United States Patent 11,001,841 (CCCTC-BINDING FACTOR (CTCF) RNA INTERACTOME) - sequence listing, part 15

SEQ ID NO: 37321 - DNA, 1024 bp, Homo sapiens
acgttataaactcactaatattgggactgggtcttcaactgttttttgcccagtgattttttgcctgtaggtactcaatatgttgaatgaatgattttagcatatcacaggaagattgcagatttggatactgttgcacttatatatatctggaaaggattttatcttaaatatcaaggaaaaaagctaaagttagcttctactgttttagagcatttgtgcagaatgtcatcagatgaggagaaatactcacttccagttgtgcaaaatgactccagtcgaggcagttctgtctcttcgaatcttcaggtaggaaaaaatttctaaatttaccatgactttttttattttaaacaaatgaatgtaagggaaaactaggattttttaataattttttcatccatttacaagggagtttttcaatttataataatatcaaacttcaggaattactgtacacattttaggagtgactttacattgttttaacttttcagaaaatattgatgaactcttcatacactctgtacaaaggcttcaaccaacacagtaagaggtgaaacaaatgttcaagaaacatttttttgtttaaatttttttcattttagctacctctcatgaatgctactttcacttttaatgcaaattaatacaatatcaaaccatccaaagttctagagctcaagattcccttgtgttctacttgctgaggtttggtctctgttgtcacaacattcagtacaatctgctgcccaggacctggacattgacagataaaatgaagtgggtcagttaactacagagggtgtggtatttacatgaaatgttttaaatttctcttatttctaaatatttcatcatcaaaaatatggatttagatttctggagtagattttaaatatgagaataatgacatggtatatcttaaattttacagttgtattactcaaggggaaaggctgtttatgcctaagcatatgaaattgttattgattctgtacgatatgagaaaagctttaggaaa

SEQ ID NO: 37322 - DNA, 1020 bp, Homo sapiens
ttaaattggtaattttttttgtcagtccataaaattctacatgtttaaattttttgtggacctaccaaccaggaacatgttgcttctcaggtcctagtatatcctccaaagaatataccacaagtttttccatttgactttgagctgctgttgaagtggtgagtgctgtgttttgagcttattttgaacctagatccttgtgaaaggtacaaatagaggtaatagttaagttatggcatttattagaagttttattatttggcttcctttagaattattgtgaagtttaaaaatagcctttctcctgcaaattttcctagtctttagtaactgttagtgttctatatagcacaaacttgaatctctcagccaaaaaagggaacatatatactgtttaagtatggcaagttttctttggtaccaatttgtttagataattttaaaaatgttttttagttctagctactaaaacctgtatgaactcaaatggataggcatcttgtgagggtgtgtttttcccagtgtgaattggcttgaagagccatgggctaaatgggtactagaacaacaactgcccctcatgtacgccaaggatgagctctagatcatttgagaggcacagtgtttccggagtcagggactgcagctgagcgcaactgccccatctgaccactgactcaaatacgaactgcttgagacagacttcttttatgtagttctttgcagtgtccattgagacactataaccagccttgtaacaatatgttttctccttttggtgctaaaaaatgaaaatattagaaagtagtctacacattaaagattgaaattcttaaactactgatgaagaaagggcaacgtgacagatgttagcagactgacccttcttacagaaaacctacagatttatttgttcattatacaaatatactacaaatataccctaaagggaatctccataagttcttttactagttttagctttgacagttgcttccacaactacctacaaagactgga

SEQ ID NO: 37323 - DNA, 1031 bp, Homo sapiens
aggtaaaaaatgtatacactatctataaacttgcctttgacatatataacccaatttctgattttaaaaatttaatcccatgttggacataaaaaaggtatcattcatggtttcaggttgtgctttaaaatggtctttttctaaaattggatgatttgtgttaagcattttaatctttgcttctaatctcgaggcaaggaaatgattaaatggccacagatttaaaaattattgaaattttgggttggattaaataatcccattggatttgaggttaatgcttaaaattgttttaagaaacactgtgaaaaagagttcttttgaagatctgacacatttcctagtgaggcaaagaaaattaaaaattttaggagtgtttctcagtctgctggcatcttggggcaagataaattgagtgagaattgttggattccatcttataggacttgggagtgatgctcttgaagcactttagatctgttttgctgtgagagattagtaccaatggactactgaatcttatctctgatctgaaaaaacaaatctcttagcatcaggggctcagaaaatgtttttaaagggcaattaacttttctaaatgtaatcacaagaaatgtttatgaattgtacccttcgaggagaaggagttggggaggcttttctctattttgtgactttctatactgtttaatttttctaacggcatgcacgttatttttattaaaaatttcagtagtagtgttatgtagtggggggagaatatgatccatttttctttgtaccactctttaaaaacaaaacaaaagattaggataggaacaggacttagaaacactaatatattcaaagattgtttctttgtatcccaactttattttgaaaaaagttaaatatacatgataaagacagtatggtttcagaaaagatagagactagatcactaagagttgtagccctacaaattatctattttaaatgttacatgttttttctcacttttgtgaaaattaatatttaaaagttttgtattt

SEQ ID NO: 37324 - DNA, 1024 bp, Homo sapiens
accacgcccacctaattttttgtatttttagtggagacagggtttcaccgttttagccaggatggtctcgatctccagacctcgtgatccacctgcctcggcctcccaaagtgctgggattacaggtgtgagccaccgcacccggctttttttaaaggttttaaaaacttgtaaaagttatacatagtcatagtagaaaaatatgaaaatagtgaaaaacattaaaaatataaaagttaatattaaaatctttccactatccagtattaaacaccagtccacatctttctaggtgattttctgggcctatgtatgtgtgtacatgtgtattaatatggtttactgttttgtaacaatatgtcataaatatatttccatatctaagtttatattgttaagcatacttttataacttaatttttaataacagcattactatttcattttgttgatgtcttattcaattctcaattcgatgtgtagttatcttcagatttttaagattgtgtatttgtacatatatgtatgtaacaaccttgtacatttatgtatttccttcaggataaattcctagaagtggaattgttggatcgagatttacatttttcaaggttttgatacatattagcaaattaatctttgaaaaaaatactaatgtatagtagggcattaggcaatacaggaatgtgctgatttcttatgcttttgccagtactgtgttgggtattttcctgttttatatttcctgattcacaagtcaataaatggtatctccttgtttttagatttctttgattattaaaggagttgaacatcttttcacgtttactgaccatttgtatttgttttgccttttcaggtccttttcccatttttttttctgctgtatttatcttgttcttaataatttccaagaactccttatgtatcaagtataataaacctgttttgtcatccaagttgcaaatttttcccagctttttgtcatttcagtgtatttgtgtgtgtgtgtgtgtgttttaga

SEQ ID NO: 37325 - DNA, 1052 bp, Homo sapiens
agagaaagctgatgttggaggtgattgagggatgtgggctagtcactgattagggagggagtgagttgagataacaagacatccgttgaaaccctagagagaatgggagcttcactgtttggaaaagtcagtaaaggaagagagttcttcaggacacattcagtatgggttttagtagatcatctcaaacatctcaagcatttgaaagaaatagtttaaagtagtatgaataaggcttttttttggagatgggtttttcagtatggtaggtatttttcacttaatgaaatgcttgtttttagagcaggagtagtattttatcctcttagagcattgtaataaaattttatctgtctttttcatttagtaattttcaggttggtagcacccacagaaggatcactagaatgggatattcttgaagttaagcgcctccttgatcaccaggataatattctctcattgattaatgtcaatggtaagctcattgtgtacatttattatgtacagttttgtgcttgttaacacaacctgctctgaacacgagccttgcttagttctgggattctagaataagtcactaaaataatgggattgtcattctcttttactctgaagttttagccggtggagctgagcaagtttcctagattgctaggtctaagatttagggacaaggaaaatagtgtaaggcagagaaaatagaggagaacataatgatctcaggcactgcttggtagctgtgggatgactgtcacaggctgtttcagcatttttggcagctgtttctggctagttcctcttttgtagagagattggaaatatgcccttttgtcttgctgtccacaccatacaatatcacatagcaagttacacacttacactagaatgagcaggattcaagccagttgtaatcctggttgaagactctcaaagaataataccaaactaaagtaaaagtctgcagaaaatgggtcatgtcttcccttccttcctcgtggtgggggttttgacctgctgtacatcctatttggcttcctaaatgattttaa

SEQ ID NO: 37326 - DNA, 1068 bp, Homo sapiens
tcttatctgggtggttctggctcagggcctctcctgaggctcctgctatctgaaggcctgactgcggtggaggagctgcctcccaggaggctcacctacgtgcttggcaagttagtgctgtttgttgcccagaagcctcagctctttgctacatggacctttctccatgtgactgctttagtgtcttcaccttagagcacgtgatccaagagagaacaaggaggaggccacagtatcttttatgacttagtcttgtaagtcacacaccattcctcttgccagaatctgtttggtagaagctagtcacttagtagtgcccacatgatctactaaggagaaataagctccacctagtgaaggaaggggttaaagaacttgtggatatatttttaaaccactgaacaatgactgcttaagtttctaacctgatatacatttcaaataaattttgcagtgtttaactgttcttcagagactagatgtttggctttctggtgggaatgacctgtgtgtgtggaaccgaaaattagatctcctgtgtaagactagccacctttctgatacaggtaaaaaacatcaaggtaattttgaactatgattgacagactagaagacacagcagatcttcagagagactttccataagtagaaaggtcaatataggggatttttctttttcagttctgaagataacaggtagccatattcaattcagatcggggttgtgtaaaatatatttttatcctgaatcaggaggagaagactccactcaggaacaaccttttccaatgctcttgggctgttttcctgaactgtgtttggtgagcacgctgatacctagaagcagacccttacgactttacagtagcatttgtggggtcattaactttgaataaatgcctaaggatgacctctttttacaattgtccttaccaaaaagatcatacatgtgcaagcttactgataaagtttcattttctcacaattctgtgtacatacgattttggtttcaacagaaaaaaaataatcaaatcagttttgactttttgataccaaggatcttaaaaa

SEQ ID NO: 37327 - DNA, 1043 bp, Homo sapiens
tcttagatttgatgaaatacggtacatttctaaacaatcataaagttttaagatctcaaagcaagaaccacatgtaaggtgtcttcacatttccctaactcctagcacggaatcacactgaatacattttttgctaatcggtaaagaaacatttctctcaaaatcttatctttaggcttaagtttttgctttctgttactttagaatgtttttaaaaattagtatgtaaaatgttatctggcaatattactattcttccattggatagaatagcttaaactttattgacattttaatcctttttttattttatagttcattacttcttttcagcagttacactataccttacaattaggaattcttgggttgtatttccatttctgatttggagatggttgaagtgtatgcttgactgactaggatttagtttaagataaactgataaagtatagctagttttttgttatccatcataataggatgggtaattgtaatttgtgaatgatatctcaaccctttattagtttttttatgacaggtactaatatgtgtcaaagttatactggtttgtattttaaagcttaatgtttcctctttaggggaggtagtaataaatactgaaatggcaaaaaaaaaaaaaaaatggtagcaatagaatatatataagaatagaaggcctgaataatctaccaaccaggtaattgaccttgcagcaataaaaaattgactgtgatttcatgcattactattgagccttatttagatttaacttttgttccctactgattgaattaaagtttgaggttaaatgctctatatcccatttctaaactctcagctgttctcagtcatctctcattgtgaactcatgaaagtcaaacatgataaaacaatcataagaagttaaaaattagggttagaaaaaaagtatgtattttaaacttgctgtcttctaaatgcaattttaagtttaaagaatcaatagaaattgatgttttataccaaagaacacttaagaccttgagtcctgccctccccac

SEQ ID NO: 37328 - DNA, 1044 bp, Homo sapiens
tgtcattatgatgttagctggttattttgcttgttagttgatgcagtttcttcctagcctcgatggtctttacaatttggcatgtttttgcagtggctggtatcggttgttcctttccatgtttagtgcttccttcaggagctcttttaagacaggcctggtggtgacaaaatctctcagcatttgcttgtctgtaaagtattttatttctccttcacttatgaagcttagtttggctggatatgaaattctgggttgaaaattcttttctttaagaatgttgaatattggcccccattatcttctggcttgtagagtttctgccaagagatctgctgttagtctgatgggcttcccttcgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggagaagttctcctgtataatatcctgcagagtgttttccaacttggttccattctccctgtcactttcagttacaccaatcagacgtagatttggtcttttcacatagtcccatatttcttggaggctttgtttctttttatcctttttttctctaaatttctcttctcacttcatttcattcatttgatcttccatcactgatacccttagcattttttcaatgttattttattgtaaatgtaataatgacttcaggcagtgattattgatgggtgttaacatcacacacacgcaaaaatgactgccagaaatttgtttcctaatggagtatacaaactgcttatgaaatggtcttaccaaagagtcagatttgaattggattaagtctgtagatttaaggatcagttttctaaaaatacagaatacagaggtgcatgttagatgacaacagaggaaagtagtcagcaaaatctgggctgtgagaattatacaggagagacaactagggtacatgtg

SEQ ID NO: 37329 - DNA, 1032 bp, Homo sapiens
ctcttattagtttgagatatgtcccatccatacctaatttattgagagtttttagcatgaagagttgttgaattttgtcaaaggccttttctgcatctgttgagataatcatatggtttttgtctttggttctgtttatatgctgaattatgtttattgatttgcgtatattgaaccagccttgcatcccagtgatgaagcccacttgatcatggtggataagctttttgatgtgctgctggattcggtttgccagtattttactgaggatttctgcatcaatgttcatcagggttattggtctaaaattctcttttttggttatgtctctgcccggctttggtatcaggatgatgctggcctcatgagttaaggaggattccctctttttctgttgattggagtagtttcagaaggaatggtaccagcttctccttgtacctctggtagaattcggctgtgaatccatctggtcctggatttttttttggttggtaagctattaattattgcgtcaatttcagatcctgttattggtctattcagagattcagcttcttcctggtttagtcttgggagggtgtatgtgtcaaggaacttatccatttcttctagattttctagtttatttgcatagaggtgtttttagtattctctgatggtagtttgtatttctgtgggattggtggtgatatcccctttatcattttttattgcgtctatttgattcttctctcttttcttctttattagtcttactagcgttctatcaattttgttgatcttttcaaaaaaccggttccgggattcattaattttttgaagggttttttgtgtctctatttccttcagttctgctctgatcttagttatttcttgccttctgctggctttcgaatgtgtttgctcttgcttttctagttcttttaattgtgatgttagggtgtcaattttagatctttcctgctttctcttgtgggcatttagtgctataaatttccctctacacactgctttgaatgtgtcctagag

SEQ ID NO: 37330 - DNA, 1050 bp, Homo sapiens
gcctcctgagtagctgggattacaggcatgctccaccacgccctgctaattttgtatttttagtagagacagggtttctccatgttggtcaggctggtcttgaacctcctgacctcaggtgatctgcctgcctcggtctcccaaaatgctgggattacaggcgtgagccactgtgcctggcctttctaacttctaataaatacaatttaagttaaaatattgaaccatttaacataaccataacttttttctgattcctcttaataaggatatacttaccaagatatgagctaaacacctacaagttctgccatctttgaacgtctcacagagattctcattctaggcagagatcctacaagaatccaggatgatgatcccagattgccagcgcaggttggaagccgcatatttggatcttcaacggatactagtaagcaaagacttctgtgtcatgtttaaattttttttttcaatccaatacatggaaagccaaaagtttaaatatttaacactgagaactagttggcagtatttcttattcacttgccctttataccgctatattttaaaataattaatggagtttaaattgtgttttgaattatgcctccagtaaaagtactgttttctagcatgtttgttcagtttattaaaatttagctagttaaatttatttaagttatgatagtaccagtattgtccagcaatgtcttgattatttggttttcatacataaagatcttttgagacattgaggatgagttgactgattaaaattttaaaagatctaatgtttcaaaagaatttgggatcttattaaaaggatcttgaattctttcacattcaaacctagatcagtttgagagggggaaaaaacctggtaatctatgtagtcccctcatactaacttggagctgaataacacttatacttgctggtataaatgccttgtgatacagaaggtagataaagcaggaaataataactgttaaaatactatctaagacaggaagcatcatttgtatttcttgacagtttaaatgcttt

SEQ ID NO: 37331 - DNA, 1033 bp, Homo sapiens
aagatattcaaagaggtgtcgttacatccttcatccttccttccccaatgttagtatcttgtataaatataatacagtattcaaaccatgaagtttgccttagcacaccacagagcttactcatatttcactagttatacctgcactcatttgtgtgtttgcatgtatagttctctgcagtagcatgtgcagcaaccaatcaagatggagaactgttccatcgcaaagctccctcttgccacttctttttagccacccaatcctctctgctcccaaaaccctaaataattacactgcctcaagaatgtcacataacgtagaatggaatctacagtatgtaaccttttaaaattggctttttctattttatataattccctttaggtccattgaagttactgagtgtatcaatagtttgttctttattactgctaagtagtattccatggtttggatgtactaacatttaacctttgatgaacatttggattgtttccaggtttttgctgttgtgagaaaagctgctgtgaatgttcatgtacagttttgatgtgaacataggttttattttattttattatttctgtaggttttgggggcacaggtggtatttggttacaagagtaagttctttagtggtgatttttgagattttggtgcacccatcacccaagcagtgtacactgtacctgatttgtagtcttttatccctcaccccattcccaccctttccctctgagtccccaaggtctattgtgtcattcttacgcctttgcatcctcatagcttagctcccacttataagtgagaacatatgatgtttccttttccattcctgagttacatcacttagactaatagtctccagtcccatccaacttgctgcaaatgccattaactcattcctttttatggctgaggtagtattccatcatatatctatatatactgagttacctcacttagagtaagtctccagtcccgtccaagttgctgcaaatgccattaactcattgctatttgtggctgagta

SEQ ID NO: 37332 - DNA, 1035 bp, Homo sapiens
ataaaactactttggaaagcaatttgatgatatttagtgaagtagaagttgtatatatactctataaaacctctttagcatcatctgacttgtcatcagtacattgatttgtactgtttaagagtggaacctttattatttctcataccgcatcttaccctagcctttattcactataattttacatgcttgcattattgggttctcactaactgactgattttttttttttctttttcagggcaacacatgctattcaataacttgtttcctgggccttttcacaaaatatgactttttaagcaaaaacgtaacttgtatttattttgatattccaataaccatgcaaatacgcagcacctttacttatcccatgtgataggtagttaagtaactctttaatgttgctggagccattgctgctgttttccatagacaagcacaatgaagtaggatgacttggattaccagtcagaattatctgtgggcttaggcatagaatcctcctcttctgttgtatacttcttcaaaagttaccatgttgttcttattgctcaatttttgtgaatcactttttttctgcttcagaattgttttataaatatatatttctatctttaaattgaaaatgttaaaagacagtagtgagatttctagactcaattttttattcattcaaccaacattgagtgcctactatgtaggaagatcaattaaacaatatgaatacaaccttatcctctcttcaaggaacttaagacctagcaagtaaatggcttcggtgtagtgtgttaatgctgatataattaagtaggtgatggacagaattaagtggaagtctttcaagtcaggggtcagcaacccttttttgtaaaggaccagatattatattttaggttttgcaggccatatggttcttctatcacaactactcttctctgctcttatagcatgaaaacagccatacatgatacataaatgaatgagtatagctgtgttccaataaaactttatttatggatattaaatttgaat

SEQ ID NO: 37333 - DNA, 1048 bp, Homo sapiens
tatgaaatacttcacaatcactaacagctgtattttcaaagaacatttaatgacattggaagtgattattatccaaattattgttatttattagtattattatatattttttgagacagtcttgctctgttattcaggctggaatgcagtggcacaattatagcttactgcatccttgactccctaggctccagggatccttccacctcagacttctgagtagctggaactacaaaggcatgccaccacgcctggctaatttttaaaaattttttgtagagacaaaatctcgccgtgttgcccaggttggtctcagactcctggcctcaagtggtcctcctgcctcagcctcccaaagtgttgggattacaggtgtgagccgctgtacctggcccaaattatttttttatatatctaaatataaattttcacacacacatgttgagagaaaaagactactggacagtactcaaaatgttaatacaggtccataatcccttactttgaaaacccttgggcccatatgtgtttgtgaattccaaatctttcaaattttataaaagtaatgtatatttccataatagcatctagagaaatgctctacaatcatacacattaatatttctgcagtgaaacgtaactattcacattagatggtacacataaattctataaatcattttatctcatttgaggttacactttgctgctaaatgagtttgtttcaaacaataaacaatgttctttttttaaaacttctttgggtttcaaaattatgtgtattttgaatctgtagtgattatgagtgatttttaaaattttgtttttttataattttttataaatatgtacatatgtacattacagaaaaatatcttaatacaaattttaaaatacatacttgtcttcagtattcttattaaatcttagcctttcctgcaaacgagaggagccaaattcaccagaagatactaatttgttgattcaacaaatatttatccagtaaatactagagagaaaactaatactattttaataagcataaaga

SEQ ID NO: 37334 - DNA, 1030 bp, Homo sapiens
gaggctgacgatagttgccctgcttaccacgcagggtaattatgagttatttcattcagcaaatatatctgtgaggcatatattctgctaggtgtgatatgagacatattttcacaccttgggggatttatttttaattgtcgaagtagacaaaatttcaacctattgtgatgatgcagataaatatgctatgaagatacatagacaaaggatccacagtgtcagcttgggagagtggaaggattgatgttagagtggtcctcctggaagacaggacatttatttgagttaagttttgaagaatgagttggttgggagaggatgaggagaggagacattccattcagaacaagcagcatctccagccccatctcattttatgtgtttctgggtagcacacttttgttttattttaagttttgttaggagaggatactgtagcaggttcttccttagttttgctgactgttgacatcttaactataattctcaagtttgggaacagtgaaaaatctcacttaggactttataatgaccacaaggattggtggaaaatgactaaaactcactgaattttaactacatacattgtactgtatagaccattagcactaaatcatcagcttctgatgtcaaccttagttcttccgtactaaggaactagtgagaattcttaattaatgcagttgacttgcatttttccaattgacttttttcttcctgcatccaagtagtaagtggatacacttcctggtgccatattgtttcctttgaagcacagtgaaacttcttaccccataatggtctatagatttagtatctagctacttaattcccactctccattaagttgcagtttataggccttgatattttactattcaacacctaatatcctgtaagttacagaaatactttgaaaatgtgatgtagatagaaggtaatattatttattctgagtattatcctttagtagccaccatgattattaaaaacaaagtggtcttggtttgttttttgtttttttgag

SEQ ID NO: 37335 - DNA, 1034 bp, Homo sapiens
gttgtgtagaactacaccttagaaatttaggaacaaatttatcagtcactaaagtcagaattttgcatattactttttcatcattttggattccaagttgatggaatctggttcactagctcttaataagcatgttgaaaaagtgttctgtgctcgaattagtttgggaagggttgagttaaacaaagtttaatatgtttctttactgtaagataactcaaaagctgtgattatgtgaaacctttaagaggggaagagtgtacttccaaatacactttggaatttccaaaagtttatttttggaatttggtatttccaaaactttatttgttcataaaaacgttgttactttcgtttacttttgccatatctattaacatttctttgaagagcattcctttttcctctataaaagaaagcagttgttaccacatttgaatggcagtttggttatatttacatgatcaattaaaggacagattttcccctcatacataatacaagttagagtcagctggctgtaattacagctcctgtgtctttgtttaatcccaaatgttacagttattacttggggtttttaggttgaccagaaaaaggaatgtttgtcacagatgtatgtttatgtataatcatgatagtctatccacagtcagggtcctgaaagattctaccaagtaattcatcagaaatagttcaggaagactgcagaacaacagcttgcaaaaagttgtgatgctcttcaaatgccataaaagacataatttatatatttttttctgtttttgtgagataaagttagagatttttcgtgtttttacatgctaaaacaatactattctcctgtttaagcctccagttgtgaaaatgcaacattttaaaataatgtttactggcaaattcaggaagtcaggctgtaaaatgaccattttactttgagtaaacaggtgaagaatgaaagggtaaaatatttgatacagaatagactttttttaaactacaggctataaataaggtgacttagacaagaaaga

SEQ ID NO: 37336 - DNA, 1053 bp, Homo sapiens
tctggataatttttgtatttttagtagagacggggtttcgccatgttggccaggctggtctcaaactcctgacctcagcaatccacccgcctcagcctcccaaagtgctgggatcataggcatgaaccactgtgcttggccaatcgtttctaacttttgatgtaaagttagagacatgtgattcttcctttcacttgaacacttagaggccattatagagttattgactgacctgattttaatattgtgtctcagggagtagagaggcctgaagagagcaagagaaatgagagaacagccagtcattggagcagtcagaatatacacattcatcgattgagtttgccatcttatataggcacagtttgtgggaccgtaaaacaattaacaatagtaacataaaaggtcagtgatcacaaatcaccgtaaaatatataataatagtgaacaaggttgaagtattgcaagaattatcaaaatgtaagagacacagagtgagcacatgcttttggaaaaaaggcactgacagacttgtttgacacacgattaccacaaaccttcaatttttttttttttttttttttttttttgagacagagtctcactctgtcgcccagactggagtgcagtggcacgatctctgctcactgcaagctctgcctcccgggtccatgcctttctcctgcctcagcctcccgagtagctgggcctacaggcgcccgtcaccacgcccggctaattttttgtatttttagtagagatggtcaaaccttcagtttcttaaaaagaaagaatgaaataaaaaaacaaaaatccaacatcagcaaagtgcagtaagataaggtaatgcctgtgtatgatttcataggacccagatacccatttgtttatagagaaaacgttttaagattgagagaaattctaaaactggaaacctgtagtcactctgtggagaagctatagctctagaaatgttttcaggagtgtttcagattacttattgggaagacattttcattttttgacaccagataatgacatcaaacataccct

SEQ ID NO: 37337 - DNA, 1049 bp, Homo sapiens
ctgcataggggatttcttttaaatagaggcagttttgttttattgcaaaatttgttttattttgttttgtttttaatgcaaatttatgaatagagcacataaagctggccttgtcatatttgccaacaccatttcgcatgtaggtaaagcatgtatgaaagaataaacagtaagcatatgagtgaatgaaggacaaattaagccaaataaacttgaatgctcttagttgtattgaatttttaatagagtagaattataaaattaatatttgatagaaacgaatatctaattttcactaaaatgattaatcctattttaggaaaattaaagtcaagttaattataaatatggactaaaattagcagttgaatcacagcaaagataatgacaggattatattgaattgggggtcatgtttgacatggtgccataggtgttatgttaaatacagttttatttaaatcatattaattacttggaagaaagcatgcaagaaagcctcaaaggatgctaaatttggattgtaattagaacagagaactgaaaagagctagagtgacgaggcatgtctcggtagataaacaatgaaattccctttgaaaaattaatccccttgagggaaagtagagtagattttcgcattaaatattttgtttctgatttggcatttgccaatctgagtaaaatttgagtaccttatttaagagactttctttttatgttgtgatcctttgtatttattcaggatgttaataaccaaaatcttcataatatgtaaaatctagatacaggtaccttggagatatcgctggttcagttccagaccatcacaataaaatgagtcacacaaattttttggtttctcaagtgcatataaaagttatgtttgctctgtattgtagtatattatgtgtgcaatagcattgcatctaaaaaatgtacataccataatttaaaaacactttattgttagaaaaatacctaacaatcatctgagccttcagtgaattgtaatctttttgctgttacatatcttgcctcaacgttga

SEQ ID NO: 37338 - DNA, 1049 bp, Homo sapiens
aactttataaggttataacctagtaccctgctatcctgttcagctttgctgctcttctcctgtgcactcaacaaaccagccttacttaattttcaaagcaaattttaatgttcttttttgctttagagtcttctatgttcttagcacctagaatgctgcctccctgcttagtactcctgccagatatcctttttccagtctctgtcctgctaattcctactcatccatcatatcctaactttgacatcattttctaggggaagtattcttaatagccctcccctagccccacatttaatttggctgtcttttagcaaacagaatatcatccccaaaatatatttattttactgaagagttgtggttatgaaatacattttaaatgttgatgttgtattcttatttggataactgagtttctagttgtggaattccttagtgtcttttttgtttgtttgtttttggtaaggcccccagggtgccttttacttgccactgtagttcaaaagaagaagatataagatgaggatttgatgaatagttaagacgggacaaattattgtgtccacttcttattcttgttaacagcgcaggaaacgtcaagtttttatttagctgttatatggaggaacagtgctagtgggtctcttgatgtttaaaaactgatttttaaggactcagtagtatatttgcctggtgaaagtgggcagggaagaggaaggatccagccaaagatgattggccttctctatagagcaagatatttcaaacttttgttgttgttgagacagcgcctcactcactctgtttagagtgcagtggtgcgatcttggctcaccacaacctctgcttcctaggttcaagcgacgctcgtgcctcagcctcctgagtagctgggattacaggtgtgcaccaccacacccggctaatttttgtatttttagtggagacaagggttcaccatgttggccagtctggtcttaaactcctgacctcaggtgatccgcctgcctcagcctcccaaagtgctgggattacaggcatgagcc

SEQ ID NO: 37339 - DNA, 1026 bp, Homo sapiens
aaatattcttcttctcaaatattagagagagtactctgattgggatattcagagtagctcagggtagttctccctgagctatatcagcagcccaaatgaaattgagccaagggccaactctaaactcaagccaactttcctactctttattgttggacttggtaaatatatcaacttctgaatataaaatctcccttcaggttttcattaaatattcggtttcctctgactagaatactccctagccatctgctctggataatacttaactagtccttaacttttaggtctctttttaatcattacttttttaaaaaaatctattttttttcttttgctgttacttctttcttgaagtcttccatggttaatggtaggatcaggtgctctttgtatgtgccccacgcaccatcaaacctacagacttacttgcatcgcacccctactatccttattacctcctcttggaataaaagatctgaacctcttattgaaagccaacattctgtgatctcaatcctatccttttgccctgtgtgttgtcttttcttaatcctgtgtctctaacctctaccagtttcttctcaatagcattcaggtatggtgaagtcacttttatcttacagaaacaacaccaaaaacctctatcctatttctctctctcggaaccacacttggcaaaggaattatcttctccacaaccctacctcctagtcacttcttaacccattgtagtctgatttcttttcttagtagtagcagtaaaaaagatcacccataatttttaaagcctttatcttgccttcttagtaacagttgacacagttgtcctttcccactttcataaaaagctttcatcctgttttcttgttacagtgatacttcagtgctttggtttcctgctatattcttcccccttattattatttttgactcttttctctgttatttatgcaacaaaaatttattgagccatcaatatatgtcatgtactgtttgaatgacagagatacaatagtgaataag

SEQ ID NO: 37340 - DNA, 1047 bp, Homo sapiens
ggataaaaagaaaaaactaaacaaaagttacctctgagacctgtggttacagagaagatagttaatgtgggggaagggtaaaaccaagtaactattaaaccatatggtataatgtaaacaaattgttccatttcgtaggctggtatcatcagcttcctgagaaacctttactataatggattgtaaaaataactactttaaggacaaatttcttaattgtaaatgctgcaaaatgaaggagcttgtttgggttgatgcaggacccacagcaattaaacaattgctgacgagtatatgtgatccagatgcacaggaggttattcttgcaaccagcctattggaccagatgatcttggtaccacccagatcaataaactggctcatctgatcttgtggcaccccctacccaggaactgactgagcgcaagaagacagctttgactccctatgatttaatctctaaccaatcagcactcctggctcactggcttcctcccacccaccaaattattcatagaaactctgatccctgaatgctcagggagactgatttgagtaataataaaactctggtctcccacacagctggctccatgtgaattactctttctcttgcagttcccctgtcttgatgaattggctctgtctaggcagtgggcagggtgaaccccttgggcggttacagtgctatgggacaaaattaagatttggtggccattgatgttgcctctggccacatctcctctggggagaatgtaaatcaaaaataaaattggaaccctcccccacccccaaccatcttaatggactcccttcttggccagggcactaaaatttaacctgaaagactggtcaggctggccggcgcggtggctcatgcgtgtaatcccagcactttaggagcccgaggcaggtggatcgcctgaggtcaggatttcgagaccagcctggccaacatagtgaaactaaaaaatacaaaaaattgtctttactaaaaaatacaaaaaattagctgggcgtggtggtgggcgcctataatcccagcta

SEQ ID NO: 37341 - DNA, 1050 bp, Homo sapiens
gtggtaataacatctaattttgtgctattacccccacctgatgtaactactatttttaatcttgtgtttattattaccttttaaaatataattttatttgtgtattgctaaaacgtgtcatttacttttggttattttttactttataagaagggcattttctgggacttaccatttttcacctatgttgataggattcagccctaaatttttactcttaggtgcagtacatttttttgatggttgtgtaatactccattgtttgataataccgcaatttatccattcctcttattgatgagcatttggattgtttcacttattaactgtgtttctatgtacattcttgttcatgtctctgttaattatgtctgagggtttttcttgggtatatacccaggaatgaaatcgtttggtcataagtatgtgagtattcatcttgtaagatgcgtatcttagttcaagctgccctaacaacataccatagactgggtggcttataaatgatagaatttatttctcaaagttctggaggctggaagtctgagatttagggtgctagcatggtcacattctggtgagggctctctttgggttgaggactgctgtcttctcattgtatcctcgagtggtgggaagagatctggagagctctctgaggtctcttttacaagggcactaatctcattcatgagggctccaccctcttgatttcattaccttccaaagaccccatctcctaatagcgttacattgaacgttaagatatatgaattggggcattggggttgggaggaagggatgggcacacaaacatttagtcgcttgcaatgccagacttccaaagggattgtacccttttatgttcccagctgcattatgtgggaattcctttcattgacccacatcctctccaatacttgatagacttcttaattttactccattatactgtctttgtttagttttcattttggaaaaaaattgttttgcttgtctttttatttatttatttattttatttatttattttttttgagacggagtctt

SEQ ID NO: 37342 - DNA, 1034 bp, Homo sapiens
ctagtctattgtggaaaatttaaaaattattacagttctgtcaaaaagtttttgtagtttacctagaattaactagaatagattcttaaattctagtttaatagaggggtctgtgtttgtgtgtttaactgcctgctaagttacatagactaatccactccaggttattattattattattattttgcaacttaagaaaaatagtagggacataggtatgtcgaaatctcatggggagtaggtggtatttcagggaaacaaaagagcaaaggtttggtcccagtgcttaaggaatttgtacattgttaagttatgcagtatacatgtatatgaggatttattcctagaacttcaagtatgaatgtacgaatgtatgtttttattctcattttaatggatatgtagtttagttttctttttttttttttttttttggccctagtttttcacttgtacaaatggtgccacaatgtacattgttatatatggcccctagaacacatatgtaatggttagcgtaaggcagaacttctcaaagagtagacccagaatggatttcaggtgtgtggaagtatatctcttctcagctataaggatggccaggtgtggccaagagcagccatgagatacatgggggaagagtcattcagacagaagaaacagcaaattcaaagacttgaaaaagggagtaagattggcgtgtttgaggagcagcaaccaagtgaaagagaggaaaagggggtaggagattcagaaaagtaggagggagagggtacagatcttagaaggacttcatgtaaggacttgggcttcaggtgtcaccatctctatgagagtttcctggctatgtccaatgttagtgcccccttttctgtgttcccagagaactttgtagttttcactatgatagtactaaaaatgcattaagctatttgttctgtttactaggctgatagcttccaaagtatggtctaggaaccccttggggtccctaacacccattcaggggttctgcaaagtagaaattagtttta

SEQ ID NO: 37343 - DNA, 1096 bp, Homo sapiens
aagaatgcaaatgacacgtatacttaagtagacgtaaagtctccccccattagctttagctgtttatatacttatatttaaagcaatggtgcatagaagtatggtggactgtatctgggataggttaagaacatagtcctgtaaattattcctgtaagatttgctagctttgttttcttttatcctcttttgcactgtaccccattgctaagttcagccagatggctaccttcctactttgaaatttagctagttcctttaggaatttgtgtaatgtattcagttctccaaagtggtggtcagaggccatgtcaaaatggattgcaggtggtcagctcttcaccacattctgttaactacttggcaagtagttactcttaggagcaatatagcaggcaaccagatgtctcttcaagctggagagggagaaggctaaggccactcatcatcacagttttcccaacacaaggtattttattctccaggttgaatgtggagatgaaagatctttggccctgtatgtgtatgggtgttttgttttttcattgcatttttttgtttggttggaaattttgaaaatctgtagtaagcaaggttggaaaattttattaataatggcagtctaaaactcttaagacagtaaatgcttagatgtgtgatgtctattccagtattctacttccagtaatacctttataaaagaatataataatgttctattgtgatgctgttgtgtccaaatagaactgatttttttcttaataacttgtcataggtctaactaaagatcactcatttagcagcctcactcagaacctacatcttactgtctttgaatcatctggtatggtgttggcacattatactcagtaaaagtctttgcaatacacagatgaaggaatgaaatcttcctttataaggattttgaacctgatcggataagcagtagagagccactgaatcaattactatattacagcataatagttactatattcttgcaatatagtaattgcagaatagttatttattcttgcagtgagagttaaatagatgggctcccaggctccacttactacacgttattacatatgtg

SEQ ID NO: 37344 - DNA, 2006 bp, Homo sapiens
tatttgtcctagagttcagtttgggtaggctatactagaaagggtggattaatttagtttctgattagacctggtggaacacttcaggtgactcagaagttcctgatagtgggtctgaggaagaaatgtggacaggcaggttgaatgttaggggaatatggaaacaggcaataagtagatgatggtatttggcgtgtaggagatccagccatgcgtgcaagacggccatttcagcatgttggcaaaatggcagagttgacctaatggatagcagcccacattataaagtagaaacaagtttcagggccagtatttttaggccctgggaaaataggccggaggtttacggtgagtgtcttgttcctagagaaactttgttaccttgtacagtaaatggcaaagcatctgatttctgggaagtgagtttcaagagagagaggttagattactaggaataaagaaagagtctagatactaggaatggcttagaaggtgagagttggacagaatgaggctgaattggtgctaagcctctgactctgagggctccttaaatatcttccagcaacaagattttaatagtattgttgttatttttagttgacacatacatatttacagggtaccctgtgatattttgttacatgtatacttttttttttttcctgaggactaattcttgctgtgaaactagagaaatgtatgtaacagaggctagatgggttattatattatttttatttttattttttcagagtcagagtctcgctgtgtcacccaggctggagtggactggtgtgatctcggctcactgcagctgctgcctcctgggttcatccctgcctcagcctcctgagtagctgggattacaggtgtccgccaccatggctggctaatttttgtattttttagtagagacagggttttgcctggctgatcttgaactcctgacctcaggtgatccacctgccgtggcctcccaaagtgctggaattataggcgtgagccactatgcctggccctaggtgggttattatactaagtttctttgagcagcagcctttgttcacatgtgactcactggtagtgggtattagttggcaggtttgggtgtagctggctctttgttttttttcttttttttttaagatttggatctatgtttccagcagattgctagacctattgatatctgtgacagggtcacaactaatctggcagctctagcagagttaccaaataatactcagttttttcccccagcacagaactgttgaacactctgttttttttttggagcgggggaggatatctaggtggcatcaattatcacagtttgcctgagactgaggggtttcccaggatgtggaacacttcactgctaaaactgggaaagtcccaggcaaactggaatgattggtcacctcttctgtaactagctaacatagctctgttttatgtgttctgtgatttatttggaggctatttacagatagtacaactgtgagttgtatgttgtaccttaatttaaaacttaagtgcatggtgtaaatatgaatccttgacagagtagcttttgttctgtatttaaattattaatgatttagaaaataattttcactaaagtaggagaaaatgcagaattgatattttctaaatgtggtatttcagctaagtgacttatctgcaccaaaaaagtttccaagtgggatttgtgttcataaaaaagtttgttttttattagacttgtgataaattcaagaaattcttctgcaagtaaaaaacactcacaatcatttaacataaaaggttatttaactttaaagccagctttcaataaagcctgttaaactagttcactggtgagtgaatgaattgattaaaaatactttcttaaatatatctttttataaccattttggattggtaatggcttaaaatccaatgtgaacaaagaatgttagggcattggaaatagcactgacattggcccatagttttcctct

SEQ ID NO: 37345 - DNA, 1061 bp, Homo sapiens
tattttaatcctatttgaatgtatgctatctcctttaccctccccatcttatgataaaaggtctctcttttttctcttccaggtttgcagctaaaactgtgcacagtgggtcattgatgctagtcacagtggaactgaaggaaggctctacagcccagcttatcataaacactgagaaaactgtgattggctctgttctgctgcgggaactgaagcctgtcctgtctcaggggtaacctgcttacatctggactttagaatctggcacacaacaaaagtgcctggcatccactactgctgcctttcatttataataatagcccttccatctggcagtgggggtagaatacactcttgacattcttgtctcctgctttagaatgctagtgtgtatctatcatgtatgcaatactttccccctttttgctttgctaaccaaagagcatatattttactgtcagttgtctcaactcttgaatccatgtggcgttttctctgtcctgctgcttcttttggcctcctcgttttccttctctttttcgacaatggtagacatgaatgagatatttaaagttcattggaaatcttcttccctacagcagtaagcaaaaattagcaaagagatagtctaaatggcctctcagcttggtatgtgaaaatgagatcacatactttttaaatccaaatacaaaagcatagtctctgcaagattttgttctttgaatttcttgatattgtaattgattattgataactgtcatcatgaaattatctctcaataataagataaataaactagcatatgaatcatatttgtctttgcatttttaatgagaaactattaataatcctgaagttcatatgctaaagttttcttattttaaagcaagtattttgagtgttacattatgcagagaagcaatgtggtttagttagcgaaagaaaaaccacttccaaaccaagtaaattttctacttatagtttactccaaggaaaaaaaattggtgtatttaataacaaaaacaaaaatcttcatattgcaaaataaacatcttctaggt

SEQ ID NO: 37346 - DNA, 1030 bp, Homo sapiens
gagaagagaattgatcgatggcaaaaattagtttaaatattgtttaaattattaaagataaccactaaaataatagaaatgtgatgtattataacttctaaacagctaaaggtaggaagaaagggagtaattaaaacctgatcagagctgcgtgtggtggcttatacctgttatcccagctctttggaaggccaaggtgggaggatccctcgaggccaggagttcaagaccagcctggccagcatagcgagaacttgtctctattcaaaaaaataataataatttaaaataaatgtttaaaacttggtcagtttaaccaagaggaagaggaaaaagcatggcaaatataaaacaaaaaaaggtggctggagaggccatgcacaccacacatactagttttcacaattcacgtcagagattaaatcctacttttactaaacaggtaaaaaacaaaatttaacatatgctatttatgagaaacctccctaagagagaatggcacagaaaagttgagattagatagatgaagtgtgtgtgtgtgagcgtgtgtgtgtgtgtgtatgcatttatcagatagatgtgctaaaactagaaaaattaagaagtattttaggtaaaaagtaataataaaatattttgtgttcattgtaatcctccaagaaaatacaattgttacaaaccattaaaccatgcacttttgtaatttataaagcagaaaacaatacaaatactaggagaaattgtcaaagccataatcatagtatattttaacatgcacatcagaaatggacaaatcagagagtaaggttaaataggtatagatacatacaggtttaatgatttaattaacaagcttgatctaagatatatatgtttacatagaattccttgtttcctgtgtacagaaaatactcattttttaaaagaacatataggatgtacaaaaaaaaggaaaactatgggataatatgattaaagaaaaaagacaacgaagaaagattagagaggagaaagatgacaaagcacagag

SEQ ID NO: 37347 - DNA, 1035 bp, Homo sapiens
taaacttaggaaacaaggttaaaaaagtaatcaaacattttctttttctttgtgttttttttttttttttttttgagacagagccttgcttcatcacccagacttgaggacagtggcactatctcaggtcactgcaacctccacttcctgggttcaagtagtcctcccacctcagcctcccaagtatctggaattacaggtgcatgccaccacgcccagctaatttttccatttttagtagagatggggtttcaccatgttggccaggctggcctcagactcctgacctcaagtgatccacccatcttggcctcccaaagtgctgggattacaggcatgagccaccacacctggctatgttttcatttactacctttctgtagttaaacaagtatatattattaccacgaagtgtcatttatgatcctgtttattgtgaaagagtgcatagacctctgggaattatcacagataacctttggaggttgtaagggagggcctttttagacggtgaattcattagagaatgctttttaccttgaacttggttgaatgtggaaagaatgagtggagagaattatactgtttttctttctttattcatcccttaacatattttttgataattataataaagctgtagaattttgagacaaagttgaaaacacaaaataaatgtttggaccatgcatcctaggattagactgagagaaggaatcagtgagtctgccaaggcttgatggctcttaaatgactaaaggcatacttctaaccaccttgtatgatatctacagtactgattcctggccgctgtgaaccagacctttgttctgttctgctctagtcccactcctctacccttgcctttctccaactttcaaatagtcttcccttttacattacagtttcagctttctttccccgatattatatgtaggccaactttttatgaatttccacagagataaagctggctacatcaacatttatttaatgatttgataacaaatatgtttgtggaacaatgtagaataa

SEQ ID NO: 37348 - DNA, 1078 bp, Homo sapiens
ataataattaaagaaggagactttcaccagcaacacactgtcacatgcagtgtcacactgactcctcaaaagaatcctatcaattagatacaaatacaagcacagagaagttaaatgattttcttctcatcaaatagcttgaaggtcttctaacttaaaatccagtgttttccttcgtaccactgccagctgtaattctgcctcatgagaaggaaactaaccattcttacttctgaggaaaaatgtttaatatgttaaaaatacgtatagcctgagaagacctggccagtgccacagtgcaggagtgaggctcaatcccaggacttgacccggaacagccatgcagccaggtgcctttgccatgaagaaaaccaggccttatgtagtaaatcacgttctctccatccccacctccttactgaaaattttaaaatatttacacacagatcaaggggaataatgtttatataagtaagtgtgtgtgtgtgtgtgtgtgtgtgtgtgtgtgtgtgtgtgtctgtaggtctgtctgtctgtcttatggtctcagggaacccatttccccatcctttccctgcatcaggaaattttcagcaacttgtggtacctggaactggcatctaggatgtatgaggatccttttcccttctgtcagattcaaagaaagcatctgtagtttaaaatcactatacccataataaaattccctttccaatttgtacatctcctaagacatacttctttccttatcgccaggacctcttctaggtgacatccgcatccttcatcaaggggaatccatgtccctaagtcacaattcacttaaatgcaaggcaacacagccagcttttagaggccacagtcccatctctgaaatatgtagaacagcttacggtttccctcatacaattttgtaaggttcatggcctagcttttctctgggaatctccatttggatcttgaagtcctgttgtaaatctgttcagcatggccccattcataatggctgataattctgtcttgacgaaatcattgttactaccaagattgtttgtgtgaagctcacctgttcctttta

SEQ ID NO: 37349 - DNA, 1054 bp, Homo sapiens
atggggtttctccatgttggtcaggctggtctcgaactcctaacctcaggtgatccacctgtctcagcctcccaaagtggtgggattacaggcatgagccaccgtgcccggtgaagaactatctttaaaaaaattttttttttccattttataaagttaaggtatattcaggccccaggctaagagacaagtccagctaagatcaaattcctttgagtttggaagagggagaaattgtaagtcaaaattaaaaataattttgtcattttaaatttaggaaaaatcctttatttgttctgatgaaaatgtcagtagtcatggaactgtggtaaaaataatgaaaaatcactggcctgggtctgcttcaattgaaaacatttttaaattaaagtgtgacagtattttgtgcttccattgcctagccatgccccatcttattcttttattcaattctctgggtatgaggttgctttaattcttaaattaaaccttaaggtatgtcatcctgctgcttgatctttctatttctatgctacttctgaggtactcataacagaccattttcatctctccttttcctagattactaaaaggagctactttttaaaaagagattgttattaatttttagttggaatttttttattgcaaaatatttttaattggcttaagcaaatatgtgccagtttgtcctaactggcggatagtactcataatgttagttgttagtattttagtaaaattccccacagtgacaaatccgctgaatcagatgctaattatagttattaatgaactagcaattatttgtggcaaaaaacccaggtcacccaaaaaaacaaaggaaacatgcacacagatctgcaagaaattgaaggattaaagaggttgtgataaagaaagccttaggcctttcgacttcccttcctcctcctttgtggtaagtagttctgctggctgtgagttcacttgtttcagagctgagagttcactgaacatctatccacttttccctaagattatgatttttagcttttaattattattattaaat

SEQ ID NO: 37350 - DNA, 1101 bp, Homo sapiens
tcctgtgaggctagaaattagctttgacttcttgttgatttcaaagcacagtatggctttgacagactttacatactgcttatcctattttatagtttcaaatttcaaacctctttacaatggtttcctcttagaatgcatatttgatgcttgtcatgtcagatcttttttgctatttgccttttttttaatcagcatgaaaatgaacatgcataatacattaacaaatcttttcaggtgtattgtaacatatttttgtttgtattatttggaggttaataagtatttccaggatcttttatttattatttgaagtgaaatacattaaatagaaatcagtttttttgaccctgtgactttgtattgcattttgaaaatgttgatgtgttgaggtgtataattgaataccatagaaacaaaatggagatttgaggatgatgaattgataactaggtattttttgtggtgagattctaagatcagttactgttgtccttataaaagtctaatacagtcactcagctgttaaaagcctaatcctctatttaaaaaaatatacaaaaacaaattgtctatctttctgcctgatctcttctcaagtactaacacaatggaaacagtgggtgatctgtcaatgtgtttggtttgtcgatgatggttttgtataaatattgggagggtaagaaataaaatcgcacagtaaaatatgatttcatctgccttttctctgcagctccatggctcatgctgcggtgtgaaattctcattttacacactttgcaggcggagcacatgaattatgcattgagcaagaaaaatctcctgcctcaagtcctatatgcatttacccaggttctgtctctattaccaagatgaattgcaaatggagaaatgtttgatggaatagagctcttaacttcttcgtttagaattcagaattttatttttatagtagatcctttaagtatgaaaatgttttgaacttactatggattttttaaaatgaaaaatgaaatataagaggaataccaaacacatcatgaagcattttatagcgttgattcagaatgcaagggttttccaattcagtagaaatgacca

SEQ ID NO: 37351 - DNA, 1031 bp, Homo sapiens
cttttggttgcttcactttttacacgcctctgacacccaagtgtgaatgttgaccccaaattagtacttagtacacattagtcttttgagatattaattgatgtgaatgaatttttctttaatcttcttttttccctctaaatttttcctgttgtgagacctcattcactcctatagcttcagctaaaacatttatattaattacttccatggtaacatctttcagtctttacattaagtttcagcttttcttcccaaattcataccaaatttttagacctctctgaggctactggttttccaaacctaatacaatcaaaagacatgctctaccatttgtcaccagcattcttttcattctcccagatctgaagccccagaattatctctgactactctgtcattctgtatgtttagatagttaccaactcctatatgttctgtgcgttatttctcatgtctgtttcttctttccctactgccactattctagattagctcttcattacctgcatagaccattgccattggtcatcctctgaccaatgctttcccaaccccaagtccttctatacaactgccagatggatattaaattcacctgtcctgatggcccactgccatttgagttcagtaaactcaggctagcttgcccaaacctaccttgtcttaaccctacccaccttgtgttctttctttctttctttctttcttttttttgagacagagtcttgctctgtcacccaagctggaatgcagtggcatgatcccagctctctgcagcttcgacctccaagtctcaggtgatcctcccacctcagcctcctgggtagctgggactataggcatgcactaccatgcttggctaattttttgtatttttaatagagaggggtttctccatgttgcccaggctggtctcgacctcctgggctcaagcgatccacccacctcagcctcccaaagtgctgggattacaggcatgggcaaccgtgcccagccacacacactaaattctaatcccagtggaa

SEQ ID NO: 37352 - DNA, 1032 bp, Homo sapiens
aacagtgggaggcctttaccatgcctcagattgaagggaaggggtgtgaggagcaggagcagttaccagaccctgcaggagtgagccacttgcagtaccttcagtaggggattgcatgtaataccagggagaggaggctggcagagtagggatccaggataacaaatatccccgccctccccccaccatctcctgctgaagctttctattgactaaacacagctataagccaggaccaagggagtctggttgaggcagactacaggtgggcctcttagggcacagtgctggggagagaaaggtagagtggactttatagaacaaatagagaaaatccatctcactctcacaatcccattctttccggctttgcactccatgctatttctacagtgacttctttactactaccactcatctttactactcacttttctgggcatttcacttaaggaaaaattttttttttagtttgctgttttctgcagaatagggaaaatgttgtttagattgtagataattgatttccactatataatttataggaatcaaagagcaatatttgaggactctggttaaaagccaaagacatagaacactatggtgagcagcataatccaacgtcttttgctttcttaatctaaagatgcagagataagaaaggaactacagaagctaggagacagcaacagaggttagaaattaaagttaactctcctagttaagacagttgttcacacctcaaatttggaagcgcactcatggttatgctttcacatagtcttttaaggcttgtattaaatagaatgtttttctaatttaagtttacattttacgaagcatattgcatttgaattgaattatacatatttagtatgaataatttctatctttttcagaaatagttgttgctgaaagtgtggttgttataaagaaattactgcaaatgcaacctgcacaacatggtgaaattattaaacatatggccaaactcctggacagtatcactgtgagtatcaattaagagatgtt

SEQ ID NO: 37353 - DNA, 1060 bp, Homo sapiens
ataccctttatgatggaaaggtcatctctgaagccttagttgtagagcacagcaatagaaaactttacatcagtattatgacttttatattccactatctgttttcttaacaaaaatataccacatactatgcactaatcacagagtttttcttttatcagcttccaacttttagagatgtattttttgccatagttctcctatatgccaatattaaatttcttcttggttataagacactgtatacacgatttctttttagctatgtgatttttaaactttttacaggaatagtagaataatatggcatgtccataatttatattttcatacctggattactccacttttatgttgtgtatctttctagacaaatttcttaaaaaattaagatgttctagaaaatatactattttatgttattattcagtaatcttatagctgcagatcattgcttgaatctgattttcacttcattcctataattttatttatttaaagtattggtctttgtgttttttcttgttcctttcctgttgtcctatctagtctctttgggtgtcctctcactgtccagtttttgcttatatcaagtctcctgggattgtaggaaaggagacttaggtaatgttatggaatgggttgtatagagggcacatactagacctgtttcaaaatattggtcatctagtcttttcatttaatatcaggatgtttaataaggtccatttttcagtcaaacttttaagtatttttttcatgtattcatttttatcactgtctaaatttgtaccttctgtctatgtttgtgttatgctcatagttacgcttttagtaactttttgggtaaaatagggaatgtttctaaagactcataagttcatatttttctttaaggaaattaaataatttatttgggaacacttttaaatataattggtcttgccttcatggaactaggagagtttaattaatttaatttatttgttcaatgtttaatcacctggttggtaccatttttagcaaatttgtatttttttagacatctttaggttttctc

SEQ ID NO: 37354 - DNA, 1055 bp, Homo sapiens
aaactcaatgtgcaaaaatcagaagcattcctatagaccaagaacagacaaacagaaagccaaattaatgagtgaactcccattcacaattgctatgaagagaataaaatacctaggaatccaacttacaagggatgtaaaggacctcttcaaggagaactacaaaccactgctcagtgaaataaaaaaaggacacaaacaagtggaagaacatttcacgctcatggataggaagaattagtatagtggtaatggccatactgcccaaggtaatttatatattcaatgccctccccatcaagctaccaatgacttccttcacagaattggaaaaaactactttaaagttcatatggaaccaaaaaaaagctcacattgccaagacaatcctaagcaaaaagaacaaagctggaggcatcacgctgcctgacttcaaactatactacgaggctacagtaaccaaaacagcatggtactggtaccaaaacagatatatagaccaatggaacagaacagaagtctcagaaataacaccacatatctacaactatctgatctttgacaaacctgataaaagcaagcaatagggaaaggattccctatttaataaatggtgctgggaaaactggctagccatatataaaaagctgaaactggatcccttccttacactttatacaaaaaattaattcaagatggattaaagacttaaatgttagagctaaaaccataaaaaccctagaagaaaatctagagaataccattgaggacataggcatgggcaaggacttcatgactaaaacaccaaaagcaatggtaacaaaagccaaaatagacaaatgggatctaattaaactaaagagcttctgcatggcaaaagaaacttccttcagagtgaacaggccacctacagaatgggagaaaaattttgcaatctacccatctgacaaagggctaatatccagaaaaaacaagaaaagagcaaccccatcagaaaatgggcaaagtatatgaacagacacttctcaaaagaagacatctgtgcagtcaacaga

SEQ ID NO: 37355 - DNA, 1055 bp, Homo sapiens
agctgggattacaggtgcctgccaccacacctgcctaatttttgtgtttctggtagagacggggtttcaccatgttggccaggttggtttcgaactcctgacttcatgtgatccacccgcctcagcctcccaaagtgctgggattacacatgtgagccaccgtgcctggcctaatttttgtattttttataaacacaggatttcgccatgttggctaggctgatcttgaactctggggctcatgtgatcctcctgccttgacctcccaaagtgctgggattacaggcgtgagccactatgctaggccacatttttgtctttttgattgcatttatattatttcaagttgtttcattgtcagtaatttgattttcaatggtctaatcttttttttcagtttttatttttaattccgtaaatgtagtaacaccattgctttgatctgttgtttacttactcagtttgaatttcatatttcctttattctatagtttatcatcttatctttgaacttctgtttgattgatttcgtgttcttagtaacgtgttgagtgatatgcttttgacacttacatatagtccgttatatatgtgaggagtgtggtcagggagaaagatccttcttcctccttgccctactggctgttggaggtaatcaacagtctctaccacattctccataataacctaaaaaatttttgaagacactatgatttggaaagaataattgtttcatctgttaagatatatactattcatgtatatatatgtggtataaatattagattaaaatgaagtgttctgacaaaatttttttatctcaggagtacacctcctgttccctctagattttgaaatggtctattttagtttgatcacaatgtagtatattttaattcattaaaatagatgtctggtaggtgaggaaggcctgatacattgtaggttggaagctcttaattaatttataagtgaaataatggaccttttctcattctcatttattaggaaatacttcaggctgtgtcatctaagttgctgattcattccaattt

SEQ ID NO: 37356 - DNA, 1036 bp, Homo sapiens
tcactacaacctccacctcccttgtttaagcaattctcctgcctcagcctcccgagtagctgggattacaggcatgcaccaccacacccggctaatttttgtatttttagtagagatagggtttcactttgtttgccaggctggtctcgaactcctgacctcaaatgatccaggccacctctgcctcccaaagtgctgggattacaggcatgagccaccatgcttggccaacctgagatgactttggtggtggctgatcacacttttgggaacactgatatgaggacatgcagacatatggtccatgggtgagggtcttaatctgtttgtgttgctataaaggaatacgggaggctggataatgtatgaagaaaagaggattatttgactcatggttctgcaggctgtcagcttcagatgagggccttatgctgcttccactcatgcagaaggcaaaggggagacttcgtgcagagatcacatggctacagtgcaagatggggcatcaggggagagaaagggagaagctgactctcggttcttttgaacaacctgttctcaaggatgagaactcactctcaggagaatagcaccaagccatttgtgaggaattcatccatatggcccaaacacctcccaccaggccccaactccagcactgggactcatatttcaacatgacactttgcaggtccaaagccatacccaaaccatagcagggagcttattaattcattagcctccatgaaatttagaattatagaatgtgcgagctgagaaggaacctcagcctctctcatgattgaagaaactggagtttggacaggttaagtaatttgtctcagacaccaaggaagtgaatggggaaacagggaacagaactcaggtctcttgactaatgttttagacattaaataaataggttattaaatgaatagaattattctatatgaataatttcatatagaaggaagaaatgctatgtgcaaggtagagagaaattatacaagaagcctcatttggtgcaggagttcat

SEQ ID NO: 37357 - DNA, 1043 bp, Homo sapiens
ttcacttgagataaatgtaccaccccgggtctcagtgttctccttctgaaaaatagggagattggaaaatgtgaccttcctttggactttttaggcttagagtttgattctgtgaagctccttgtccccttttgactcacttctgaagatgactctccccttcagcttggcatctcaccacccagaaatattaaaggtgggtttcaagattgattcatcattttcttgtcagagaaatatccctgctttattctccttggacacacggtgcctcaggggcatgtgtgtgtgtgtgtgtgtgtgtgtgtgtgtgtgtatgcatgtgtatatcttaaaacttttgcagggaagtattactgaaggcttttgaagagtcaaacatgtagctcaagggaagccagcacacactaattattaatcctgttgaagagccctggttgaccagagagtaggatttctgtttagttttccctcgctctgttgtatttgcacatccttgatgatttcatgcctttattatgggctttattgatttgctggtatgtagatgagactcctggtttgtcatgtaggagtgcttcttatcctgaggaacttgatggtgatctaactaccttcgagcaaaccagtggccatttactggaaggggtgggacatcttgggccataacactaaacctatctttggcagtcattcagaagcaaagcataggtatccttcaagactgtttacatgcagtttataataaggcgttagttgagtgaattccatgtctgagtgtggattagtccaacatattttggtactctggtgtgcatcacattaatggcaaggtgttcattattgcacaaagattagtatggctctcaggtattatttgaacactccagtgagttttctttttctttttcttttcttttttttttttaagacagattctcattctgttgcccagcttggaatgcaatggcaggaacttggctcactgcaacctccacctcccagtttcaagcgattctcctgcctcagcctcccaagtacct

SEQ ID NO: 37358 - DNA, 1028 bp, Homo sapiens
atagctgaatttgtctttcctttcgagcttctctgtggaccatttcatcatttttatcatttctctcagagaaagtagagatagccgattaaaaatacccaattttattactcagtgatagctcatatggaaggcttgtgggaataaaagttaaaaacagttgactaataggtgatttatgattaattctacaggttctaatttataaaggtcactttttgaaaatattagtgacgataatagaggttgagtaatcttgtacagtacacatttaagaaaatcaaggcagtacatagtcaaataattgtcccaaaagactttgatccagccctgcttctcccaagggagaagcctattcagccaggtcctctcaggtcttattataaactggaggttcggctcagcccaaagaagccagctcaaggtatggatttgggactgactgacaccctttccaggagggtctgccatgttgaagggatttgcacacagcattttcacagataccgtctcatttgtagaaaagtcttttagcttgcagattctagggaaggaaaaattgctcttatgttatgaaatgaactggtgactcctcaaatgttaagttgttctaacaacttctactgcttaggttaggaagcttgaggtttttgttgttgttgttaaacaggaattgtaaatacttgtgtgttacgaaattatttgagcagaattccttctcataggaatgccagggctgacctgagacagatggtgtcctgagcaggctaatcattggcaccttatcaaactgataatctttttttttttttttttgaagtggagtctggctctatcacccaggctggagtgcagtggtgtgatctcagctcactgtaacctccacctcctgggttcaagcgattctcctggctcagcctcctgagtagagtaactgggactacagacatgcacaactacacctggctaatttttgtatttttagtagagacggggtttcaccatgttggccaggctggtcttgaact

SEQ ID NO: 37359 - DNA, 1034 bp, Homo sapiens
cattaggaaatcactgtctccccagctcatttggtgccagccttaagggcactttaaatgcaggattaagtgctgctgtaaaagggagtccagctctttgaagactgcgcctggcaccaggcctctgggttgtcgctgtttactggagctggtttcatagaagtgattctggggattggggcaaggaaaggcagcctttatgtagaggaagtgtgccatgggtaggtagttgactgcttattagtttactctttcagccaaattatttttgttgctgttaaaaattagttttaataattgcttttggatcaagctgttgaataactgagccaagttttcatgcccaatgaacttttatagcaaactctcctctctttatggggttattttgaggatgatatttgtaaagcactttaagtgcctagggaaggctgtggataaatagtagtcatattttcagagttctggaggaatgactatacaatggcattccagttctgaaagatgcaaatcctactctgctactactgatttgttttaatggctattttcctatttttaatttttaaagggaaatttatgcaaagatcaggatgatttttatattttcattaaaattttcaactagattaaaaaaccctctttaatcggatgggagaagtcttcacaaagtcagtttgaatagtaagtaggagatagtaggaaaaatgctccattgtcagccaacagctaaccaaattaatgtgtaatggaatgtcataatccttttctataaagtaatattttgtttctctcttcctattctcttttgtcttttgggagaagaaacaaataaataaaaatagttgtttcgttgtttcggagagaaatacactgtctagaaaggactgtcttaaaatgcactgtggctttttaactcatgaagctcctaccatgtgtgcatgcgttctcagaactcgtctgtatcacatgtgggaaaatggaattagaaagacttctccctttgtggcctccgtatattctgagttttaacg

SEQ ID NO: 37360 - DNA, 1049 bp, Homo sapiens
tgtttgaacttctcatgggggctgttttttggcactgatatagttatctatgagcttgtcctgttgtgtggtgctagcgtagtgctttggagcaaatggtaaatgtttacttgaacccaaaatatactgtgtgcaaagccatgcaaattagaaacaaattaagaatacatatgtgttaataaaaaatggcttatttggaaaatctagtttcattcattcatttacatgtggggaaaacttgattattctcttcaggattcttgaaagtataaacaaaagtgaggtgggagtgcccaccttccccagctatgagccttaagcatttatggagggtattttagaatgcacactctttagtgcagaagagtttcagcattgcctgtggatgaaggcacaccttttgcttatttgtatacttattgcatgtgacatagtttcaatgcaatagttctctctctctttctttctctttttaaagcaatctatgggggtctataaccatagtggcagaaagaaagttaatggagactaaacaatagtgttcatgtttacaaaattaaatgctgaaacatgatggaattctgtattaatggggtttcaacttgctataaaatgaaaataatgtgatggagttctgtattcgtaagattccaatccgctataaaaattaatgttaataagcaagaagattggttcatattcgtggttttcttcctgcaaagtcaaatagtatacatgcatttgttaatgactccctgaataaggtctaaatcacttaagtacagttttatatggagtggaagtataagaatcaaagtttgtggttattttgtaagaatttgcttccatttttacaatgcaagtcagagaaatcttgatgtgttccatcttttcttccatttgtatcttctctattttcctctagatgatttcctcccctattacacatgctgttttcccacagcctagataagatccccaatcatcaccccagtttcatcccccttctttacaaggcctgaccccgttaagggtctccaagttcttcc

SEQ ID NO: 37361 - DNA, 1083 bp, Homo sapiens
caggctggagtgcagtggcgcgatctcggctcactgcaagctctgcctcccgggttcacaccattctcctgcctcagcctcccaagtagctgggactacaggcgcccaccaccacacccggctaattttttgtattttttagtagagacggggtttcaccgtgttagccaggatggtctcgatctcctgacctcgtggtccgcccgcctgggcctcccaaagtgctggaattacaggcgtaagccactgtgcctggccggttttgttttttaaagtcagtttggttgtgagagagaagctaaatccaagacttggaaaatgatccattttctgtacctgcttagcaggtgagcttggccagcggcagaaaccatcccttttccctgggggaagagggggcggtgggagtgttgggggcgtctttcccagaggacttgaagagaagggcttgactctcctgagattgcatgccacctaggtaatgtgcattagtgcatgctttctctgtcgtatctgaaaagagtcattacatttgcagagttctcagcctctggctggcaaaaagaaactgaacttgggcattctgctgccaaagccaaagcttgtgtaagtggtggagtatgttttgagaacagagtggggatgggttgggagattctcttgtctctgctgtcggagtaaaccagaaccgacagaggacttacacagaagcactcccgagggaccagaactctgggaatgtctgtgaagaactgacccactccacggctcacagccatttcccgactcttcttcccctggtgtccctagattgggcttagtgccccacattctaagattcataagatgttcctccatgttcttgaaatgaaacacacaaaaaatgattccattcttatcacaaataaaatgtctttgtcctcaagggggcatggtactcaggaaagatgggaacacagcctgtgaaaggcagaaattgataagaactgtctgttctgcctccctgaccttcctttgctgttagcttgctctgcggccttgggcaaatcattttgcctctttggattggaaagggtgagggga

SEQ ID NO: 37362 - DNA, 1003 bp, Homo sapiens
gtgaagcctcttgaaagagaggtcactacctatctctggccatatgtcccaatcctgccattgtatagggcagtggtttttactgagagtattttagaaattcacttgagtgttactgatagttagtgagtagggggctcaggatgcaatgcccgtaataaccccacacagtgaggaattgtcccaagtcctgtacaacttacaaaatatcctgctggttagtcatgaagattaaaagcttgtttacaattttctgagactagaacctaagtctagtctctatgttttacacataaacacaaagtattttttgcgtggttttaatatataattaatattctaatctttattttagcatttatccctgctctctctttttttttgtatttctactatagaatggccttaagtccaaatttatttcgtctataactgtatgcactcatctaaccactttgctatgtcttttagggttgaacctgcgcattttcctatgaaatacatgctattttattattaattgcctttttctactctgtattacactgagagttattttttttaattagacatatagttacagtattgtatataaattccatttcaggacaaaggagcatcacaaaatatttgttatgaaaagggtggggatgttagatttgaaaagcctgagaggcatgttatagaaacaaactttcttctgatttcagtacttttcctatcattatagttgctattacataaaaatgtaaagtcttggaatgagtccatattactgcttcaaaataaccaaaacaataaaaatggatttaacttctatttcgcctacaaaatagcctaacacaattattatatccatcaagtctaggacatccagccatagtgctcacacatatgcatagtaatcacaaatttcagtgcacaaacttagatctgcaaagaatataacttacttcttttttaccctgtcactgaacgcagtacctctggggtccctattctg

SEQ ID NO: 37363 - DNA, 1027 bp, Homo sapiens
ttcaaggtgagctgttgaaagaactggtaccatttctcagtgtgaatcagggctttctcaatgctctgtcactgaaacaaaatacagaaatagggtctacataagataacttctgtcttctgtaaacctagtctcaaatgtttgtttatgaaaataattttattttgaatgacttaactgcttaagtgtgacatcccatgccttctgttaatatatggggctttgatgttgtcgtttttaagggttggggaggtgtagctaagaagaagttaaccaacaccactttctttctgtagcttatttgcctctcttcaaagtcaagttttagaggcttatgtgtattgtgtgtttctttttacatgtattattttgatactgattatatcacgaggaccacgtaactttgtgtttgcattgctatagaaagtttagagagttaatatttctgttatcttaaatggtcctctttttttcatatttactcataaacttaactgcttacaaattatctctgatagaagtgctctcaaattatactctttgtatttggttttagactactgtatgatatttgatttttatttctagtttaagttacaattaaaattagtctgaatttgagtagaatatgacttacactacttggtcaacaaattgagcatgttcgacggtccaggaagaaaaaaggagcgatcagtactcaacattggctccaaataacccacagaatttgcaaatcacttgcaaattgtctaataaagtttaacttttaaacaacttttgtttatatttttctacttagtgattaatcttggtctcctgtagcagagcctttattttacaattacaatctgtgcattaaaatctcagcgttatacataatagtataaggcatagaactacctagactatggtgcatggccaactactccatctcacaacagttttcatacaatttcatgacctcagtgttatcgttatccccattttatagatggggagtctgaggttcagcaagataaagtga

SEQ ID NO: 37364 - DNA, 1121 bp, Homo sapiens
ttctctaatatgtacagttattatgtatcttcactacagtttctagcaattgagtgatactctctacatatacatttatttgatattgaggcaaagcaaagaataacatattcagaggatcctaaaatcacattttagagagttactttcttgtctaaatctttctctagagttgccagtaaacagaaaaagttaatttctttttctttctctgcctgctttcacctgtgattgctaataattatgcattaggagaaataggtggacagcaataaaaatgagatctaagtgatccataaataggtcttcaagcctgtcttggtatttgaagtacctagagtgttgcctggcacaaagtaatgagtcagtagattttcgttgagtggttagatagattgataaccaagccagtcattaaaatcgtattgctctctgggatggccaagtctaaaatctccttaaattgtgctaaattaagattctgcagctcatcctgacagtcaaactgcattgattaccgcaatattggtaataacagagagttgtattgttttctaagtgatgaattgacatatatacatgttacacttttgtttctgaaggaagtagaaattcggaacaaagacctggagggacaactgtctgacttagagcaacgtctggagaaaagtcagaatgaacaagaagcttttcgcaataacctgaagacactcttagaaattctggatggaaagatatttgaactaacagaattacgagataacttggccaagctactagaatgcagctaaggaaagtgaaatttcagtgccaattaattaaaagatacactgtctctcttcataggactgtttaggctctgcatcaagattgcacaaaaaaaaaaaaaaaaaaattgaatatcactcctccaggaggaggatcttttgaaattggaattgtatatttcactgtaaattttagaatccagcttgtagctagttggggaaaaaagatgaaaaacttgaactacaaattacctccatgtatattattggccatagttaactagaaagttataaatagacacttaatgcaatcttttttcctgatattagccaatgggagaattaacaatgtct

SEQ ID NO: 37365 - DNA, 1107 bp, Homo sapiens
cttttgcagagacaatcagaagaaagattgtatgtcctttaatagtttttctttggtcttaaattttcctttcttgcttatttttccctttaccccgcaagattcctttctcttccttttatcttctgctttttggaactgtcttcagcctttctaagactacctcctcaagtttcgtttatactgttaagttcctttcttatagtctgctctggttttctagaacttttttttcagtattctggcattcacactggtagtggttttctccttcttggggttaccgtagtttagtctgagcccttttgttctctactcttctgggcattgcccccacaactctgccttcccttttgcaaagggttagagtgagagcttgagaaatacctctgctggaaattggtgcttatattttctaattaaaggcaatttgatgtttgtattgttctgtatcttctagttatgtcgaagtcatggaatttgcatgcctttgtatagtttgtatagtttatatagtttggggaggatagaggactgtgattgcagtgtacacagtcactattaccttggctgcccagaaatctattctgtttacctctttatagccagagtcttccttatagaatgtatgttctattaaaacaagaaccatctttgttttatttactactttatccccaatgcctagtacatagaaaatgtaattgttgaataactgcttcaaaatgtgtgtatgttttacccatttttctattaaattattctacttgtcttgattatttatagttcctattatatagaaggtaacagtcttatagggcaataatacatcttattcataagagcttaagaagtatatcagatgtcaatttttctacagcttttatttagattaaatgatgcaagatttaaatttatagaaaattaaagctgggtttagtactgtaatcccagtactttgggaggctgaagcagaaggattgcttgagactaggagtttgcaactagcctgggcaacatagtaggaccctatctccacaaaaatattttaaaaattagctgggcatggtgatgtgcacctatagtcctagctactcaggagctgag

SEQ ID NO: 37366 - DNA, 1052 bp, Homo sapiens
tgcctcagcctcctgagtagctgggattacaggcgcccaccaccacatccagctaatttttgtatttttagtagagacgggttttgccatgttggccattctgttctcaaactcctggcctcaagtgattcactcatgttggcctcccaaagtgctgggattaaggcatgagccacccccttggcctcttcaatttttaaatagtgttgttcaaagagaagtttttaagtttatgaagttcctgtgatcagtttttttaatggaccatgtttttggtattgtataatatctaagaaatttttgcctagcccaaggtcacaaagaattttttcaagttttatagttttatatcttatagaagttttatatttttaatttgcgtatagactatgagatatgggttgagatttatttatgtttgtatgtggttatccaattgttttagcaccatttgtttaaaagactgttatttctccttcgtattatcatacctttggaccttttataattatcttcattttaataattttcatctctgtgtagatctacatttctctctggggtcatactctcacttaaagaactttctttaatatttcttgtaggacacatcttctagtaataaattatctgagctcttgtttacctgaaaaactctttatttcaccttcattttgaaagatatttttcctatgtgtagaattctaggatgaggattgttttctttcaacactgtcactccactgtcttctggattgcatcatctgtgatgaagtattactatgcagtagtccctccttaaccacaggggatatattgcatactcccagtggatgcctgaaaccatggatagtagtgaaccctatatgtagggtttatgtttatgtttttttctgtagatacatacctgtgataaagtttaatttctacagtaggcacagtaagagattaacaacatgaactaataataaaataggacaattataggaatatactgtaataaaagttatgtgaatgtggtctctccctctctcaaaatattttatcatact

SEQ ID NO: 37367 - DNA, 1045 bp, Homo sapiens
atacatgtgatacaggatatgtttgcacttgtatttctcttgggcttcttgaatttgtgtttctgtcttttgctgactttgccaataatctagtttcctgtgattatttccttaagtagtcttcctgaactgtactctttctcttatttttctcaaagtcagattgcataaatgttagactttctagtatttcccacaggttcctggggctctatcaaatttttctcccatttttctctctgatgttcaaactggaaaatttgtattgattaagctttaagttcactgaccctttcctttctcactaccattctgctattgggtccattcagtgtatttttaaatttcagttattatattctttagttctgaattttccatttgattcctccttatatcttctatttaatggctgaaactttctccctttccagtccctcctattgtatttgcccttagttgttatagcattttcataactgctttaatgtctttgtgagataattccaacatctgtgtcatctcgtcactgacgtttattgaactatcattgtctatacaacttcagattttcctcattctttgtgtcaactaattttgaattgtattccagatattttgtctattatgttatgagacactgggtcttgtttatatcctatggagaatgttgatattgttgttttaggggaccatagttagttaggttcaacagttgcaagtttccgtgagccttctgtgagctgcagttccaataccagttcagttttcaagtcttcttgcagggctatttgcatctgtcccatgtgtgcactacacattaaccagtctgagacttgggtaatggaatatgccactgttcagttctcaaagtgtgtagactgttaagagcagatcctcaaatgcacagctcaggaataagcttataaacacagataactttaagaggttgctttcctgagcttatctcactctgcaatgttccaagtattttttagtagactggacacaaatagttttaagtcaatattggttgcttctgcgt

SEQ ID NO: 37368 - DNA, 1091 bp, Homo sapiens
ggccaacatggagaaacaccgtgtctactaaaaaatacaaaaaaattagctgggcatggtggcgggtgcctgtaatcccagctactcgggaggctgaggcaggagaatcacttgaacccggagatggaggttgcagtgagccaagattgcgccattgcactccagcctgggcgacaagagcaaggccccttctcaaaaaaaaaaaaagaaaaataacagggtttagtgtgtgtgtgtgtgctcatagtattcttgattatgtaactggtagtttatatttacaaagcaaaagtattagagaatcttagattaaggtaatttacatgattataggccatagtaaactttccttatatgttatattatttctttgctcttttgtctattgatttagtagtatagctaagaatccagtctgcatgtttaccaagtagctggctaaagctttcagttccactgagagttaagcttatgtttctgaaaccagcataacataactaaacatttggaacacttgttctacaagttttcggatttgaatgtaagggtatctcaaccttacagcatctgggggcactttgtaacaaaagtcatttcttggaagtagaaagttgaaacttgtaacatagcttcaaaggtattctgcaaaatattgccctaatagttcaaaaatagtttctaaattttatttgaaaataaagagctcaaaagtagttctattgtaaaccagtgactgaaacatatcaagagtctgggagtacctggaaagcacagttatctttgtggagtattttgtaggcatgttgtatacatatataatcatatgaattagaaatcatttaactagcaagttatgcatctaaaatcaccatgagcacacacatgtaagcagttagtgtccagactgagcatgagcaactctttggcataggtccattttaatactacttagttcaaaatcatgtatggagcatgtctttgtgccaggtgaaaggtgaataagattgccttcgaggagcttcatgagacagcagaatatataaccagtatggatgatgtggaggtagtgatccatggggtgctctggaaac

SEQ ID NO: 37369 - DNA, 1006 bp, Homo sapiens
aatagatacatttacattttcatgtcttgattttttttaagaactgaccttcattctctaaagattttgaggaaagtgttaaaatttgctaaaccattttgtcaagcactatcacttggtaaagattattcacaagaaaaaaactattctttatgtgagataaagacattactaacccacctccaatggcgattagacccttcctcttctctacctctgccttactgttacaattaatgggaaagaattgttcatcaatccattcctagtgattctcagtttctcttttcaagaagactagctggaattacaggtgtggtcatttgccatggaacagattgatcctagattaattatgatctctttcttgtggagggctttaaaaaattcctttttcccctccatttctgttcttagcctgctacatggggatttcattggaagggaggtaggtgatacggacagttttgctctaggacgtagagaagaatgtttttttcctttggatttggccatctttcctcttacccaaatagttagggccaagatcaaggtgtaaacctaggcagaggccaggcaagccacaaaatgtgtgacatttgtgatatatgtgacagtaaatagtggtaaggcctttggtaaaatggagtgtgcagggttcacctaaacatattaaagctgtttaaaatgaagccaaaagaggttggagactaggtaacccacatagtttctagtctacatctttaaaagaaatctctgtaaagattggatccagttcttgcttcatggggataatacataagattcatacttcatgtggaaataaggtcacaatcactgatattgaaagtggtcattctccagggactgccttccttgtagaatgtgtcaaatgtagatatgactgaacagtttaaataaatgtacattgtacttttgttttctgtctgccattttccatttagagtttagcttggccgtatattcactgttgacaaaattgtta

SEQ ID NO: 37370 - DNA, 1025 bp, Homo sapiens
attaccctcaaagtgaccggagcatttatcccagaagatggtaacaaccatgagtcaaactgctactgctcttcctctctctcttttgatcctaatgtacttttgcacactcttgtcaaccagttccagcaaatccctgagttaatccttaattgctaaccctagttatgccctttaagtttaataaggtaatttatttttatttttattttttattttgagatggagtctcactctgttgcccaggctggagtgcagtgatctcggctcgctggaacctccacctcccaggttcaagcgattcttccacctcagcctcccgaatagctgggactacaggcacctgccatcatgcccagctaattttgtttgtatttttgtagagattgggtttcatcatgtcagccaggctggtcttgaactcctgacctcaggtgatccgcctgccttggcctcccaaggattacaggcgtgaggcaccacgtcccggccggtaacttgtttctgttatcatttctactgaattgaatcttcaccaatttaactgtttagcaggttgcacattcaacctttcattattttagtttggcttggcctgtcttggagagaaataagcctgatttgttaataccagagatgattattttatgatatcttactggctggttaaattttttctgactaattaatatggtccataactgacctagaagtagtcactttgtgattgctattcccattattcacttaataggatttgactttgttgtaaaacatttttatattgtcacattatactgtagattttattcgtgcattgactgtcagctaaaggaaacagctgatttaggagaaatatttaataaaaatgaaattaaaggtcaaaattagaagttttactgaaaattgaaaaatagttaagtgataatgtggaattaagaaagtatccttttgatctttaacagcttgtatagtttatagcattatggaaccattagttaaaatacttaaatgtgaaataaaat

SEQ ID NO: 37371 - DNA, 1083 bp, Homo sapiens
gttgtaaggattaaatgagttaatatctgcaaagcactgaaatcagtgcttagaggacagtgtgcccttcagaagagttggttggggatcccttttttttttttttttttgagacggagtcttgctctgtcacccagcctggagtacagctcagctcactgcaacctctgcctcctgggttcaagtgattttcttgcctcagcctccccagtagctggtattacaggcgtgcgcctccatgcctggataatttttgtatttttagtagagacagggtttcaccatgttggccaggctggtcttgaactcctgacctctcgatctgtctgcctcagcctcccaaagtgctgggattacaggcatgagctaccgcgctgggacgggggatcctttaatcatcaatgaacttcatggaactcacttagagaaagaaattccaaagaaaaatcagactctaagattctaggtttgaagtgtgtagaaagatgaggtcttcagtttcttaaagccatgaagcctttccactttcaggaattttagcaattaaatgaagaaggggttaagtgcacacactgtagagccagactgactggtttgaatttttgtttctactacctgcttgccatctatattagtccattctcatacttctatgaagaaatacctgagactgggtaatttataaaggaaagaggtttacttgactcacagttccacatggctggggaagcctcaggaaacttacaatcgtggcagaaggtacgtcttcacagggcggcaggagagagagtgagagcaagcaggggaaatgccagatgcgtataaaaccatcagatctcgtgagagtcactatcacaagaacagcattggggaaactgccccccatgattcaattacctccaccgggttccacccttgacacatggggattacaattcaaggtgagatttggatggggacacagagccaaaccatatcaccatctgatcttgagcaaagtatttagcttctgcatgcagggctgggcactgaggtttgtgcctgtaattctagcactttgggaggccgaggcatgaggatcac

SEQ ID NO: 37372 - DNA, 1052 bp, Homo sapiens
cagtgcagtcgaagatacccagttggcaaacatattgcctaaaattgctttaataaatataaagttccttttattaagattttatgctggttttcggtaattctatcactattaaacattcttaatgaaaaaacacatataatagaatttagaataattttaggtggtagagagttgatagattttaactggatgatggtttttatcactattactgtattagttttctatatctactataagaaattacactaacttggtggcttaaaacaacacacgttcattctcatatggttctagaggtcagaagtacgaaagcagtttaactgggctgaaatcaaagtgtgagaagcccacactccttcaggaggctgtaggggacaatggttcccttgacttttctagcttctagaactgcattcctggttcatggcctctcccttcatctttagagccagcacatggaatcttcaaatctgtatcttccttcatcatatcaccttctgtagctaaatgtccctctgcatccctcttgtgaggatagttatgattacatttggggcccactcggctaatccagggtaatccccccatctcaagatccttaacttaatcacatctgcaaaatcccttttgccaaataaggcaacattcacaggttctaggtctaggtttctttcggggccattattcagccttctacattcatttgaaggacctatcaacaaattcaatttttcaaatgttagtgttttttatgcagtcctacatttaaaagtctgtcagtttattgaagtcttctgttgattttccctcttctgtttacggttttactcagtgaagtttgtttttcctcctgtgcctgtgtcacaaatatttagttgtgatgattcagaagaaaaacctaccttaaaacttgcgtcattttcaaagaactaataataagtactttctaaaataggccatattaaaatttatttttatggaatccagcttttctttttttgacggagtctcgctttgtcacccaggctggagtgcagtggcacaat

SEQ ID NO: 37373 - DNA, 1300 bp, Homo sapiens
tacctgttctatcatctatgtcatttctgggtgtgtttctgtttattgaatttcctgctcattatgggttatgttttacttatccactgaatgttagatatttaggattttatcttattgggtgctatttttgtattctattattttttatttttttgagacagggtgtcactcttgttgcccaggctggagtgcagtggtgtaccatggctcactgcagcctcaacttcctggactcaagtggtcctcccacctcagcctcccaagtagctgggactacatgtacacaccaccatgcccagctaattttttgtatttttaggagagatggggtttcaccatgttgcccaggcttgtcttgaattcctgggctcaagtgatctgcctgccttggcctcccaaaatgctggtattacaggtgtgagccaccgtgcccagacttatattcttttaaatattcttgagctttgttctgagactcagtgaagttgattggaaacagtatgatcttttcaaagcttacttttaagctgtgttgtgtgggaccagagcagccttttactgtacagctaattttagctcattactgaggagatgcctttatggaaactttacccaatgtcccatgtgctctcccttctggctgaatgaacatgaactgtttctggttttatgtgagtcctggggattgttctacttgctcttcctagtggctcttctctggacttagactgtcttgacaaaggtatgtactgatcactacttagctgaaaacatgagaggaatcctctatagatttcaagtgctttttctgtgcagctcacctgtgttcagctccctcctctttaatactctgtcctgcaaattctagctgccttacctctccaaattttcaactttgtcttaaactcagggctctgttatggctcccttccctgtgctgtggtctggagctctctccagtaagcaagaatatgtgtagagcaaggttgtttcctgcctctcagagatcacggtgccatgctatttattgtgcagtgtctgaaaacttgtttcttatattttgtctagtgttttagttatttaaggtggaaggatagatctggtactccataaatgtctgggggtagactcttaaaatatcacagttaaaaataaagttgtaattgtgacacgtgtcgtgaggagagataactggtgctatgagagtgtttatttggagactctgaaagtgctgcccagtaatcatcccatacctaagtgatgaaagaaaaagcaattaagaagatggaaagtatga

SEQ ID NO: 37374 - DNA, 1029 bp, Homo sapiens
gaaccatagagaaggtcatggggccatttattctttggaccactggctacttctgaagttctggcttccttctctctaggaggagtcgtgtattcaagcttttaagttaaatgcataaaaatgagttttacttctcttctgacttgatttttaattttatgaaatgggaaataatgtttttccatttttctgttcattttgaagtgggaatttgaggtgtttgtaatgtcatgttactgttctgaaagattgacagtaaagaagacaagaaatatatgtatgtagtatgcatattagttttgtcccaccaagcctatctttgaatggcaaacattttaaaaacatctgttctagttgcacaactactctagcttctttataaagtaaacaatcttaaagtaagcaatgttggccataatttcaatattctagccttgccgagtgtgaatatattttactcagagactatgtacaaatacactaaagtggtgatggtgatcaatattgtaaagaatttattctgataaatgagaaactggatataatgtcaaaatagctattttctcaataaaaatctcaaatctcctgactgcttatgaattctcgatttaatgttatttattctttgaggtaaatcttttcatcgcgaagaattttttgctggttgaatgtggttgttcagggctgggactgagctatagacatagtgggtttttaaaaaatgtccattctttttttttttttttgagacagagttttgctcttatcacccaggctggagtgcaatggtgtgaactcggctcactgcaaccttcgccacctgggttcaagcaattctcctgccttagcctcccaagtagctgggattacaggcacctgccaccttacccggctaaattttttttttttttttttggtatttttttttttttttttaagtagagacggggtttcaccatgttggccaggctggtcttgaactcctgacctcaggtgatccacccgtctcggtctcccagagtgctggga

SEQ ID NO: 37375 - DNA, 1721 bp, Homo sapiens
ccaaaaatatgcatttaccaggcttgttacaattttttgacagtttttcatcaactgtcaaaaacttcaacccttttaaaacctagatataaatgcttacatgtaaagaaaggaagctaagcagtgggtacctgggatctctctgaactatttttataacttcttgtgagtcttaagtatttcaaaataaaagtggttttaaagtaaattcatagattaaatgtatcattatctatatataaaccatgatttaaaactttaattttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaaccctaaaaccaaaaactccttttccctaggaagtcaaaaatgctgtgatttaaaatatctaattatatttttttctttctatggtagtggggtttacttctgaggataaaatattttgaaaaagctctgtcccttgacatggtagttctcccgtgccttgtacttgttctctctccatatgcacagtgtgacaagatgctcacctttaatgaagaaggtgtagcttttcgttttaagctgtaattgtctttgtcttgatttggctatttttataactgaaatcctgagcaacagagataatttgggtggtaatgatcatcttttgtatatgttcttgatgttaagaaatattttttgctgccattcagctttgtggaatttatgtttacttttcaatattttcatatttcttaaccagattttaaagaaatttgttgttagttacgtgaaatcaaaggtcaggtcagtaagcccattatcctcaaacttgaagtttcgttggatgttcaaaatgctaatttttgcagagatataaggataaattagttttagtttgtgttcttaagggtttgcaaaataatttggctcccaaactcttgttggggtgtagtgtttgctaggagcccaggatacctgccctggacttaaattgtgattgaagtggagaggtactctaggaatttaaaaagacacaaaattatttttttccagactagtgtgccatggatttctgataagaattaacattcttgaacaaaggtatcagaaagggtaactcgagttgaaggtttgtgaatagaaggggaaatgtgatagaagattattcagaacaaaataagtagacaaaataacaaaagacaggaaaataagtctctttgtatccttattaatcatttgaaattatgctataatattttttaaaactcacctgtttggttctgggtgaagcagttcctgaaggagtgttttgtcagaatatattgttaggagaatagagggttctgtggccaagtaagtttgggaaatagtgggttagacaaagttgagttactgttggcctttcagacctttgatacgctaatgtgcattttaaatctccaagaagcacctctattttatacatcatttccctaatttattttaatatggatttcttgtttttgttttcttgagacggagtcttggtcttgtcacccaggctggagtgcagtggcacgatctcggctcactacaacctccgcctcccaggttcaagcgattctcctgcctcagcctcccaatttactgggattacaggcacctgccaccacgccc

SEQ ID NO: 37376 - DNA, 1029 bp, Homo sapiens
acccccgccgaaggccggcggcgacatcaaggcttctccgcttggctccgagttttgtccgcctcacaaagctgtctgggcggtggagtgaaaccccgaagcaaggggcgcgccctccctactctgcatccccaggaccttttggggagcaaagtcctcgaaagccgggtggctggcgcccgcgtccctacttgagatcacggggagggatgcggcctcagtatcagtcgccttctgcctttgggggatggggctgtgaagtaaagctgctctgcagctttgcattacgcacttggtctaaaatgtttgattgcaaactctgtttcaggcttatgccaaattttctggtgcacccttgaaagtcaatgtgatagataacacctggagaggttcaagaggtatagtgtaaacctttacactcccctttctgcactcttttttttcttcttccatttaaagctgtgaggtatatagctataatattgaggatttagtttcttaccgtgaccttggctctgtgttgtttatggtttgatcattctgagtaatacctcaaagtgcaagcgaaatcactggaaattatgagaaacgaaaatgttctttagaaccgctctttgtgaaacagcaaaaaaaccaagacaagcttactcattttttcccctctaaatgtgcaactgctatagtttttaggatattggaatctctcagaggaaatcacactgtgtccttgtatgtaaactgttttttgattataggcgatgtaccaattttgacaactgaagacgacatggtttctcagccagcaaaaatactaaactttttaagaaaacaggtgggtggttcactttgaagaagtagattggtagattgttgatccctgcatgttgggctttattttatttatttatttttttttgccaactcattagacaattggagatacctgggacaagatgtaaaaatagatttgagaatcactgctctaaagcatgagttctgtgatttgaaagtcatatgaagaggtagtca

SEQ ID NO: 37377 - DNA, 1039 bp, Homo sapiens
acatatacactatggaatctatggaatacggtgtagccataaaaaggaaagagatcatgtcctttgcaggaacgtggatggggctggaggacattatccttagcaaactaacacaggaacagaaaaccaaataccacatgttcttgcttaaaagtgggagctaaatgatgagaacatgtggacacatagaggggaacaacacacactggggcctatcagagggtggaggtgggaggaaggagaggatcaggaaagataactaatgggtactaggcttaatacctgggtgacgaaataatctatatgacaaacccctgtggcaattttccccttacaacaaacctgcacatacacccctaaacctaaaataaaagttaaaaataaatgaataaataaataaataaccttaaagccattctcccagtgaatgctgagccccatagccttcctctttagccaagagcagttcttgtattctgtccccaaaagctttttgatcattggcaggtaagagctttttgccctgtcatagactgtagtatgtgatgaccttgtagaatccagaatacatcccctatgaaatctggtttaccacttactcccctccccaattaagctatgtggttttatcaacaactatggtaattttttttctgatcttgtgatttaagaactaatgttacaaacctcagggagactagttagtgtgttttaagtgtagccataggcttgataaagtattggtagataacttggcagaacctgatgtctttgaagtagcaatgttcagttcagcgtgtaactctctcccccttaatatctttttagttttatctgagaaacatactacatttttttctcttttctttcctttaaaggtggatgctcaagtttgaggactgtcatggggactatcaggttttttaggcatgtgctttctttttcttcaaattaaaacctgttgtctgtctcttgtcacttttcaggacagccacactcggggctcttacaatcaggggtcataagctgctatgtcacc

SEQ ID NO: 37378 - DNA, 1032 bp, Homo sapiens
agtagagacggggtttcaccatgttagccaggatggtctcgatctcctgacctcgtgatccgcctgcctcagcctcccaaagtgctgggattacaggcgtgagccactgtgcccagccaaagttataaagtcttctaaggcctaaaacaaggcagaaattacgagtctcgctctgttgcccaagctagagtgcagtggcacaatcatggctctctgcagccttgacctcccaggctcaatcgatcctcctgcctcagccttctgagtagttgggactacaggcgtgagccaccatgctggctagtttttctatctgaaagcgtagattttaactcttattctgagcgtccacttaatctcccatgtactacttgtgtttttttaagtaatacagtaaattacttaaatttactctttgtaaattcaacaagcttgaatttctaaatccattaaggtggcttgatgatccactgtggtactgtggtgggaactctgctgtgcactggttgtagtgtgatccctgctcttaataagttgctattctttaatagaattaagccctgcatccaaaaaacaaaatctattactaaacaaatagatagtatcccacagtggtgaatttattgagacgttagagggagagataatttgggagccattggtatgtgttttaggacgtgaatttcataatgataatattcacacctgattaccatccaagtaacctgccccatgaagcagttctagcaattccagtcagtatttatgctttctgactgttaacggatcatttgagaaacagaagatgttccactggtgttgctaggaaaggcttcgtgaaataagtgacttgtatgagtaataataactatttcaatagctaattattgagtgataccatgtgtcaggttttattctgagcactttccctgtattttcttacttcatcagcactgtactcacctgaacagtaggtactagcattacccctgccctacagatggggaaactgaaacatcgagccatttaagt

SEQ ID NO: 37379 - DNA, 1028 bp, Homo sapiens
agctactctggaggctgaggtgggaggatcacttgagcccaggaagtcaaggctgcagtgagctgagattgtgccactgcactgcagcctgggtgatggagtgagaccttgtctcaaaaaaaaggaatgagtactatgcttggctggcatgtggagataattttatcatatagacccttttcctacattacacattgggcttgggttttagttctatattacctatattttcattgcctatgtcattatatttggtaaaaagtgttctgttgtgggatatgctattctcatttatcctttccatctagactaggaagcctgtccttgcctaacaggccattagtaacatagacttctccacattctgtcctcaaaactcaacgctggaagatctttgttcccggatgtaagggagagggaaatatgaaccatgtggccttctttggtgaatgttccctgctgggcttcaccacccagtgttctcccatgctcaccctcgggctgtgtgacaactcaaacatttttctcacttcccagctctgcaggactttgtggcattctggttgaaattaagaatgttatcaatttgcttaatatgaactcagagaggagcagaagacatgcttattcagattgaacagttctgcatttccagcgtaaaaactttagctttggctgggcgtggtggctcatgcctgtaatcccaactactcgggaggctgaggcaggagaatggcttgaacctgggaggcgaaggttgcggtgagccgagatcacgccattgcactctagcctgagcaacaaaagcgaaactccgtgtcaaaaaaaaaaaaaaaaatcacttttactctggtacttaatcatattgctcagagttttccacagaaacagaaccaatagaatatatatatattatatatatatatatatatatatatatatatatatatatatatatatagagaatagaaccaatagaatatataaagatttattttaaccagaacctattttccccaaagctagcc

SEQ ID NO: 37380 - DNA, 1078 bp, Homo sapiens
cacacattaagaaaactgatgttgttttatttcaaaggaagccatgaatcacccaggccatcttaaactatttgtgacaaggatcatgcaagactttgaaagtgacacgttttttccagaaattgatttggagaaatataaacttctgccagagtaagtataaggttattaattagtctgaagcactttggatttcctgcttaagactatagaaaataacatgtcttttcagactacaaattgggttcactgtgtactgctaggatgatgggtgcaccaaaatctcacagatcactactaaagaacttactcatgtaaccaaatacaacctgttccccaaaaacctatggaaataataaattaaaaaaaaaaaaaaaaagcttggcacagtgactcatgcctgtaatcccagcactttgggaggtcgaggcaggggcagatcacctgaggtcaggagttcaagaccagcctggccaacatggtgaaaccccgtctctactaaaaatacaacaaattagctgggcatggtggtgcatgcctgtaatcccagctacttgggaggctcaggcaggagaactgcttgttcctgggaggcagaggtcgtagtaagccaagatcacgccattgcactccagcctgggcgacagagcaagaccgtctcaaaaacaaacaaaaaaaaatattaagtattttaacacctgagcatgtgatgtctttccccttgtttaggtcctatttcgttcagcgatgttttatacctttcagtgttaatttcatacttatgtattctattccttttgatgctattgtaaatggtattttctttagtttcagactgtttattgctagttacagaaatgcaaatgatttttgtttattgatcttgtatcttgcaaccttgctgaactcatttgtaattctgtcaatagattccttaggattttctctatacagtataatgtcatctgcaaatataggtttacttcttcctttttaatctggattttttctttgcctaattgccgtggctagacctgccagtacagtgttgactaaaagatagcaagagcagacttac

SEQ ID NO: 37381 - DNA, 1059 bp, Homo sapiens
tttaaggctgagaaaatttaaagtctttgttatcaagcatgccagggaaatagtgataccagttagtaaaaaatgttagagctcttttttgttgttgttcttccttccacttccttacttgttggtcagtcccacacatatagtgaacagctgctgagtgccaggcactgcagggtcctgaataagagggcagagatttatacatggaaatcacttgcttatgccaactctaaagatacttcatttttcacccctctcccccaatgtaagaagaaactgaatcctcaaagtgatcacaaaattttctaccaaacactatagtaatttagggtaaatatttcttaagtaaggtattgagggaaaatgcttttccaaagttgtctagacagtcaagttgtggctttaaaagaacttgaggtgagaagggtgggaatggccactgatgagtacagaatgttttcttttttggtgtgatggaactgttctaaaagtagataggagtgatgcttgctcgactctgaatctactaaacgtcactgaactatacactttaaaagggtaaatgttatggtgtgtgatttatatcaataaagtggcttttaaaagtctttggaaccagccgggcacagtggctcacatctgtaatcccagcactttgggaggccgaggtgggcagatcacgaggtcaggtgttcgagaccagcctggccaacatagcaaaaccccgtctctactgaaaatacaaaaattagccaggcgtggtggcaagcacctgtaatcccagctactcgggaagctgaggcaggagaagctcttgaaccaggaggcagaagttgcagtgagccaagactataccactgcactccagcctgggcaacagagcaagactccgtctcaaaaaaaaaaaaaaaacctcgttggaaccaaaaattaaataaacaagttttactgtaatgctatagtagcctggacaccatctttagaaaatccaaaattgcctccattatgtaagatttaaatagtctcccatccacgaaagttaacttaatttcatgttat

SEQ ID NO: 37382 - DNA, 1050 bp, Homo sapiens
tcaagcacgcagcaacgcagctcaaaacgcttagcctagccacacccccacgggagacagcagtgataaacctttagcaataaacgaaagtttaactaagctatactaaccctagggttcgtcaagttcgtgccagccaccgcggtcacacgattaacccaagtcaatagaaaccggcgtaaagagtgttttagatcaattcccctcaataaagctaaaattcacctgagttgtaaaaaactccagttgatacaaaataaactacgaaagtggctttaacgcatctgaacacacaatagctaagacccaaactgggattagataccccactatgcttagccctaaacttcaacagttaaattaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgacgaaggctgcaaagtaagcgcaagtacccacgtaaagatgttaggtcaaggtgtagcccatgagctggcaagaaatgggctacattttctacttcagaaaactacgataacccttatgaaatttaagggtcgaaggtggatttagcagtaaactaagagtagagtgcgtagttgaacagggccctgaagcgcgtacacaccgcccgtcaccctcctcaagtatacttcaaaggacatttaactaaaacccctgcgcatttatatagaggagataagtcgtaacatggtaagtgtactggaaagtgcacttggacgaaccagagtgtagcttaacataaagcacccaacttacacttaggagatttcaactcaacttgaccactctgagctaaacctagccccaaacccattccaccttactaccaaacaaccttaaccaaaccatttactcaaataaagtataggcgatagaaattgtaaaccggcgcaatagatatagtaccgcaagggaaagatgaaaaatta

SEQ ID NO: 37383 - DNA, 1096 bp, Homo sapiens
tgtgaaggatatcaggttactgtttagaccgtgctgagggtcaattagtggtttgatcaaccggcattagtgagtacctactgtgccccatactgggctcaacgggggaggggggagtggggtgggggacgcttctggggccccaggatggcaaatgtgggaaaggtcttgttaagaaaagcataatgtaattttattattttgaactctgggaagactggtctgagagggacctttgaaggacttaatgaaatctgccaagacactatttgaagcatgacaaatggtcgcagttgaatagttgctttgctgctgatgatataaatcagactctgatataatgcaaagcagaatctctgatagtggagtatgaaatggaagaatttttgccatccataattttcacttacatttgcacaggtttttacaatgtacaaagtgacctttagtatataattttttgttgttatttgtttgtttttgagacagagtttcactctattgcccaggctggagtgtggcacaatctgggctcactgtagcctctgcctcccaggttcaatggattctcacacctcagcctcccgagcagctgtgactacaggtgcacaccaccacgcccagctaatttttgtattttttgtagagatggggtttcgccatgttggccaggctggtctcgaactcctgacttcaaatgatctgcccttcttggcctcccaaagtgctgcagttacacgcgtgagccacggtgcccggccgtgtataaaattttaatccttccttagctgacccagcatcagacaagtcaggaaccataatctcatggtctcccgtcacatatcggccacacaggctgaagagaggtgatcacatgggctgagatgagaagcatggggaaatggaggggctgggacaagaacaccagtccttctgactccttcgtagtcctttatacttgcccttctcaaactgtcatgtgcacagggctcactaggggttgtggctaaaattagattctgattcaggggatctggaacagagataaggattctgcatttccaacaagctcccgggtgatgctgatgctgctggc

SEQ ID NO: 37384 - DNA, 1055 bp, Homo sapiens
aggccgggtgcagtgggtcacacctggaatcctagcactttgggaggctgaggcgggttgatcacctgaggccaggagtttgagaccatcctggctaacatggtgaaaccccatctctattgaaagtacaaaaattagtcgggtatggtggcatatgcctgtaatcccagctactcgggaggctgaggcaggagaatcacttgaacccgggaggcggaggttgcagtgagccgagattgcgccactgtatgccagcctgggcaacagagcgagactccatctcaaaaaaaaaaaaaaaaaaaaagattctatattcagcatgtgcttgtcaattatttttgacaagtggaatttacaggcgcatgccaccacatgcggctaacttttgtacttttagtagagacagagtttcacgatgttggccaggctggtctcaaactcctgacctcgagtgatctgcccgcctcggcctcccaaaatgtggggattacagcatgagtcactgcaccaggccgaatatagaatcttaaaggagaggtctcatgtcagacagcttttgcgatgaaccctttagagtgttaatctccaaatgactaaagcacatgtttggttaccttggtattgactaagcaatgtcctctactacagatcttttcttttgtgatcttcttcatccatttgttagagaagtataactgataattactgagaaataacattgttgttgacattggtctggggtttcttccatgaacataggagagtggtagggtggcccttggggaggataacccattcctgggaatacccacatccaggcagcgtggctgggcatggaggatccaggtcctgcctggagaagaacttggaatgcccaggttgagggtcctcaaactactttgtctcacctggagaggagctgcacagcttcctgagaggcaaagggctgtcttcccagttctggtgtctgagggctcttagagatggcatgcttggtccagggctaaccttgctcaaaaaagtttcaaaagtacaacctgtcctacagcaacaga

SEQ ID NO: 37385 - DNA, 1048 bp, Homo sapiens
tggagacagtaaggcggtatatgatgtgaactgaaccttaagaaaaaagtaggggccatataatgcgagacttcacagtcatgtcaaagattcttaattttttttaatcctaagaccaacgggaagccaggaaaatgttttatgtaagggagaaaataatccactttgcatttcagaaagctctacctagctgtaatttgtagaatgaattttgcatcctagagtgaatgcaagtagagcaggcaacagatatcggcagcttggaccaagggttctggcagtgaagacaaatggaagaggattcacaagaaatataagaagtaaaatcaatagaacttgatgatgaattgatgttctttttttttttttttttaatcagactagccaaagattttctattttactggtcttttctatgagctagcttttggtattttggatcaacttttactgttgttttctaattcattaatttccccttttttctttattaatttcttcacagccacataatattacctttggctgatgatctattctgtaggaagtctgctggaactggcgtatctctctgatgatgtgtgatatctaacagagaaaaaaacaaaacaaaatgacaacaacaaaagcaaagaaaggtatttcctgcattgcagcacattcttctgaggcctcttcccagaagggtcagtcccttcctccagtgaggcgggtggagcctgcctgaccattccctatggttggtgctttcttgactctcaaggaggcacatgaaatgccaaaagcaaaaagatactgaattcaaaactggggaacagctggcaatatgtggcctcatgtttgggagaggcaagctctgggtgctgtcatccgtgggctccttgcttctagcttagtgcttagaacctggctgtccaggctgggcatggtggctcatgcctgtaatcccagcactttgggaggccgaggtgggtggatcaattgagttcaggagtttgagaccagcctggccccaacacagcgaaaccctgtctctactaataataca

SEQ ID NO: 37386 - DNA, 1079 bp, Homo sapiens
acactcttaaccacggccctctgctgggcaactagaaattgtgtgtgatttgtgctctacttggggagccagagcctgttggggggtcctgggagggcatggttggctatgggacagaccattcaacgatgttgtttgaggagccttgtcaggtcttaagcataccaaagtactgtattgcatgcctccacctgccctgggactaggacaggtcacaccctgcaaaggattcgagtggaaacgatgaatagacccctgcacacccatgtgcatcagtggaggactgtggatgccacgtgcccccactcctccctccccaaagctgctttccaggcatcttccaggtggggaaatggccattcccctcagcccagagcagacttagcctgcccttgaatgctgccaaaaaaaagaaagggctaaatgtgtcccctgttctattcctagtccagattcctaagatgaggacacagcatcctgggccactgtcactaatacaaatttgcctctggagggactctacggaagataattcccctgaaatttggagagttgaattaagctaggactgattctggctggaatttgtggtggctacgtaccctagagggcctcaaggaaacccacggttcaagacagccctgacagattctggagtctagaacagaaatggatttgaacatgggcaaggccaaccacccagttcacggcctgtgtacagcaaagattacgttacagcctgagagctaagcctggaagctctttcatccatccgtttgtccatctatccatccatctgctcatccatccctccatctgctcaacaaacgttagagaatcaatccttgtgtcagatactggggctgccctcaaggagcttttatagagttcagggtacagccaggtgggggagacagatcactataaaaacctaccactataatccaaaggacaagagcaaaaatagtaaagaggagagaagacccaaatttgcctggtgggtcagagagggctttctagaagaggtaaaaaatcttcggggctatcacttcaccttgcctggtggataaagggaggac

SEQ ID NO: 37387 - DNA, 1024 bp, Homo sapiens
gcatggtgataggcacctgtaatcccagctacttgggaggctgaggcaggagaattacttgaacccaggaagcgaaggctgcagtgagcagagattgtgcctctgcactacagcctgggctatggagtaagactctgtctcaaaaaaaaaaaaaaaaaaaaaatagtgagggggatgcatgcccacacaaaggaatcctgatagaggaacaatggcttggtccgtttcccctcctgtgtagcactgtgataaaggaaagcctttcaggtatgtgcctcgatggagccagtgggtggaagaggaagggcaatgagaggtttgaggacaagctgctgataccctcatgtgtcatcacagtggtgccctttgggagcctgctttggtatactcgtccactcagggaagaggaagtctcttatccacagttttgtcttcaaaattgaaatttctttgggcagagcctaaaagagagttgcctcatttcgtgtaactgtagcatatgtagtgtagaggctccaatgtgtttttgaggcaatctgagagctctttctggaaatccctggcagatgacatctgcgtctgattttactttgtcttacaaccaggctaagacctccagcatcatcagactgtcgaactgctcaggtcaaggcagacaggtagaaaggcccacatagatagtggttactcatcccaagaacacagaggcccacaccaggaaggggcaggtgatgttaatgatgaggcaggcaattatatcttgcgatttctatgagccatgatgcattacagtaaggaactttacctcacttggcttgtgacttctgttagtgaaaagtggcctgctggcctatgctgtggaggacttgcagaaaacttcccagtcaccggcagacggttgacatctcccctggttcctccccaacccgtttagtgtgaaacgggacaaagggaaacatttcctttgatctatttttggggaaagaggcaaatgtcaactaaataagatcatattagggactgg

SEQ ID NO: 37388 - DNA, 1074 bp, Homo sapiens
ttctagggaactgccttcagctccctgcaacagaagaacccaaaagggtggacctgaaggaggagggctgcaggcatttgcctcagcggagaggctgctctgtggaggggacgcatagtggctgagcactgttccagccgaccaccctgtgcttctgcattgaggatgaggatgccgaggtcatgggatttatccaagagacttagtgaattcagtagtctgggctacagtgatcgtctaatcagtaataggagagaaatcagtaataataatagaataagaggagaattcctcatattcccaaagatacactgaaccctcctcccgacccccacccaataaagctcagccacaaacacatcagctcctaatgtcttactggtgaatacacaccattcaattttattgtttctgtaccaactcatccacttgacaagctcagagttctgtcatgcaattcattcctccacagggagggatcttagcacagcagcaagggaagccttgtccctgggaagctatagacctcattgtttcagaaagcattccagatggttctgctggagctggcttccctttatgagagcccttcctgagaaggcagaaagttggccccatagagaagaaaaggaccccaggactgtgcaagtcagtcatatccagagcatccctcccaccctggaaccagcagccaatagttttacctcataggactcctcgtcaccagccaccatgcccacagtctttatgaaggggtggccagggttgtccactccagtctggatgcactggtccagcgtgtagccgttgggtgtcaccttgttgcgaagcttggcataaatggcgggggtgaggcactcggccatgcagttgttgtgcttgcgcaggtctgggtagtctgcgctgtgtggggaggagggcaggctgtcagccagcagcccccgaggaaaggggccaatggaaggacttgttgtttgcccatccttccactaggctcccttcagccagtgggcacagggatacttggctagaactgcctaggagtcataaatgaatacaccaggtttcaaaaaa

SEQ ID NO: 37389 - DNA, 1053 bp, Homo sapiens
aacatagtacctggcctgtactaagcacttgatgaatgttagttggtggcatttttcatgccaagagagtaggagaatacaggaattatcagcaggtgagtctatggtcaggctacattctctgtcatctgtatgcttagaatagctcagagcgatattaaataaatcaaaaaacaagtaatgatccacagacttccccaaaccacagtggaatggggaagtaagcgtaatagctttctaataacaagagaaagtcacttattttctgaagcactaccttggaagttgcactccaaaaaatgccttgaggctgggcgtggtggctcatccaaaaaatgccttgaggctgggcgtggtggctcatgcctgtaatcccagcactttgagaggctgaggccagcagatcacctgtggtcaggagttcgaggctagtctggccaacatggtgaaacacccctctctactaaaaatacaaaaattagccaggtgtggtggtggcacctgtaatcccagctactctagaggctgaggcgggataatcacttgaacctgggaggcggcagttgctttgatttctagaaaaaaattagctccatcttggaagttaccatagtgtcttctttcaagaacaaacaatacggtaattttattttaataaatatccagaaatctcagataacatcttacttcttttagtccacgacagaatcgctcaaatactcgtttcatattgcctcctttttccattgagattaccctggtgtgatcctcctcatttatccagatgagaaatgtcttatcataattatgcctaatgaagagagaaatatggtactgagtgttaattgcatttgtttcaacacatgaaaattcccattacctccctagcttgattgcttcatttcaccttcctcatttcctagatggccctaatctcttaactgtgcctgaacaagtatgacaaaataatgttactttgacagaaggaagattaagaccaactctcaccctaaaagatgtcatgtttttaccaaacaagaatataattaattc

SEQ ID NO: 37390 - DNA, 1050 bp, Homo sapiens
attttgcaacattagcctgcatgtgccatagatactgtacagcacggagtggctaagattccagtagagaaccaagctcttttctggcctagtaaaccaggaaatggagcctggaataagcatagccaccagaagggggtattctagaggagagacccagagaagtggaggtccaggttctctggatgaactctgctcaaatctttacttgacccctgaactacacatgaatgaagcagcttcaaaacaaccactgaggcttaagtaacttaactgtatattgaacttgcagtcattgcaggtgagaccacagtttgagtctaatcaaggtaattgcctgctaaaacaaatacctcagtcatttttaaagcaatacggtagaactcaggttatactaaatataactttctcaatgtccaggatacaatccaaaattacttgacagagaatgaactaggaaaatatgacaagaaaaagacagccaacaggtttacccagagatgaacaaggtgaccaaaagatataacacaaggactttataccagctattctaactgtgctcaatgaataaaggcaaagatgtttacaatgaatgaaaagatggaatatctcagcagagaaatagaatatgtaaaaaaaaaaaaatttgagaagtaaaagttacaatatctgtgatgataaaagatcactggttgagctcagtagcagaatagagagaacagaggtagaatagagaggtaagaatttagaaacttaaagatagaacaatagaaattattcattctgaagaaaaggaaatgattgaataaacagaaaaggggggaaattatttttaaaatggacactcagagtactgtggaacaatagcagtaggtccagtatatgtctaattatgagtcctaaaagagagaatgaggccgaaaaaagcatttgaagaaatgatagccaaaaactttccaaactttgtaaaagatataaatcaacataagaagcccagtgaaactcaagtataaatatgtagaaaatcacctaggcacattaactgctgaa

SEQ ID NO: 37391 - DNA, 1032 bp, Homo sapiens
ggctggagtgcaatggcgcgatctcggctcactgcaacctctgcgtcccgggttcaagcgattcttctgcctcagccgcccaagtagctgagattacaggcgcccgccaccgcgcccggctagattttgtatttttagtagtgatgggatatcgccatgttggccaggttggtctcaaactcctgagttaggcgatccgcccacctcttccctccaaagtgctgggattacaggcgtgagccaccgcgcctggccctcgtatttgttaagtaaatgaagaataagtactttgcgatgtttgtttaaagcaaactagaaagtggcccagttttctttaagagaagggattttaaagtcagtgcttgtaggaatgttgagatttggtatggtacatatcacaaataccgtagttcatatggtggagaaagttttaaaagacaacaaacaaacaacagcaacttccagctcttgaagatagggaacttcctaaaagatgtgtggtagtgctgcccatactgtaatgatctcaaccagctggtttcagggtagtgacatttcatgaagaggttttatctttggtagatgcaaggtacttacacataacataccactagagggcgcatttaactaaaacttttctttttagtggtatattgcattttaaactgtaggtcgttcattcttggaagcaaaggaacataccgatttctttttgtagcggtatgtccaataaagattagtagttgagcaaatagggcgtagaataagtcctttggaattcggaggaaactattgctactaatagctaactttactgaacattttataggtgccagcagtatgcttaatggtttgcattcgttacctaattagtccactcagtattctgtgaggttggtactattattttctccattttgcaatgagggaataaattcacagagctgacgtaacttatccaaggtcagacagctaataagaggtagagtcaggatttgaaccaagatctcaatccaaacctgtgtgctctgc

SEQ ID NO: 37392 - DNA, 1032 bp, Homo sapiens
tttctctattttttcactcagtttcctccctgggccaacctcactcttttaacttcccaacaaatcagtaacaaagtatcatttttctgtaagattgacttaaaacatttgaaatatcacagataaaaaaatgttaacagttgccagtgttgagatgatagcaataaataaaaatggttgataatagagtatatgcgtatgtatagcttgacatatatacatactcttaacaacgtatagtataatgaaggctattctatattttcaacactatttcctaacataacctgacatatgaatgaactggaataatttttttttttttgagacggagtcttgctctgtcacccaggctagagtgcagtggcacaatcttggctcactgcaacctccgcctcctgggttcaagcgattctcctgcctcagcctcctgagtagctaggattataggcacctgccacctcgcctggctaactttttgtattttttagtagagacagagtttcaccatcttggccaggctggtctcaaactcctgacctcgtgatccacccgcctcagcctcccaaagtgctggaattacaggcatgagccaccacacccagccccagaaacatttttaaaaagcatttcctttgaggtcctttctgaaatgcttagtatcttttactggtttatattattgacacagtatactcaataagatctttgttttaaaagaatgattgattatctagctgccctattaattaaaattacatacgactaaaatttcagttcctaaattgtactagctacatttcatgaactcagtagcaacctctggctagtggctgttgcagtaaacagcacagaattataacatcatcatcacagaaagttatattggactgatggaatcaccaatatttattgtaaataacagtagctgcggaaagcatagattaaatttatctgtgcccattttgccatattctctgattttttctactctagtaaaatcttgctaaccacttattttctttttattta

SEQ ID NO: 37393 - DNA, 1036 bp, Homo sapiens
gagagctccaatggacttcagaggatccttgttctcagatcctccctgcggggtgcacagcaagacaagacacagtgtatttctaccagctcatctatctatctctgctttacattttaaccattttcttctgggaataactcattcatgaaatgttaatttttatgatacaagttgttgtagttaagacaaaattctctgagcaattttctttaaaaaaaaatctaaaaactaattccaaaacaatgtaaataggaatggcttaggaaaaagtaagccagtaagtaagtaagttatttcttccatttgaaataacaactaaaaaatgtttaactctgaagtttttttttacaagttaatgaattggaccttcaaagaattacagttatactactgtataaacatggtttatagtccaatgtcattctacatttcctattgatgtggagtatcaggtatcctgccatggctaaaattgtgcggtaataatgagactagcaaatttaaatagaatatgaagcaacgcactgctaacttggtgttcgattagattgctaataacagtcattttatcttccaaggaaagttccaaagtaaatctactcttaaactaatgataggaaaatattctaaagcagttttcttttgagcctccttttcctctaagagtacataataaattctcaagtcctaaggtgtctcttgttcttaagtacagttgttagctatctttcttttttccttaaagttcatgtaaaaatggttgaaatagtgttatctgtatactgcatgtagaattaaaaggaaatgtttattaaaacagtgacctttcaaagtttggttagtgaaatgactaagggagttattgttccatcttgccttatcagtgggtaggatctcttcatcatgcccctgctgggaatgttttaaactctccagtgttttaggaactctataagctgagggtgggaaattgaataaatattgattctgaagctaagaaaatagttgtggtaggttattgggggttttttta

SEQ ID NO: 37394 - DNA, 1139 bp, Homo sapiens
actaagatgaatgaaggatgaagaagtacttacagtattatttaccctacatgtctataagtatttattagtcagcttataaattcactatgtaataataaaagttttttatcttctaaactaaaacatacttcaatgttttcataatccttttatataattactttaaatagttttatcatttatttttgagactttcacacagactattaaatgtgtcttggggttgttaacagtggaagactaaattggcgcacccttcttagaaaatgctatgataaaatgtgtcaagagccatgaaaaggttcataccatgtgactctatacttctaatactagaaatgacagagatacaacccaagatttatgtagaaggatgctcatttgttatactcaagagtaaaacagtagacacaaactcatgcctaattcaattttagtggaattagtaaattaatgtttaaggtgtaggttagaatataatagagccattataattattatcaaagaatttgtaatgacatggaaaaataaaatctcatgattcaatgcaatataatcacagtttcatttgaaaccgtaacacaaatctagaaagtagaaaacaaagaaataggctaaaactctatcagttattactttgggatgattaagtagatgggaaattttaataattataaagtatttttgattatgatgttttactgttaaactcatatgtttttaactggcttgttgaaattaagatagaagcttgaaattcagtatcattgatcataccaataaaaatttttaattttgagccctttcaatttagaaaaatcataaacttgataattaatacaaaattttactttgcttcactaactccttggatatttaatggtctgtgtcctgaaggcatcttcattgaaaatgatacaattcatcgaagatagaattatatcaactgatcatcttgcccatatttatgttcttatatggtgaagttaatgtttaatttatgaaggtagcatgtgaataataaatgcttcactgcaagactaaaaaaaagtttttggagcaacactgaacattgcaggcaataagtaatcttcctttcaaaccagaaattgccacaagtacatcttcctagtctt

SEQ ID NO: 37395 - DNA, 1028 bp, Homo sapiens
tgctgtcctccactaaaaggaattaaggccccttggggaaagagctgattccaagcctaggtcagaagaagtatgaggtgagcctggaacatcttatgccataaattaaggaaatgctcaaaaatggatgtgggtatgttacacacacacaacacacatacacacacacacacatacacacacacacctgaaggcttctcactagccaaatctgagataatttgactattgaaataaatgatgatagtaatagattacaacccattgaacaatatagaaatctatgactgagtaaataggtgaataaataagaaaagcttttccttatagtgaaataccaactaataaatataaaaagaatgatggacatggaatgtctctatttgacagttatcatagtggttagttgttagtggaggctacagctgatgggttgataaaggattgttgaggaatggaatattgacaatctcagaatagctcttatactaaaagtaatcaattactgtgtagaaacctgcagacaccagcacattcagatgataaaggttaccatcaccagtagtgggatagatcaacataatttgccctctaatgtgatacactgagaaaggcatagcatcatttctctggtattcctgctaagaaaatataactagatcataaagaaacatcagacaccatgctgtagaatttaagacctgttctctttaaaattgttgaggacatgataggtagggatagaatagacatagataggaacaataggaaatgattcctgcttagaagaacatgaagagacaggacaactaaatgtaacatgtcttccatgatgttctggtaccagaaagaaaaaagaaacattattgagacaaatggcaaaattaattgagatcttggacttggatggtagtgttgctgtcaatgttgatttcctgacttgaaaggctgtatggtggttatgtaggaaatattcttattgggggaattatactttgcagtatttaggggtaatgaggtatcatgtc

SEQ ID NO: 37396 - DNA, 1053 bp, Homo sapiens
gcatgaaaagcttaagctcttactaccttttctttttttttcctgcaaccctttggcagtacagagtttatagccacaggactgttcctatctaaatagagagcaatgcagtgaaattttaaaaaggcttctgattgttaatttgaaggacttgatattttaagaccagtgaaagttacctatactcttgaaatttgaacacaatcttttttgtaaaattggaaatgacatgagaatctagcagcatgactctttttttcctaaccaagtaagaagtgttatacaattaatcgtggcacatagtaaacagcgcaattgatattctgttgtattctgttatttaatatagtttaagttaaagtttatttttctggggaagcaatcatatttttcagtttttgattgtgagaattatattgtgtatgttgaaatcacaaaataattgaatgaaattatgtatttactcagtatagttttgcttaataagtaaattaaaagcttatttaataattttagattacttatggacaaataaaactagacttctgatgccttatgtaatactctatcagaatagattatattatgctaaatcactgtttttttagtttttttgacgtttaagattttgacagttgctttatgtaatgacatttttatggaataaaaatggcttaaatatgtacaagaccaaattattactgtagtcatatgtattaaaatgaaggatatgttttagaaatgtggttaaatgatacttttataagaaggcaaattaattataaagttcaataactcacataatttaaggtagaaacctgctactggtttgcagttcatttctattatttgtttcttataatattataaataattttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttttttttttttttttttttgatgaaatct

SEQ ID NO: 37397 - DNA, 1068 bp, Homo sapiens
cataaatctgcacattgattacacacggctcatataacctatacatgtaaacatataaaaatacatgtagcataattttatatgatgtatcataaatgtgacctaaactaacatgccatctataatatgcacgaaacatttaattaataagtttgcttgccttcctggaacttaattaaaggaggtttggcttgtttatttgtttttgtaatgatgtagattctcttattctcttaaaacccagccaaggaaaactaaaactatatacttttttcaaatagttttttgaatgcaattattttattgattagactgctgtacttttaaaaaacaccctgaacttcttctgccctttagtttgcacttgatgaactctctgaaaggcacagtattcctttaatttatctagagttaaggatataattataccatgaagttttactattgaaaatcagatttttgaaaattaaagtaagctttaggcagtatttggtaaagtttcttatttctgtttctgaggaaggagatttagaaatgtgaaggtcagacatctagtttgtggtagaacccacctacatcccagtcaagagcttttagttggttaagtaagtacacagactctgaagcctaggtttcaattctagcctttttattatctaggcgatcttgttaatgaacctctctgtgctttggtttctccactgataaaataaggataataatgatacttacaccatttactagttgagagaatttaatgagtttatataagacacttagaatagtgcctaacatatagtgttatatgtaagttatgatatactctacatgttgctattttagcagaataatctcaaatatttcacttgcatataaaattagtccagaaaacataatgtatttgaatttttaagttttggggagtagtagcaaaaactgacaattattccttaacaagaaatgacaaaaaaaaaaaaagaagcctgatagaggaagaaggagatgtagactgtgcagcttggcactggggagtctgaatgctactatgaactaaactatgcacaaact

SEQ ID NO: 37398 - DNA, 1065 bp, Homo sapiens
aatagctatttctgcatctgactcaaacccccacccccattctagaattctcaagggttcttggttaactcttgagtaataattttcattaaaaaaatcttttattcatttacaacatctcaatccattacagttcaaaaacttttaaaaagtttgaaaactgcttattttagtcatttgaatagataagaaatctggtacctggagaagttaaggacatgtcattgtttaaagactgagtgtggtttaaccatgaaaatttaggttttccaaattctcattagtacttttccaactacactggatgaaacttttgcttcatctgccatagtcattttttagcatattcaaaaaataggaaattatattttaggatggtgaatctgagggcatgatgaggactgaagaaaggcaaggattaaaggccaacacagttaggaggctattctaatagtgttgatatacgctgaaaattcagcccctgaattaaaatggtgacaaataaaatggaaaataatgaatgagaatgaagaagaaaagagactgtctagttgtaagtattgaggaagagagaaaaattaaaaataatttgtaattaatgtggctgatgatatgggacttgtgatatgcttagcagaaatctgaaattagggaggaagaacatagagaaagtggattaagggataagagtgggttaaattaatgaagtagtaaagataaaataagaattgaggcctggggatagaaaggtgtgaaaaaggctcacatttaaggagtaataggaaggaagagactagcatgaaaacaagggaaaatacaacttggtgagaagtaaatacttaccacactaggtagactgacttggatagcataactgttatgttctgtaacccagtacatttcccaaagctgttcactgtttcagaatgcttccagctcgaactctgcatcccaaggcaactaatttgtttggtgtgaacatagtatcttgagtacctaagatattcaaaagctgtttgtggttgttgaagcaagacttgagactcaaactatgtcaatggctga

SEQ ID NO: 37399 - DNA, 1071 bp, Homo sapiens
aagccacacttccacagggagatcctgctactgaaaggagcctgctatatagcttattgtgttagggtaggaaaaagagttgagaagcactgatgtaggaagtgtcattcaatttgaatatgtttggagatgtttctaaattacattcatcctcactgtcaataacttactttctatgagtaactttaacaggtctactctctcaaggtgtttagtagctacagaataactctcattttaagtatttggcaattttggaatggggaaagaattaaatggacagagcaactgaatttgtacaagctttctcttttcatgacagatgcatgatatgttttcatgaaaataaggaaaatactcatttttgtaaatgccatcaatctttaacagtcgaaaatctgcttggcaagagaagtggtacaactataaccacagaattgtggttattgttacattgtattgtttactgtaaacctggttcaatattggtaaatatagtgtagcagaaactgaactgttgtgagctatctgggcattggtccaagatatcattaaaaatactgcctcagactaatttgggtttatgaataatattttgttaacagctcaactgaaattgagccacatggtgtagcttcaaaattctgaatccacaagataatgagagtagtttgtgtatacaacacattgaatattctatatttgaatgaaaaatttatacataattttgttaacctttaaactgtaagctcccatatgcttaatatgatctgatatctttaaagtttacataatgctgtagtttgctgtgaatttgaatgccttataaactaaagtattattggcttaacaatcaaatctaaagaataaggagaagttgctgagcaaatattaaaatggatattcaacgcaagttgtggcatatgtttctacaaacagctagagtttatattaacattcgccaaaaagattgaaggacataaagtattgggaaagttcactaacttaattcatttcttttactaatgaaaggttattatgtcttcaaatgggatttagagattattaata

SEQ ID NO: 37400 - DNA, 1083 bp, Homo sapiens
acaatatatacatgtatcaagacatcatgttgtatattatgaatatttatatgacaaaattttatacaatttttatttatcaattaaaaaataaagtttctgttctgttgtcaaaattttattttaaatagctaaatcctccttccctctaaaaaacctgactaaaattaagtcacacaacaaactaggaaaagaatttgcagaaaataaaccagagatttaatatttttatatagctgaataccttcgatatttgtttagagtgccacaaagtttaatcttttactggtgacataaagctaccattatgattgttgattagaggacagtactgtaataagagttgcccttaggccttctgagggaggcacagggatatttggcccaactccaagttggccatactagtttcactggtttacttagtttttctgccccattcctacttgttggacttcatctgttacttcttatttttgttaatgtttctaccagtagccattactcttatttccttatactctttttctacacacattgtatatatttggggagttttaattttagcaatgaattatgaacatttcttaatatcattaaacattttgcaaaaatatatttccccatcacatgtatttatcataatctaattatttcttctttctcagatatttagattgccagtttttcactgctataattttgccccaggcattattataaattgtttggctttctgattctttacaatagtattttagaataaaaattgctgggatataaaaggatataaaggtttagtatttaattttttattgcttgtttatttctttctaaataggaaatataagctcaggggaagtaatcaaacaaaagaaaagttatgcggtaaaaaattctccctcttattccaggcccccagtctctaggaaaaaaggcctgcaataaaagatactgtttgaactcaaatgattccatgagcgtgggaagcatgggagtgacttgttccagtgcttgtatgtacatacaatatttctgtaatacagatgagagcatactatacaaactgttctgcacttaaaa

SEQ ID NO: 37401 - DNA, 1052 bp, Homo sapiens
atgtggatgaaagggaaccattgtacactgttggtgggaatataaattagtacagccattatggaaaacagtacggaggtttctcaaaaaattaaaaatagaactaccatatgatctcgcaatcccactctgtatatccacagggaatgaaatcagtatgtcagagagatatctgcattcccatagtcattgccgctttaatcacaatagacaagatatggaatcaaccttagtgtccatcaacagatgaaggaaaatagactatatatgcaaaattgaatactattcaacctttaacaagaaggaaatcctgtctttaaaaaacaattttttaaagttccaggatacatgtgcagaatgttcagatttgttacgtagtatacatgcgccattgtggtttgctgtacctatcaacctgtcatctaggtgttaagccccacattcattaggtattagtcctaatgctctccctcccctgaccccccacccctcaacaggctccggtttatgttgttctcctccctgtgtccatgtgttctcattgttcaactcccacttatgactgagaacatgtggtgtttggttttcttttcctgtgctagtttgctgagaatgatggcttccagcttcatccatgtccctgcagagaacatgatctcattcttttttatggctgcatagtattccatggtgtgtatgtgccacattttcttgacccagtctatcattgatggtcatttgggtttgttccaggtctttgctattgtaagcagtgttgcagtaaacatacatgtgcatatgtctttatagtagaatgatttataattctttgggtatatacccagtaatgggattgctgggtcacatggtatttctggttctaggtccttgaggaattgccacactgtcttccacaatggttgaactaatttacattcccaccaacagtgtaaaagcattcctgtttctctacagcctcaccagcatctgttgtttcctgatgttttaataattgccattttgactggtatgagatggtatctcattgtggt

SEQ ID NO: 37402 - DNA, 1013 bp, Homo sapiens
tctagaactggcacacattatatatagtacattttctgaaaagttttgtgaatattaaatcatacggttttataactagcacataaaatgtaaggaaacacttgatgaatcctgttcacaaagttaaaaaatcttttctgtgatacaaagtcatatctactttaattgttctataaattgggattaaaaataagaccattttattagctgacttctgttaaataatgatttgttatatatagtcgtattatatacatacatacatacggacatgtatatatgtagaaagagagttaggaattagctgtgagctaataggtaattaaaaggcagtatttaccttttatttatgtgtttcttggtaaacttgtttgtgaatccacaatactgtcttagaaaacttacctttaatatcttgcctatctttcttattttctaccaattctaaattttagagcattatatttaacctcaaattagataactagaccatagaaagaattgagtaaagtaagatctttactcctttcccagactgtacattcattcgtttacaagaatggttcagaatctgtaattagacacttaagtaacagtctctgttgtagatacctaattagttaaatagttcatctgtcctagtactgttagatgatacctgttggcaagcatgtaatggattttgttcatatgaatggaaagaattcaggtttctttcttagaagttgtaattttcttttttttctttttgtttctgtttttgagattgagtcttgctctgtcacccaggctggagtgtagtggctcgatcttggcttgctgcaacctccgcctccagggttcaagcaattgtctgcctcagcctcctgagtagctgagattacagatgtccaccaccatgcccagctaatttttgtattcttagtagagacggggtttcaccatcttggccaggctggtcttgaactcctgacctcgtgattcacctgcctcagcctcccaaagggttggga

SEQ ID NO: 37403 - DNA, 1025 bp, Homo sapiens
cttgacttgtctcttttctcctcatctttgtaggactattacctctttttttctagttcttatagtctattaatgcattttaaggtaaaattagctcttttggcagggcaaatacacgattaattcatcttgaatttgcagtcaactaaaacctgtcttttcatatgggctgttgttaagtcatatttgtcatcctttacaagtttttttgattcaagcacaggattttacattggtttttgttaagttagtcttaatggatttagtgcagtatttcagagttccctattcttttgggatcctaattcaggaatataaatatattagttagctccttagttttattttcaaatttggtgattatgctgtgattgcttatccaaaatcaaagagttagtctgattattttcatctggacttagggaagtcaagacgtcttagcttactgtctttttatttggtcacccatgggtgctaaatgcttcttagtgcaagtgattagaaagtaaatatctggaccgagtgtggtggctcatgcctgtaattccagcactttgggaggccgaggacggcagatcactacctgaggtcagaagtttgagatcagcctggccaacatggcaaaacctcgtctctactaaaaatacaaaaattagccatcgtggtggcaaggcgcctgtaagtcccagctactcaggaggctgaggcgtgagaatcgctttatcctgggaggcagaggttgcctgagggatagcacgagactgtttaaaaaaaaaaaaaagaggccaggtgaggtggctaacgcctgtaatcccagcactttgggaggccaaggcaggcagatcacctgaggtcaggagtttgagatcagcctggtcaatatggtgaaatcccgtctctactaaaaatacaaaaaaattagctggatgtggtggcaggcacctgcaatcccagctacacaggatgccgaggcaggagaatcacttgtacctgggaggtggaggttgcagtgagtcaagatcgtg

SEQ ID NO: 37404 - DNA, 1029 bp, Homo sapiens
gaaataaaacttgcaaaagtgtggaggcctctccagtaactggttccccgtggagtttttttactcttggacttgtccacgctgagcctccagcaatttatcaattacagattagattttccttccctggcgctgattcctgcagagatttctgctcagggttttttgtttgtttgtttgtttgtttcttatggtaagctgtgattctctatacctgcctgtctcttcagttttggagggcagtggtttgccctgtgacctcacttattttatggagctaagaatagctgttgatttttctgtttgttcagctttttacttgttgttgggatagattggtgatttctaagcttcttatatgctggactagaaactggatgtccaataggcaactttttatgctttggggcacattagttttataaataatttttctgccactcttaaagagtattgaaatttgggggaaaaggagagtaggccttaaacgaatattattattctgagactaaagtaaacttgagaaacagatggaagatcataacactttaccctgcgtattaattactgagtgaccttgaataaattttgaaatcttcctggctcttaatttttctgatagagttatgaggactaaagagccaggcttccttcttttccttttctttcctttatctttttctttttctttccttttccctttcttcccttcctttcttctttccactaacatctaccaggtgtcagagaattgctagggatgcaaagataatttgtatttttttctagtattaaattctaaaataactagctactatactcagtcataattatttatttgcgtaatttctataacaaagatacagtagttctacaaagaggggaaggagggggtaagagaggatggtagttaggaaaggcttcacggttaagaaatactggattaggctcttcaaggaggaggagccattttcctggtttagcaggaggggaaattctaggcagcagcatctggaaaggtaattagct

SEQ ID NO: 37405 - DNA, 1030 bp, Homo sapiens
cagtgctaagaactaagggaaggaaagatttttttttgttttttctgtgtttagaccataacttttagtaaagatcagggtgccccaatggaccagtatagggatgaagcagcagagaaggtgtaatcaggaggtgatactcatgtgcatagagtccagtgtttttgaacaaattatccattttccatcagtgaacttggagatttttttgtttcatttttacaaaggcatttgattccttataatgatgctgatgaaatggttcaggaaactaaatgtcatgtctgtgatctcataatctgttagagagttctgttgttttagagaatttagttcaggttttgaatttgctacaggatagtaaggttttgattgccaatttttgaaaaggcttcatggctgcctagtttttgtttttgtttttgtttttgttttcagtttccatgttgattagttagtcactggatactgaactgctaaagaattagatttctgttacagattttggcattataaaactctttggtttgtgtataggacttggttggaacgtaaccttagtcggtttttggttctttgtattttgcttagtgtgtgaactggttcatgagctttttcatttgggtgcttcactgggacatcagtctgaagtagctacctgtaagatttttgtttgtttttgtttttgcttgttgtctgtgttggaagagttgtatagaagttaggaaagatattcggggacatttttaggtcgtgtgattctcaagcctgatctagaaggattaactagatgccttagtatgaagcatacagattggattgccatattcagatgctgtaactaaacatctcatcaagcagtagtaggtttatattttttatggtatccatccagacttgattaacagttgacagattttaggtttcctactattgtggctctttataaaaatccctgaaaatctgtatatctttggctttatttccatttagttttgtttttaaaccagtcttctacctaatattttgt

SEQ ID NO: 37406 - DNA, 1066 bp, Homo sapiens
caatctttcatttgtaaagtggtatattatttaaatttttatttctctgattattagtgaggttagttatctcttcacgtatttgttttctgttctccttaagacctcccattcttgctgttttattatgcctaaaaaactctttccccttattcacgtggctcactcactccattcagatctcttcttaaatgtcatgtccccagagagttctgctttatctttcattgtctttatcacaacaaaaccttatattatgttatgtatttatttattttctctgctcaagttccttgaaggcagagaccttacctgtgttcacacctgtatccctagcacttaaaaaggtaagttctctataaatatttgttgaataaataaacatgaattggctatttatatcctttgtccattttgcctactcaataggagcgtcttgaatattctagacattaacctgtgttggttttagatgttgttataatttgttatttctgtccatcgtagctgcgtttgataaggaatccttaattttcaagtggttaaatcatcacgtcacaacatgtaaatcaacacattgtggtttgtgtttttgtggtctgaagaaatgctcttctaacccgatattacatatccctctccattttctatttgctttataattttatattttatatttgggtctgtaatttcttaggagtttacctttgtataggctgtgaggtgtggggggtgattttatttttcttcctgtagaatacaagcagtttgcacttttcctgctgattggtagtacacacttactatgtacgaattatttctcatatttcattgatcagttgtctatttgtgtttagtatcaatgttttttatacagtggctttgcactgtgttctaaagtctgatagggcaagtcctcccccttttaaaaaattgacttagcaacattcgtaataggaacaatcaagtagctaacctttaaaaagaatgcaaaagatcattatggagtaattatgaaactctattaaaggatatgaaaaaagacataactaatagaagagaatta

SEQ ID NO: 37407 - DNA, 1038 bp, Homo sapiens
tgttggagccttcatatttttttccttcagtcatcttgccgattgacactaaaatgagcttaataagatttttatctattattggaggattccaggcctatttattttccctaggaaggctataatatttaacaaacaagtttattgaaatattttagaactttaaatcttttgaagttacccaaattggagggtcttacaactttgaattactttctaagacctctttccttccagtaatgagaaacatttattcaactttttaaaagacagaaatcatctttttaaaatgtactgttttctaattgtctgaaatgacaagagatcacttacccagcagtgcacaagacttccaaaatagctgagcagcgggtgaggggctagaaggcggggggtggtggtggtatctttttttaaaaaagtatgtttactagaaagggtataagatactttgcttttgttataggtgcacttgcacaaaactcattttaacctgtagtcacaatttcttctgtatgacccacccaaagtaaccaggctgcaaagcattataccacatataaaagcaacattcagattgcttgttttgcttttatttatttgcatatgtaatttattgtgcctgtgaaaaaaggaagttcttataaagagcaacaaaataggaaaaacaagcaaattgtcatttcttctggtagattatgatttagaatttaggtaaaaaaattaagtttgagtgattccatttaatcttggtagagttgtgatagcttatatgtaaaagcaaaatcattttatttaaaacattatgaaaagatgctgacagtaaatttacggagtgcattagtgttactattggatgtgttggaatccagactgtaaattattgttactctgttacataaagactactaatttttagtacatgtttatattgatttattcatattatagatcatggaataccacttcattttgaaaaaagagaattatagttttcatatttagaaactgagaaaggattttttaaaaatgaagaaa

SEQ ID NO: 37408 - DNA, 1063 bp, Homo sapiens
caagtaaagagtattttagccagagagagaatcatgtacagcaacatggaggcattaaaaggtatgatatagttggtgaactgcagtaaagttggtagggataaatctggcagattaaatacgaactatttcaagaacagccttaaatgacaacttgacctaggagataaacaatttttttttttttttttttttttttttttttggagatggagtctcactctgtcaccaggctggagtgcaatggtatgatctcggctcaccgaaacctccacctcccaggttcaagcgattgtcctgcttcagcctcccaagtagctgggactacaggcgtgcaccaccatgcccggctaatttttgtatttttagtagagatgggatttcactatgttggccaggctggtctcgaactcctgacctcgagtgatccacccacctcagccacccaaagtgctgggattacagacgtgggccactgtgcccgccctgagataagcaattttaagcagaaaagttacaccatctgaggtgcattttagaagaatcgttttggaaatcatatggagcatggagtaaagggggaggtagatccattaggaagcgattgctataacaatacaaatgcttatagcgtcatcatttttctacaccaatgcagtggtcatttcaggatgtagaatagatcagacttggtggcctaagtgtgaaaattaggatttttaaagatggctgcaattgttggtagaagttttagtcacagactttgggatacaggaggaggaacaggtaattttaaaggtgtaaggaggaagatgatgagtttagtttgagatgccattaagacctagcgatggagaagtttgggaggaacttggatatgtagcttttgagttcctggaagaagtctaggctggagatacagaaatgagaaaggataagtgtgaggaaactaaggctttaataggataagtaatttagctgaagtacacatgttagagctgaaatctgaactcaaggtttagtttattatttctctctttaaaaaaatagcgttattgaaatc

SEQ ID NO: 37409 - DNA, 1025 bp, Homo sapiens
gaagatgtatcttgaggatatagggagaataaaatgagtccctgctttcatgagactttgaaggttgaaggagaaatatataataataagcaaataaatgtactaggcaacttcaaatagtcatatatactataaaaataataaaatagtgtgatgtagtgtagagaatgactgggaggctatgctagattgggtagtcgggaaggttcttggaggagaggacatttcaacggagaactgaaagaatcagccatagaaagaccaggttacagtatttcaggcatgtctaagctactattgaggaaaccttagcatcaacataattgctcaaggatatgttaaatatgagtgaaaattgggatgaagaagccatacttgcctggttttgtttttaaaatggaggaattgggtgttgggttcagtttatctgatcttcctagataataggattgatatcttttatctttcaaaccctaaggataaacttgttctgaaggacagtggggcttttataatgatgattatagaaataactaagatttgttgaacacttacagtatactgggttaacagaggttggtacaattggcgtaattatttctcctaaaccttctagattggattggatactctcatagcagacttttttctttttcatatttattataaataacaaattatttgtattattatttttttgagatggagttttgctcttttgcccaggctggagtgaagtggcgcaatctcggctctctgcaacttccacacaccccccaggttcaagcgattctcctgcctcagcctccctagtagctgggattacaggcatgcaccaccacacttggctaatttttgtatttttagcagagagggagtttcaccatgttggccaggctgggcgcgaactcctgacctcagatgatccacctgcctcagcctcccaaagtgctaggattacaggcatgagccactgagcccggccatttgtgtgatgtttaatgcctcatcttccagttagattg

SEQ ID NO: 37410 - DNA, 1050 bp, Homo sapiens
ttagattgaaaagatagaaacagtttctcattagttctctagttaatatgaaaagataatctttttcagaaagccagctcacagtgctgtgccttttgtatttcagaggagttgaagccaaacagccaaattctgccattaggaagtgtgtaagggtccagctgatcaagaatggcaagaaaatcacagcctttgtacccaatgacggttgcttgaactttattgaggtgagtatttcaactctatcgtaccttctgttcttggggtggcctccctcacatttttatctgatgcaagggagtttcctcacatgaaagtatttttgtgatcgccaccaacaccagaaataaacttcttattttattccaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgggatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtca

SEQ ID NO: 37411 - DNA, 1047 bp, Homo sapiens
ccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccaggtgaggcgagtgtcttagaagatgggaaacacgtagatggcgtgtttttacggaagaactaaaatatttaatttttaggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtgtaagtccattgctcccgtcaagttttagtttattataggaattcgagacatgaacttacgaattcttgttttgaaagtaattgcaggtttttgtgtagtagtattcatttgggcattgtggggtaaaattgcaaagcgtttgttctatttaaaagttggtaaaattagtttttgggaattaggtagttaaggttttaatttaacgttggcctggaaggaattggagaagatactagcaatgatgaagtaaaggacacaaacacctttactgtgggagttgttataagtaaatggcacgtgtcagctattgaactttatcgacttgataaaactaaggtgaagagaagtgacttgcatcagaattaattgaggtcatacacctaagattgagacatgaaactgccagtatttgactggttttgactttttaaaataataatttcatatagttctatcatatttgatggtagagccattttaacccagactttttttttttttttttttttttttgagacagtctagctctgtcacccaggctggtgtgcagtagcgcaagactccctgcaaccttagcctcccaggttcaagcatttctcctgcctcagcctcccaggtagctgggattacaggcgcc

SEQ ID NO: 37412 - DNA, 1042 bp, Homo sapiens
tggtctttctttcttctttctttcctccctcccttccttccttccttccttccttcctctttctttctttctttctttctttctttctttctttctttctttctttctttctttttcttttctccctttctttctttcttttttttctgcaggaaaaactccctttaagcatttcttataagatgagtctgaaggtggtgaattttctgcacttttgtttgtctgggaaataccttatctcgccttcatattggaagaatgactgctgcatgcagtatttttgatggaaggtttttctttcagcacttagaaaatgtcattctactccctcctggcatgtacagtttccattgagaagtctgttgccagatgaattgtacctcttttgctatttgtgtattttcccttactgcttttaggatcctctctctatctttgacctttgagagtttgattattgcatacttaggagtagtcttatttgggtcaaatctgtttagtgttctctgactttcctgaacctggatatttatatctttctcacattttagaacatcttctgttatttctttgaataagttttctaccccttgttcttgctcatctcccacttgaatactaataattcttaaatttgctcttttgaggtaattgtctgtatcttgcaggtggtcttttttccttatcattctcttttctcccctgtgtattctcaaatatacagggcctttctttgggctcactgagtctttcctctgcttgatccattctgctattgagggcctctaatgaatttttaattcagcaaatatatttctgagttccaagatttccgtttgatttttttgtcagttatttcaatctcattgttaaatttctctgataaatttatgtttttatttataattttctttctcattggaggggagggaaagaaagcaagcagaggtgggggtatggttacactatttaaggaagagctgaatacaaagacaatgagtctttcatagtctcaacaactccacaatgaatgtggattatc

SEQ ID NO: 37413 - DNA, 1041 bp, Homo sapiens
gtagcatcatacatgtttttatagttaataatatactcctatccattcaccctgtatatgtaacatttaacacggtacccagcacatagtagactctcaaatgattaagtgaatcaattaacatgtattttattgcatcattcatcagtattttttttttttttggagatggagtcttgcagtgttgcccaggctggagtgcagtggcacgatctccgctcactgcaagctccgcctcccaggttcaagtgtttctcctgcctcagtctcccgagtagctgggattacaggcacccaccaccacgcccagctaattttttgtatttttagtagagacagggtttcactatgtcggccaggctgctctccaactcctgaccttgtgatccgcccgcctcggcctcccaaagtgctgggattacaggcatgagccactgtgcccagccattcatcagtattcttgaataataaattacacccttttttaacctttttaattaaaaaaaaaaaaagactccagacatttgtacatataccacttggactgaaattgaatatttcttatctgtcctctttggaatcatttgtataaccaaagaaaaattcttttgtttagtactcttcttctaactttgaatttatgcttaactacttttctttcataaagctgttagacatttataatgaaaaatattttttctacgtttgacatttattgttagccagtctgacaacagcctaaattctctcaactaatcccttttaataggatagagaattgaagaggcatctccattagataaactgtgttccctttagagtattgtgttttattttggctttcaacttctcagagatgtggaaaatttagaggatggtccataaaggaaacaaacttcatgagattgaaaaatacaaactgtatagtttgaagtcaggtactcaatgggtgcagctattcttcctcagtgttctgtcatactttgttctctcttacggtgataggtctaagagtctttcttttgtaataagtatcattac

SEQ ID NO: 37414 - DNA, 1101 bp, Homo sapiens
tttgtgatttttttcctctggtgtaatcaatttgcaaggaaatatagcatacgattagcatgaaaaagaatctagaggcaccaagcagaaaaagtcttctccattctcctacatttttccttttatttaggctggaatgggaaaaagaaggaatccagggagtgtttgaaaagagaatcgaggaaatttaaaaattgtagaaatcatatcatgcttgttcagcgtgcatgtttatggggtgtgtgtgtgtgtgtgtgtgtgtgtggtgtatgtttgcatacgtgtgtgtgcatgcatgtagcatacctggcttaatgctataatgtattatacatgaaagtaagctctgcattccccctctccttcaacaaaacacctaagctgtcctaggcagagctgagtgtgaatggattgtattttatgccaggaacagtggtgaagcagacgacatcccgtgcaccctgtctttcgggaccctcagatcttggttcacatagatagaattcaacataatgatctgcctggcttcctgctctgcaaacttccagctccaatgctgagggtacttcatgcatactttcaggttcacctcccagagtcctagacagtggacatttaaagccctgccatataaactctgagccaagcattattagaactgctgtttctctttgtcaccgtatgtagcttttaattgctgcactattgatttgtttctttggaccacaatcctacttggttttccagttgattccccggatgatattccaccatttcccaaatttaacctcaccagtgtttgctgagaaaagaatccaactactggcaagacatactcttatgcccaggtctctgctctatgatatagagagtctgtgtacttagagctttacctgttgttttttgccagatatttccagaaccccttatattccctatcccacaacctcactttcacacacactgtattctattttacacatactccatatagtatgccttgctcgacttgtctcatttctgcaactttccgtagcatctcttctgacttttttcactcttgggtccctgaaatttaatcagacattcttaacttcctgt

SEQ ID NO: 37415 - DNA, 1050 bp, Homo sapiens
atccctttgaataaactttctactcctatctcctttactttctctttaaggccatcaacccttagattggccactttgaggctattttctagatcttttaagtatatttcattatttttattctattttcttttgtctcccctgactgtgtatcttcataaagcctgtcttcaagttcactaattttttcttctgcttgatcaattctgctgctaaaaaactctgatgcattccattgaattttgtagcttcagaatttccgcttgatatttaagaattatttcattctgtttattaactttatgtgataagattctgaattccttcttcatgttatcttgaatttcattgagcttccccaaaatagctattttgaattttctgtctgaaagtttgattatctctgtcactccaggtttggtcactggtgccttatttatttcagttgatgaggtcatgtttgtctagatagccttaatgatggtggatgttcatcgatttctgggcattgaagacttacgtagttattctaaactttgcaatctgggcttgtttgtatctatccttcttaggaaggttttccaattattcaaagaacattaagtgttgtgatctacatctttggtcattgcagccacatgtgcattagggggcatctcaagcctagtaaccctgtgactcttgcagacttgtagaggtaccaccttgatggtcctggatgagatccaggagaattctatggattaccagcaatctcttattctcttcccttactgtctcccaaacaaatggagtcactgtctgtgctgagctgcccagaactggggaaaagattatgcaagcactcccataaccaccactgggacagtgctgggtcacacctgaagctggcacagtactcagtgccaggtcttgccgaaggcctgtagcaactattgcctggtaccactgaggtttattcaaggaccaagggctctttagtcagcagatggtgaatcctgccaaatgtgtgtctttcccttcatggcagcaggttgccttcttgcccca

SEQ ID NO: 37416 - DNA, 1050 bp, Homo sapiens
gaccaaattcctgcctttgtggaatttataatctagtggagaaggtgccagtcaacaaaccagtgaaattaatgataatatcaagtagtgaaaagtgccataaagtaaatgcaaaataaggcaaaatcgatagagagagagtatgtaaatgggattgctgttttagatagagtagtcagaggggccacctctctaaagacttgttgaatattgaataaagtgagaaagcaagccacacaatataagttttggggagaaaggcaaaagtcaagaccctaaagaaggaataagcttagtgtattagagaaaaagaagaccactgtgaccagagcagtgcgagaaagtcagagatgctgtagatgacattggagaggtatgcaggacccagaccattcttagccacctttgatttgtgtgtgataaaaagatatttgagactttgagcaaggaagaagtaacctgaacttgtttgtagttttaaaaggtaatgttggcatatatgaagagaattgactgtaggaaagcaagagtagaaacggcaagatcagttagggtcatctaagaaaatattgcaatactcaggtgaaaaataagaaaggattttgaacttgggtgatagtaatggagataagaagaaatgcacagtcagtataaattttaaagatggacttacatgatttggcagaatgaatgtaggctttgagggccaggagaaatcaagtatgatttcaagttttttggccgattgctaagatacagaagattagagaaagagcaggtctaggatcctgtgggtttgcagtggacagtgatgtagctactaaaaatgtgtaaagacacagataatgtgaaatgtcattaacagagaaggatatggaaacagaaggcaatgttatataaagcaatagataacacagtatgctatagtcagaggtttagctttaaaagttctcactggagcatagatggtaccttacacgctgagatgtgacatggagccatttttataaggacttgtttcatcccattttacatacaatccctgacttt

SEQ ID NO: 37417 - DNA, 1045 bp, Homo sapiens
gaggcaggagaatcacttgaacccagaaggcagaggttgcagtgagccgagatcaagccactgcactgaagcctgggcgacaaataagactccgtctcaaaaaaaaaaaaatttccatttgcactattttttaatgctattgaaaatgataagaaggtttttgtacaaggttacccatcataagaaaaaaaagcaaagtgatatttatagccattattaattacattattaatttctatttttatgataccttgtcctatagttttaaaataaaatatggaacaaaatttgatagcagttacattcagggttgtattatcattatggcattgggtgtatatgattactattgctattctatatgcaacataattagcaaaaccaaatgtggttaagagggtttaaggtaaatgagtggaacaactattatttgagttaaactctgagtcacttttcaccccattcttaacatcctaccacctattaaaggttcaatctttgtttatttcatgaaaaagcactgtagggttttaatccccaaagctgtaggatttgatggccctttgttaaataccacaggacccatctgttctgttaggcatatgccttacgatgtgggaaaatctgtaatacacggtaatgaatccaaagtcctttagactgcaacactaaattttatatatatctatatatatatataggtagagatatacacaaatataagtatataagtatatacatataagtatatatgtaagtatatgtatatgtgtgtgtgcatatatatgtgtgtatatacatatatacatatatagtatatacatatatatactatatatgtatatatatatgcacacacacacattttctacaagctgtcttaaagctctgtaatgagaaatagggaaaattctaaaaataaagcagctttaaagatctcagtgggaaaaagcacaccaccagctgcctgtatcttcttacatgttggtgtcaaagtcattttctcaaagcatggtttggagacctcctgcatcagaatcagctg

SEQ ID NO: 37418 - DNA, 1028 bp, Homo sapiens
tggcctggagcagtggctcatgcctgtaatcccagtactttgggagaccaaggcgggcagttcacttgagttcaggggtttaagaccagcctggccaacatggtaaaagcttttctctactaaaaatacaaaaaaaaaaaaaaaatagccaggtgtggtggtgcacacctgtaatccccgctactcaggaggctgaaatgagaattgcttgaacctgggaggcagaggttgcagtgagttgagatcatgccactgtactccaacctggcaaaagagagagactgcttcaaactaactaaataagtaaataaatacataagtgttttgataggttggattaatttcttgaaaattttacagactcctgctgtaacatctaatacaaatcttattggtatctcctatgtgctagaatcatgctatttgatatgaggaattactacaataaagcataagggttactgagatgaaatagaggcatggattctttgttaaagagcttaaagtagatgtcatcgtttctggagttttgtttggccacattccccggagccatagaaaaactaggttacatctcaaggtgactttgtactgtaagacaacttattgtttaacatatatcaaagtatttatgtgaagaaaattccataatccatatgcttaaagtacatgggtaacaatttttaaatgagtcatataatgagagtagaattgggctgaatcatttccagattatatttaattttggcctttgagagtataaaattaaccaagctatgatttaaaatagacaacaatcaatatttattgttatcttctttttattttaatcaaggcctggaaagaaaaatagggagggcaaaatttccatctctcagccagagatagaacccagtaaagatatttgttttcttacgtactaatccttggaaaatatagcaaatttcaaataagaattaacacctttttaatacaatgtgttcatataaccccacaatgtctttatctgctaaggtttcattgtgaaa

SEQ ID NO: 37419 - DNA, 1033 bp, Homo sapiens
tataagacactgatttgctaattcacagccagaagtaagaagaagtaccaaaccacacaaccataatgtcagcaggagtttggctgccagcataatgacaaatactagtaatgctaatacaaccagacttgccctgggccctccttttgcaagaccctatgtctctactagttaagatcctgacatgtcttctgcatacctgaaaagaagggagattcttttaagttccttaaagaaaacagttacttgagttcatgaaatcttgcactgaaaacaatcctataattagaacgttatcttgaagcctctgaaattgttttcaactgagttaggaaaatcaaccatcgcagtattcagttccaattatccacctcctcaactttttttggagacagattttcactctgttgcccaggctggagtgcagtggcactatcatagctcactatggtttccaacccccgcgctcaagtgatccttctgcctcagcctgctgaatagatgtgactacaagcatgtgccaccatgcctggctaattttttgttttattttttgtaaagaggggtctaattatattgcccaggctggtctcaaacttctagcctcaagcgatcctcccaccttggactctcaaagggttgtgattataggcatgagccaccatgcctgacccactttattttcctagaatgagtctgatgttagatttcagactgatcttccatcagtcagaaaataatcctttcatagattggctggagaagcttacagtgtgttttctaacgggatgaatgtatcctgcctcacaacataattgccaatttgcccctaactctaggcacgaataattcagtagttccttgggaccatataatgcatttacttcttttttcatgaagcattgattgagattatgttggttttgttctgaatatgtacatgaagtgttaaaaagaacataaatgaataggctctgtactaaagttgatcccagtattaaatttaaaaatagtatacagagaaacatttaaa

SEQ ID NO: 37420 - DNA, 1029 bp, Homo sapiens
caaaaaaaaaaaaaaaaaagaaaaaaaaagtttgatgactcctgatatagagatttaagggaaaagagtagaaataaatgaatgaaatgaatgactaaaagaataaacgaaatttatataagcatcagtttttaaaacaacagcaaaacaaatattgttcttttaaaacctgtgccggtaagcagttttcttgactcacctgcttcagtagtttggaaaacattgttgtgttttcatagggatctactgagtgagagtctcccatatgttttatgttgttcaatctgtacctatttttagaagttttgaattagtttttgctagcatgaaatatatccatttctttttgtacttgcctttgactacgttttcttttttgaaagttttgcaaaaatgcttggttaattttctagaccttttaaaaaaacaaattatcttgatgcataaatatactttttcctggcatctgttcagctattcatataaattaaaaatggagcataagcaatacatcatctctttctgaaccaccttgtgtcttgcccaactagggagcaattaattgtgacatgaactttttttaaggggaccctactaaatcatctggaggagagctcagatattttattactccatttctcaaagtcagcatctggcaacattgtatttggagagctattgctatgctttaattcaattcttaaattcaacctaagtcatagcttttagattggaagagtatcttatttttaaaattattgctatttatttttacccactataaactaatttaagggtaatgagtagtttgaaaagaacatttgagcaattttccatctttctttgtggaaaatagtgtgttcagatgacatttccttggcagaatatgcttaggatgtctcaaatcaggagggttctatctttctataggcaagagaactaatgacataggttacctgataatataattacagaaggatttaagtggttaagtatgtcttccatggtgaaatgggagatgttacaaaa

SEQ ID NO: 37421 - DNA, 1049 bp, Homo sapiens
tactgacatggaagagtgttggtggtgtacgaagagaaaaaattaggtcagataacaacgtggtgtttaatattattctatttatctatattcacagaaagatgactggagatatgtgaacagaattccatttaaaaatggaatttatatttaaagaaatatgcttgcttcatttttcaaaatggcccacaattatgtttgtcaccaaaaatgtattttaaaatgtgactcacaaaacattattttcttcaataatgaatcgtgtcctacttgagtcagcagatggttaagtggattactactgttagattagagggatagctggttgatctattaatacttgctagatcaattcattacaatccaccataacctctagctcttggaaggagaaacaagctgcttcaggtcaagcagggccagagaacacacatggaacggctattgtcaattaaactcctctagaccatgaagtttctacagcacaagcctgcggaaaaatccgatgcactgttgcctcaagaagcctgcttgggaaagcaagctgttattctttataaataattgtagcaagacatgtttataaatttggcagtagaagttaagaatattattcagctcttaaaaggaatgttacattatatagtaaagagaagagaaaagggggctataatatagttaaaatgtcaggctattattagcaatgttcattaggattatggactagtgctgttaggtatcttaagtaggaattatgtttattaaaataataattgaataaacttctttatttccataatccaagaggtaattaaatatgatttttatttaacaaagcacgaaagaggtttcaagtgtaacattgctcaacaaacactagatgtatgaatcttgtacaagttttgatggtactttaaatagtttgaaaatattatgatacttatgccttcagtagaaattggagaccttctgtgtgttggtgaattctctgggtaccatggacaaggagagaaacctaccacattggaaagtcactaatatgtttcagt

SEQ ID NO: 37422 - DNA, 1050 bp, Homo sapiens
aactaagatagtctctaaagttcttttcccatctctggcactaataaaatgagtactatcaaaaagtgatgggatccatagatcgtggtgggactgaaagtttgaattggggttctaaagggaatgaataagaagataggaagtgatggtttattgtttaatttattgttttgctagttaattttttctgtcaggccacacattttcaaatgatatgtaggtagaatatatattatttttcataattttatgctgcatttgccttcactggaattttacttatttttttcattctttatttagtataattcttacttctattatatgagatatgctttcccctcagatatggagtaacctaacttcatttcttacacataatattattatgctatttattgttattttttatcatgtacatatgtactaaataataatgcaacacacaaatttctgcccttagctttttttatttcatattggtagggggtctttaagtattcatgatcttcttgaaattattttctctctctctctctctttctctctctctctctctctctctctctatatatatatatatatacacacacatatatatacacatatacacacatatatatacacacatatatatacacacatacatatatacacacatatatatacacacacacatatatatatatatatatatatactttttatctatatgtatctcttgctatatgttgcagattttctgtttctaactcatccctcagcttaaactgcacagcctgggagaatctctctctggtcatcttatccaagtaactcatgctcacacacacacttacatacacatcatatttccctgttattattctgtcactgtaccattattaaatatattataacacttttcaaaaatcatagttatataatcatttatttgctcatttattttttatcttatttccaatagactgtaagcttgatgaaggcaggaagaatatctctgttccttaatgtatacccagctccaaacgtggtaccttacatatagta

SEQ ID NO: 37423 - DNA, 1615 bp, Homo sapiens
cagtaatgcccaacaatattgtttttaaacaaaaaatgtaaacattcaaaagaatctctctaaatcactgattaaatcatttgactgaaaacaagcttccttctctattatttgttactgagtcattcacctttattatacaggtatatttatgaatattatatcaaaatagctacatcatttggcttcataataggaataaagacttacctaaaatggttgacaacattcatctggctaagaaatgaaagtacaaaggaccctggcctccgatcactctctcttataagataactgccagacttccctgcctgcctgaggcgttcttctgctatcgttctgtcaagttttccgtgataccacctaggggaaaaacagagaagatattacaatataaatagcaagtgcagaatttctatggacacttgaaaaacatactactagaggttttaaatgcctacatgtaacttaaacatttacattttactctgaaccagttattccaattttaactcaatttaacctcagtctcaaaaaatactcatttacttggtctttaatttgttctaaaagctcagtcctagtcatctcatatataaatctcttccatttctacccatctccctacttccaggattgcctgctattcaaaatataaacactactgcaaccagatctttacttagaaaaataaaagatagacaaatggaaatgattaatttactacctcgatcttatactgaggaaccatgacttcacaaggcacatggaacctatgagaatataaaatgttttattccattttagtgtttgtgccctgcgacaggaaaacagaattacactgtctaaaggatgctattttaatttcctgtttgaacgtgaagctgattaatccctttggctctaagataatctactccatgactatacattttacatttgcactcaactttccaaatttatgtaacaaacatgtgggagaataaatagcacctttgtcccttcacccttcttgctctcagtttaactgtgttctacctacatactatcaaatgatctacttaagaaactggctgtaactctagcataccaagtatgcctataaaagcctcatggactgatataaacagaaacatgcttagaaatatactagaagtatcatacaggcatggtaacaaatctccaaagtaattgctataaaatatttttacatttgatagtttagccaaactcatccttagatacttacagcctaatttgaaacatccagagaaaaacaataaacattcatattacattgatatattcaattatgtaacataatatagtacttcagctttaccaaagtttatttgtaatcttatatgtgtaataatgtatgtattttatataatatataagccaatgataaaagcattatgttactatgactatttttgtaagcttgttgtaataaaagcccattatttttgactccttaatttttaaaaataaaacaaaaacacagaaacttaaaacttatggaaagaattacttttagttttcttctaaaaccaagctatttatttagagccctatgcataaggctgaaaataatgaacttatttatagcgtt

SEQ ID NO: 37424 - DNA, 1045 bp, Homo sapiens
ataaatctaagttatgctgtgggattttcataatcctctatcttgaaacattatgctgtttcatcatcctaggaactatttcatcattactcagaattattcccaagttaatgctacaaaattactaaaataataagaaaatagaagaatgaattgcttacagcagggctgacaaactgtggcacgcatgctaaatccagtccaccacctgttttttatacataaagttttactggaacacagccatgctcattccctaacatgctgtctgtggttgcttccagataaaaagacagactttagtggacacactaaatgaactgcaaaaccctttacagaaaacttttgccaaccgctggcctagaggatgatataactgaaataaataatctctactgcatcactctgggtgtgtgtgtatgtgtgtgtgtaactgtgttgcaaagtattgcggcatcttttgtaaaaacataaaaggccatctttgctgtctttttagctttgattgaacatacttaaaatattcagaactctttattttctgctcataaatgataaagagaaaaaaactgatccaggaagatgtttgacaattagaaaaatcagaaaacgaatgcaaagaaacagcagcactctagactcttatcatgatggcagaattgattttgataaacctcagactgtgatttttcagatgatgatatacttgaattttctcaaactcaatcactgagtgaaccatattacttctattatcctgttttgctaaaaagaaatgagactaaatttttgtatgtacatcaaaatttacttaatatgatttgtgaatgggcaaatattaaagggcctttgtataaaaaattactgaaagtaaacatatagaaattgtaaaattcactggattgatcactcttataaacatcaatgttaactggtgttttaaaatctaaacaaaaatattttacaattatggagcaatggacactgtactctccaacaaaattatgagccatcagagttttcaaaagtactgcattttgctcac

SEQ ID NO: 37425 - DNA, 1239 bp, Homo sapiens
atgcgcactaatcacctactgcacaaggtggctgttaactttcacattagtcttcttctaaatgctaaaggtcagcatatcaggttctatgtgtacacaaagcaggaaatgttcaatgcctggcattaatttgataataaagaaaaagatattaacattcatttataatttccccttttgtcctctggtatttgcatcctatggtaatacataatttatcaacctatttttctacttgtcctattatatggtacagatgtcttctcatttccttgaaatgtactttgttaatgctatttgccttggcattcagtctttctcactaagtgcttctctatttcacaggaaggcactttaaaaaaaatagttaataataaagtagcatactttgaaaaaaaaatttttgttgttgtttttggtttagttttgtttgagaccgggcctcactctgccatgggtgtagtggtacagtcagctcactgcaacatcctggcagttgtgagcctgggctcagacaatcctcatacctcactctcctgagtaggtaggaccacaggtgtgcatcaccacacctggctaattttttaattttttaaagagacggggtttgccatgtaggcccaggctggtctccaacccctgagcttaagcgatcagcccaccttgggctcccgaagtgctgggattacaggcgtgagccactgcgcccagtcttaaaagaaaaatctgttttctaaatgagagacttgagtttagttctcatgaacataactttttcatactaggtttcagacctggtatcattaaatataattcattacaaagactttttctaatgtcttcaaattctttaagtcaccttcaacaagaaactgtacaagaagcaagctacaaccttacagcaagtggtaaatgtatatttattgctttccccctaccagacagaaactcctttcttgttactaaccagaataggaatcattcacaatcttcaacttgtgcttcaaggatctgatccttctttttactctggcaattctttctcttttaccatcaagtgtaatgtggacctttcttttgattgtgccaacagacttccaatctaactgcatctgttcatataaactatatcaaaataatgctaaagcttttcttcaatcttacagatattgcaatattcatcttaatacttccttaagattcatctaattgcagttgtaagtatcattagtgaatcat

SEQ ID NO: 37426 - DNA, 1053 bp, Homo sapiens
ctgagacgctaagcagaaaatagttcctaaaaggctaaaaaattaactacaaatccagtagtttgatagtgctaggagaaaaaagaatgaatttcaggctttccattgagacccctgaagggctgtgccttcatgataagggcaaaccagaaatagaacagcctttacaagatgtactaaccctataccatccgtaagaacaattctttctggacgcaataacattagtttccatagtttttcatgtacaatgtctaccacttagtcaaactaagtagacactacaggcatcaggattaaatggctaaaagttaagatgaaaaaccagaaagacatacatataatgcagatactgaagacagacaagactttcaagtaattataattaaaatgtttaagaaaataggtaacaagaattttgccagaaactgtatctttaaaaaaatggaaattctaaattgaaaaaaatgtaataaaatgaagtcctgaaaaagtggatttaactgcagaatggaagattagtgaactgaaagatcagaagaaaatatataggttggtacagaggaaaaaggatgaaaaacagaaaacagcatgggaaatagtgcaactttttttttaaccagactccaagaagaaaaaggaatgtggcagaacaactgtttaaattagatactaaacatttaaacagatactaaccaagagttttctaaaactgacaaagaacatcaggtctcagattgatgaagcactacaaacctaaggataattttttttttaatttatagttggtacattttagttttcccactaaaaatataaggaaaaatctcaaagcatccagagaaagttgtgtgagatacattacctctaagagaaaagacaaagatacattacctctaaaacagaaacaatttgaatgacaacgaaaatgttggaaggcagaaaaccatctttaaaatggcaaaataactgccaatcttgaatttaatatccagcaaaacattttcataaataaatgtaaagcaataaataccacagtgagatccagctatg

SEQ ID NO: 37427 - DNA, 1042 bp, Homo sapiens
agttgtaagctcattcaggtttattctgtgagtctcacgctaggatctagttttaagagcatcttcctcatatctagggttggcaaattatatttccaacaaagccactttcacttcttaaccacctttaagttccttcgttagaatataagcagaaatttagctgtatttgtataaaatacaaccatatactccagaaatattagggttcaaagaaagcaaaaaaattttttaagagacagtgtctcagtttgttgcctaggctggcttacagtgtctcgatcttactcactgtaactcaaactcctgtgctaatgcaatcttcctgcctcattctacccagtggctgggactacaggcataagccagaacacctagctaattttttacttttgttatagaggtgggttctccctttgttgcaaaatattttttaaagagtgttttttaaaaaatattatttcttcacacaattacttaatagacgctataagaaggacactgcacatggattaatagctaatctaaagtagacattatatctcgacttggcttagagaatagattcctaaaatatctttccttgtgttgactgacttttattttcagacatggagttcaaccagtgaagaataatgcttgttagcaaaactaactggttaactggcttacctttggattatactgagatgacctataacctttatgcagagaggattttaaatgagcattctcagttggcctcaacatcatagagtatttaaaggtcaatttaaaatggagttttcattcctaataacccttcactgtgtttgtttttgcatttctttcagaaaactttttacatatgaaatctcattccttaaaataagagatgattagatttcaggcgttctgtcactttatcttgaatgcgatcattttctattccagttaataagaaaacatgggctaacataaaagtatactgtagtttgagaaacagtaatcttacctctgcttgttctggagtttctcctgcaaagtaaaagatgtaatgttc

SEQ ID NO: 37428 - DNA, 1027 bp, Homo sapiens
ttttttgaaagaggccaaaataagtttttgaaggaaaattaagtgcccaacagaaccgtttctgctgtgttggtttagtgttgttatttaaagtggaagaataatctttcttatgtttttaacagttggcatggactaagaaagaacattctctttcataaagaagtaacgttttcctgctactgaagcaagtggcagcatggcttaaccccatatgatgtccaaaacagttcagataaaaataaaataaaaagagcaaagtgttagagcaaaatgtgacaattaaaaatccaagaaaattaagcttcacctgacgaaggcgtttattggatgtccctggactacttttccgtaaattgcaaaatgcctgcagacctttcatccaatcctgcaaagaaaaacagcacttcaaagaaatatacactagtttatttggcttccaaatcatcagttaggttttttttttcaaattcaacaattttttccttctctagactgccatttctattctcagactatactgtacttcataacaataaccaataataaaataacaataacataacaataacaataataaaacaaccaaaacaattgtaattctgtataaatctttgtttgaatttatgtatgaaacacatcgagtggccattaattagccaaaaaatcaaatttacattaaagaaactatttctcccaaacagatactaccttggggaaattaactgtataattaagctgttatacttgaggcaagcttaggtggaatttaacttgatacactttgtgagagggggagagtgctgattgtaaaaccaactgataatgtgatgaccgatcccatgacaagcatattaatctatactttagaccatgatacaggtagaaatgtataaggggatttgggttatttttaagcttctcaaatataacattagattttaaaaatcattttagcctaatattcaaatcaaattgcagccatatttttaaaatgtttatctagtgctttggggaaaaggagaga

SEQ ID NO: 37429 - DNA, 1616 bp, Homo sapiens
ggtggaagtatttctgaagccatgaatattttctccacaagctctgaaagtatgttcaataggtgtgttaaattagtgttcacatcttcatttttttctaactttgatggacttaactaaaagaaggaataaatcaatataaatgcatgttggcaatgacaaatgcaaatgaatagaggaaaacaagtagttatagttttcgaggttgtctatttttcggtatctctgtgtgtattgatcttttttctttgtataatgggagtttttaagtagttttctctatggaactcctcctggtaggtctgttaccatttattcccaattagccaactgaaaagcaaacagtgcttagtcaattctatttatttgaggggaaaaaaagctgattaaaagcttttctgaatgaggcttatttaatggctaataaaaatatcaaatgccttaggcagaatcacaaacctttctcagaacttttcctgtaacccttctgatctagtgtcagcagagtacatttatctatggaagtcggaattccgtagcctatctctaaagtccagagactccctacctacctgctgcacttctgtgtcatccttatgttaggccaactatggcattaccccacatttccaacattaaatcactaatttcttcccttcaagttattagtatgaatcgacaccttcgtgcaggattaacatttgctaggtcccagtgtccattgtcaaaaacaattccttaaactgatttttatatcagatctaatatatattatttctttgtagttgctttaccattaaaatgagagaatatgtgtgtgagattccacttactgtcttaatagtgtattatgaatttatactgaaactttaataatcctaaaaagatttttttgttttagttgaggttatctcataattctcccctcgcaaaaaaaccttcaagaacaaaccaagatgtaatgaagtgctacataggttatataatgagtcactaacaaaaccttcaatttatcttatgcacgctttctgtaagtagtatatagattattagtacagtagaggaaatgacaaagtattttcatgaatttctggtgcaacttgatggtttttaatcccaaaataaagtacatcttttttaagaagtccattttgcagaacatttttataaatgtattacagacaggtgtaactgctatgaggaataattttagaaatttaatatattttccttaaaatgtaattggctacaaattattacctattaaaatatgttctttgcaaaaatacttattaaaacattaaattcttacctcacaagactgcttgctttccattatctttaaaatagagtctttcaaagcatgatgaacaaactgtgtagcagtggctttcatatactgctccatcaaggtgcttgcaagtgttgtggctcgaaatagggtagtggcttcatctacacaaatatttacattagaagattatttgtaaaggactgacctaatgtgaccaaattggaaattaagtgaattcattttacctcaacaggaatagccacttaaatgtgctttttgcgtgcagcgttgaaagtactaattacaatgacatcctatactt

SEQ ID NO: 37430 - DNA, 1910 bp, Homo sapiens
aaacatcattgttaatgaaggctggcgaaagcctacctgctgtgcaccacgctcattactgagcgttcgaagttcatctgaatgagccacgcaaatctcatgcaatgctgctaaatcacgggacaggtccgttctagaatgctctgtagtgtccggaagttcaggtacattctttaagggaatcgtaaaattgcatttagaaatacaaatcttctttttttttgttttttttgagacagagtttcgctcttgttgcccaggctgaaatgcaatggcatgatctcggctcactgcaacctccgcctcccgggttcaagcgattctcctgcctcagcctcccaagtagctgggattacaggcacctgccaccatgcccagctaattttttgttacaaatacaaatctttctctgtagtctcatgtgaaaagattctaattgggtatattagataatttttttaatactcaaatttctcttaaaattctaaagattcttattgaaatataatattcagtattaatgatggtaaaatatagactttgtaacctttgtattcacatgaaagccagattccatttttttccgtagcatgacagatgtgtacaatattattgctattctaaaaataaggggtggggggtgtggcttcctaacaattagctttgtatctgaaaaaatctagaacatatgccaaatagtgtaggttaactgctaatctggattaaatgcagcctaaacttaaaattcctagatgaaatttcattattaagctcctgtagtttgtctaagttgataatgcatataagtaggaactgcactatgaaaatgcaatgagaacctgtcaggtttgcaattatctgtggactatgctcagaatacttgctaatgtgtgggaataatcagtgttaattatggtactttcagataaggttcataaagtaacttagtcactataatgaaagtttatagtataggttgaatatcacccaaaatgcttgagaccagaagtgtttcggattttggaatatttgcagtatacttgccagttgagcatccccaatccaaaaatccaaaattggagattttccaaatagcatttcctgttggtgctcaacaagttttggattttttagcatttcagatttcagattagggatactcaacctgtactttattatcgacactaaatgccagtgttattttaagccttggaataacatttaacaagggcttggattaccagtaaaatggtgacagtatttgctttacattgctaaaaactgcaaaacaatgttatctatgggacagagaaacacagttactcagaatacattcagtgattaaaggtttatagcgatgaaagactccatatttgccttcagagaactgactccagtagaaaggactttagaataaagtaatcatagcaacacagaattatatatcacagatacacaggggatgcttaggaggtaaaacaaaagttattttattcatgtttggggttcagcaaaagcttcctgaaggagataataattgaggtgggtcttcaaaaataaatttggcttattatacaggtggtgaagaaatatggtagtattatatttggattctaagcagtatgaaatcttagattgtgtggcataacttctcacacagttccttaaacattatagtaaaaatattttccaatgattgaccaactatatcccagttcacatatagaagcatgatggacttttagcatttttgtccatttcactataaatttcactataaatatggagctatgccataatttttcatacactagtttttatacctgaggttgcaaactagtgactcaacggcattcctgatttgtttgccacaaattgtggtggtctttttaactgaatctgaatacatt

SEQ ID NO: 37431 - DNA, 1032 bp, Homo sapiens
gttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttt

SEQ ID NO: 37432 - DNA, 1025 bp, Homo sapiens
tttaaaaaaaaatcactagatgtatacttttgtaaaattcaataaaaaatgaattactagaaaagtgaagacaaaaacataagctcaagttttattagattcagcagtcataaaattattatatcaaattgctattaaaaatttctagggccgggcacagtggctcatgcctgtaatctcagcagtttgggaggctaaggcgggcggatcacctgaggtcgggagttcgagaccagcctggccaacatggcgaaaccccgtctctactaaaaatacaataatcagctggacgtggtggtgggtgcctgtaatcccagctacttgtaagactgaggcagggagaactgcttgaaccctggaggggtcacagtgagccaagatcacgccattgcactccagcctgggcaacagagcaagactctgtctcaaaaaaaaaaacaaaaaaaaaattatgaaacacaattcctgtacttaactcactgcaaactggaaactgttcatggaccagctctggtacttgctaccatgagtagtgctactttaggactaaatatttgttttccttgatcttcaaaattattttacctttagttttcatgacacaaaaactgttttgtcattgtcagtcaatacaagtgaaaccaaagttccctttgatcaaaacccaaatctgtcatgacctcagaagttacttagcagttgtttacctttgccagccttttctctgcacgtatatccatatatttatgaaataagcagcgtttttttcttctttgcatttttcatacatattgtacaatgggtgattatcaatgcttagcttttgctagtctgggtgaaaaagtatcacattggtattttaatttgcattttcttgattatgggacattgaactttccatacttaacagtcacttatatttcatctgtattgcttatttatcccctttgcccaattttctggcttttttgtttgtttgtttgtttttgagatggagtcttgctgtgtcacccaggcttgagtgc

SEQ ID NO: 37433 - DNA, 1027 bp, Homo sapiens
aataatacactctttgtatatttgggtactcttatgttgggtgcatatatatttttaattttatattttcttgctgaattgatctttttgtcattatgtaatgatcttcatccctttttatgtttctttgtttataatatattttatctggtataaatatatctttttctgtgtgcctttggcatctgtttgtgaggaatattttattccattccttcactttcaatcttatgtggtctttatggtaaacagagtttcttataggaagcatatagttgggtcttgtttattttttaactcatgcagccagtctatatcttttaattggagactataactgctttacattcaaggttggtaataataagtaaggacctactcctgtcattttgtgaattgttttctagttggtttgtgtatcctgtgcttctttattcctctctttttgtttatctttgtagtttattggttttctgtagtgatatgtttgattcctttctctttctcgtacgtttatctgttgtgccagtgagtcttattcttttaggtgtttttataatggcaaatattcagtttttgcttctagatgtaggtttcctttaagcatttctggtagggctggtctaatgataataaatttcctgtttttgcttgtctgggaatgacttctttttcttcattcctttaagatggttctgctgggtataacattcttgtctgacatttttgtttggtttggtttccacactttgaatatattttcccatctcttttggcctgtaagatttctgctgagaaatctgctcttattctgatggagattcccttatatatcacttgatgcttttcccttgctatttttagaattctgtctttgtctttgacttttcagttttactataatgtgccttggagagggacttttggattgaatatattttggtatctttcaacttcttgtacctggatgtccgtatctctttcaatacttgggaggtttcagtgattacttcattaaatagatttt

SEQ ID NO: 37434 - DNA, 1024 bp, Homo sapiens
ctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttcagcagagtaagcaatttatttgtgttgcctatgtgtgagtgtatttaaagttttatggacgcttaatggtttctcccaaattaaaattctttttctgtcatttccaaaaatcagaatctttccctctcaaatcaggtctacaggtatcatgtatgcctttgttaaataggacttgttttaaatttgtagtttctagaattagaaatatttttgttttactggccaaaacggataatttgaatgaaacattcaagggaaatgaaaaaaagtaaaactctt

SEQ ID NO: 37435 - DNA, 1047 bp, Homo sapiens
gtatttcacatttgtgataagagtaatctgttgtttttttttttttcccccacagggtttacaaatttttcagacagtgcgatgcagtttcttgaaaagcaaggtttagaatctcagtaagtttttgaaaaattaagcattatttaaatttaaccttttctatttttaataaagcagtatttactataaatagctgttttaaattagtaaagagttttaagttggactgtcacttctagaaacatccttactcataatttttatgactatataaagttagtgtcttttatagaattcttatgtaaatttgcatttcttaaattcctctccctcaagagattaaatttatatccaagttatatgtcaattccctgttgaatgtgtaggttaggttgctgtgactatgactaaagagatgcctcatttagtttacagttcaccagaatccattataggtacttgaataatagcaatctttttgtagaaatttgctttgttttactgttattgttatttgtaagataattgattagaagaaaagaaattcttcaaaagctaattataaaaatttatcagctttttaaaaaattttatttttaggagtcctgtttcaaaacttactttcaaatttttcctggctattttctgttcattcattggggcttttttgacatttcctggattacgactggctcaaatgcatctggatgccctgaatttggcaacagaaaaaattacacagtaagcggaaaatgtacataagcacatgcagataaatatatgttttccatcttaatgaaggtataatattgtaatgtaatcataaattattgtattgaaaattaataaccatttgatgtcacactacttcctctttcaactataagcaagtttcttttatttgcttctaaattttaagtcttgtatttaaaaagatacatcatcgattactaaatttgtcttacctgttaaaatgaaaatctcaaaatttatgttatttctaattcaggggcttatactgcaatctctacaactaaactgaggatc

SEQ ID NO: 37436 - DNA, 1033 bp, Homo sapiens
ggattacaggcatgagtctttgtgccctgccagtattgcttattattgaatattcttttcctcactttcttcatggtttacacatatgtgggaatacatatacttgatatgcagttttattttaatgtgattgagcccttgatacatatgtaccagagaaattagaaaaatatactttttaatagctattcatattgtttatgtgagtaaattttatctttcattttactctataatgcctaataatgtgggagcaaaggtcccacacagcctttagcactgaactgactttgcttcgttttaagtaatccattcctgaaaggcatcaaacagtaacatctctgcaggaatcctgtagctcgctggctgtctccctatcccagagaggacagaaagttctgaagagcttacaggccaagctactttctgccagctttgattctccaaaaagagggtggggaagaaggcagtaaaattgtgtgtatgcttgagtatgtgattttttttttgttcaaacctgtagcatgtgataaagttacctaccacctttaaaggcatataggagaccagaattaaattccagatatccagtttaacaccagagagaaataagtttacatcctatcttttatctttagttataacataacctgtttttcctttcataccctatgattggaatatagcagaagtaacccctgtctggcttctctttgttttcttattgtatgtgcctacttagtagtcaaacacgtgtctgcattgattacacaggacaatagctttgcttgattccatagtcatacatacctcagttaattcagaaattctctgcagttgttactgatgaaatgttccttgttaaaatggtccccaaattagacacataaaactttaaaaatcagttcacttaaaaggaagcaaagtatttaacttccatggtcattttgttgtctttcccccctcactgatatgtgacatacataagacagcaaattatgctttctacagaatcttaaaagttctaaaagca

SEQ ID NO: 37437 - DNA, 1750 bp, Homo sapiens
tagaaaacctaaagcagggctgggggcagtggctcatgtctgtaatcccacctcttttggaggctgaggcaggaggatggcttgagcccaggagtttgagaccagcctgggcaatatagtgaaaccacgtctgtacaaaaaattaaaaaattacccgagtgtggtggtgtgcatctgtagtcccagttactaggaaagctgaggtgggaagattgtttgagcccgagaagctgaggctgcagtgagctatgatcacaccactgcactctcagaaaacctaaagcagttaacctaaaagttaaagtacgttgaagcagattaagaatgttaaaataacttgatgcaaatttaaaaattaatcataataggattttggaaaaatgttatgatcatcttatagaaatggtacaaaatttggttagtttgttttgatactacttttaataggtcttactgtatgtgatattttcaaaatactttttctataaggatatcgtatcttcaagtgtaattgcattatatttcatgactaaaaattgtccaaagcaatgcagatcattttattatgtgccataagaacatctgaattgatggttatgtacatgatttacttccacatttttaggaggccttctaaaaaatgatgttgatgttttggactacactctggtagaagtaaaccagaatacctatgccacctgagatgcaaagggtgatggaattatatttactttcaaagaatgttaatttcaatgtaaactcttaagaatggaatagtttgttgaaggggtatggttttatagaaaatcaacagacattttataaacttttttgcagaacaaaatagggtataagaggtatatttagtttattattttatttttcttgagatggagtctctctctgtcactcaggttggagtgccatggtgtgaactcagctcactgcaacctctgcctcccaggttcaagctattctcctgcctcggcctcccaagtagctgggactacaggcacctgccacaatgcccggctaatttttgtacttttagtagaagcgggatagtcttgaactcctgacctcaggtgatccgccaaccttggcctcccaaagtgctgggattacaggcgtgagccaccgcgtctgttcttgtttattattttaatctgtagtatctcacagaattactagtttacaattagtacagccaataattgtaacataaagttaaactcttacttcacaaaagtgaacagtataactaaattgttgtgttccagactaagttgttttctgaagttaaggtatcatagctagatatttaaaagaaaatatttactaataatttctgtaaaaagtagctaatcagttaagacaataccagtaaatttgcaatcatactttaccaacaacttaaataacttttggtaatcttttaacgtttattttaatttgtgaggtattaaaatttagtttgggatgctaacatcctcagtctatttcttgcatttttagattcatatatttgtaaatcttacattgcaaatgaacaaataaagtctagcgtattttaattataaataaatcctcataagttatttatgaaaatgtaagtgaaactgttttttttgaccttttttttttttttttttttttttctttccagcattgcattactttccagaataccagtggctggtggatttcacagtggctgctacagttgtgtatctagtaactgaagtctact

SEQ ID NO: 37438 - DNA, 1029 bp, Homo sapiens
aaggcaacagtctgccttattgtttcggctgtcatactgtaaacaaatctcctttttatgatctgtttagggccacatttttttacaattttgcttttcgttggtgatcttgctgtttaaaatggcccccaagcatagtgctgaaggtagtgtctagtattcgtaagcacaagaaggctgctttatggaaaaaaattgctggaatgacacacagaactaaaaaaaaatgctatacttaatgattactggtattaggtaagctttgctcagggatgagttatgcttttggctgtgaattcaatgttagtgaatcaatgatatatattaaataagatatctttaaacagaaacacacataaaagaagcttgggtattgatcagtttatgaaaatgttatgaccagaggctcgcaggaacctaaccctgtatttcccctaggagcaatggttcagtgtttgtggcaactttataaaacctaactaccgcgaataacgagaatcaattctgtaagttaaaattctggacttcagtataaattcaggaagtgcctccttacctgtttattgtaatttagggacttttaggttgggatatatatattttttatcgtaaattcattaggcaaagaactgaattccgtttggttcagttactgtttttgagcacttgctctatgccagtaactgtactaactttgaagtatacaaaaagcaagaaagccataaaatcttttctccaagaatctttcacttagggtaacattccattttaatccaacttatctgaaaccaactgagtatactgcacttgtattctgacagtaattacctggagttagtacagaccccacaggttaaaggcgaagttctccgtaagattgtcaccacttcagataccagtttcaagttttcagagtacccaggccacctgcacttctcacttattaataggctacaaatttgaggattcccatgatcccctcagatccagtaatctgctagaatgattcatagtacttaggaaactgct

SEQ ID NO: 37439 - DNA, 1058 bp, Homo sapiens
cagcatttttaagttcttgatttcttcctgatctcttccatatcagaaaaggtaccatcatcttcaaatcagaaatgtagatattatcctttattgcttacttttgttcactctctacctttagtccatcagcaagacctgttgattcactgcccttgtctccctctaattcacagaacaaccaaagggatcttaaaatgtgaatcaaattatttatctacattgctttgagaccattatttagcataaaatctgaagtccatactatgacctattagcctttgcatgatctgttcccttcttacctcttcagtcccctcttatgtttctccttgaagctcttgcctcattgccttttagttactgtaatgtcctatgttctttcatgcctctgtgcttttggatttggtgttctctgcctgaaatgctcttcttctgttttctcattctttaggttgctggttaaatgtctcagagaagtttttcctcacctaatatctaaggctgtctctcacattttcaccacttgtttcattctttcatgtggtatgacaatttatttttcactatttaattggttaaattttaccccaactggaatataaccatcaaaaaggcaaaggctttggctttaattggttgtgattatatctcctctgcctagcagagtatctgaatacagaaggttctccctaagtgactgataaatgaatgaatgggtaggtgaataacagactagaagtgaccctaaaagtatcgagcatccttagattccaactttgaacaataattctcactaataaagataaccctgagttatcccataggaaatgtaataaatctaagccattttagagaaatgagtttacaaaataagatttaacaaatatgagtatatttaaaaagaaaatgtgtcttaaggccaggcgcggtggctcacgcctgtaatcgcagcactttgggaagccaaggcgggcagatcatgaggtcaggaggtggagaccatcctggctaacacggtgaaaccccatttctactaaaaaatacaaaaaattagc

SEQ ID NO: 37440 - DNA, 1050 bp, Homo sapiens
attattgattttatccttttggcataattattattttatgagccttttgtaatatataataattctgttttaatagaaaaaaacctaaaattataaattgcctatgtaaaaatattactgatcagaaatgacagtttgcattttaaatcatatgatgcagttgggttgaagagagaaatccgagggcattctttagggtctataaagtgcttaaaggaatttaaggagaggatcatgaatttttttttacaactatgaatagtgtaggatggcttgggagtgactatattgaatagaactatttaaaagaactattcaagtaaatagatgtgtagataacatgagagattaatcatgagtatgacagaagaaatttgtttctgtgtatatcatgttaatattcatttattccattggtatcctaaattgtaaataaatgttcttttttttttgttatggcttctcttttggtgtcaattaatctgtcctgtctctcattgacctctttccctttgaaatggagagtttgaagttgcagccgattgtagtgcagttcgccctccatatttctggattcagccaatcatggatcaaaaatactcagaaaaaaaatacaagtttaagttaaaaacatacactataaaagctatatagcatctgtgttgtattaggtattatgagaaacctagagattatttaatatataaaggagaatgtgcgtagtttttatgcaaataaaaacttttgtataaggagttttagcatctttggattttggtattctggaaggggtgttgggggcattggatggtcccccacctacccccagtttccctcagatacctggggacaattgtatgtcgacttaatgagtaagccattttcctgaaagagttaataccttgacaaaataagcaattatacttgaaggaataagcagcttttacttacaaattagtttgttgatttttaatattaaaaaattgactaattttgtagctcttgttaaataacacatattgctattagtattttttttagactgttctt

SEQ ID NO: 37441 - DNA, 1098 bp, Homo sapiens
taataattctggggagtagggatgcttcctctactccttctctggaaatacctcttgcttatatggtaaaaacctggaaaattacgatctgagttttaaaaaaagtttttgggttgagttgccattggaactacgtgcaagattgaaagaaaaaaagattttagaaatcttgtattccaaacaattgaaaagaggttaaataacagtgtcatgactagccttgagaatccccttgtgcagttagaaatgctttgcaagctcaaaaatgactgtgctaggctccttctgggaagagtaatggtgactgcccagcactgaagctcagtagctaaggcttttaccttttgtgatgatggcctggattcaatacctggcttagggactgagtcctttctggtttgacatttatgagacattttgcctcttattgacccttttccctcccatggacagctttccatttcctgctttctttctgtggagggcatacagggctttgaggcctttgtatgtagatggttagctgggaaactgagactctggagaatgtggccagacctaaatgtgagttgtacccagtttgcgtggcaaaactttcctttctttgtgctacttttgccatttgtaaaaccactttccatttctttggaaatacctaatgtgtcagtggttaagtcataatcttagttaaggcttactggggaaaaaaaagaaggcttaaaagccagaggtgtcatctgtttgtcctggctagagtgtggtaaacagagatttaaaaggatttccttaaaagagctctatggttaaaagtcaggttaattaaaagctggtaggtaagctatacatatatttaaaaggcctttataagcttttttgtcttcttggatcttgtttttttgaggaaaagttgtttttttttttttttttctcagtcgactgaattgtttctccatttgcttctgtctgtcctcttactacccatgatgcccacatgagataacctaaggcaatttctagcagcctgggtctccctgggaaaaacagaggtaccacaattttggaagaaatctctgttttcctcatggaaccgcaagaatt

SEQ ID NO: 37442 - DNA, 1061 bp, Homo sapiens
ataggcccccattttttacttccagtccagtttactgtgtctgtaagcgctgcaggtatgttagaaaaccagtgaaggccacagtagtgggataccagagatgctctatgggaaggaagtctgctggtctcttcatgattgttttgtgctgcttttatcagctttggcattatatgggagaatttctcttctggattagacagtcctcagacctaccaaagaacctattggaaataaccatcttcaaaaacccagtttgggtccatcagttccacatacatagtttcatcacacttttcttctcaagtttctagacctcttagtcacattgccagagtggtaattctggtttttatcttatgacatgacatttttttcctcctttgaagaccctgatcttggtgtggttattcttcaaatttttctttcaaaccttgtccattttggtgctttctttggttcttttgattacccacttaatcatcctggattttcctattcttgtaacctgtataatgtcccatgatgatcaatcttttttttttttttcccttaaaattttttttacagttacagagggtctcactttgtcaggccggagtacagtggtgcactcatggctcactgcagtctcaacctactgggctaaagtgattctctcacctcagccttctgaatagctgggattacaagcacatgccaccatactcagctaatttttttgtttttacttttggtagaagggtgtctcgctatgttgcccaggctggtcttgaacttcttgcctcaagtaatcctcctgccttggcctcccaaagtgttgagattatggacatgagccaccacatcctgctaaatcaatcatttttctgatgtttttacctaatatgctgaatcatgcagatttgcaggtgcttggcaatcattcaatcaattctatgttcctcttttgtcaaaattttcacaaattttagctgtcccttcttcctctcctttcttttacagctcaactccttaccccattgtggttcttaggagatgatctgagaattttgaatttt

SEQ ID NO: 37443 - DNA, 1046 bp, Homo sapiens
tagcatattggattaaaaaagaagtggatatggtccttcgatagaatgtgaagtgtttttttaaaaatcagccaagaactatgcctgtctttttttcacacctgtgattctttcagcaagttagaaggatagcaagagaatgtgcatccttccccaaaccccgaagacaggcagctttggcttaaatatgcttatttattttcaaaattagaaaataaacacattaatgtaaatatgttgagacagacaaagaaatttgtctgctacttaataaacacgcgatttatactttttgtcttctaattaattgtcgaccctgaataaggtggtacaactaaggcatattatggaaaactggcattattgcttaatgtaacatgagggattggaatttctttaaagtaattttaagatatgattatttagcagaaatattcactggagcattttacttttagaaattatcgtcacacaaggaagcctttataggaccgactacctaattgcagtcaaagatctcttgaatgaatgaacacacacacacagaagaacacacattttaagaatatagtggtcctatatttttaaaaatttttgccacattttttatatctgaacagaacgtatgtgtctaagcagatgttttaagttatatccttcatgtaggtgagtctgtaaatgtaccatttaacttaaatggctttgtgggaaggtagtttgaggagtttaaaaaggaaaaaaaaaaaaaaaaaaaactccagttactacagtttcagctctttctttttaaaaaacagtaattacactcaggataaagaaagaaaaataaactcttttaattctttgtaacatccacagtttttcaggtagagttctggtatatttttattcctgaatatgcagggcaggtactggcagcagagctacaaaatgaaaacttcctggctgcagaccagatactgtgcacagtgccacatcataaacttcccctcttctgtctcggagtgatttcagccctaactaatgtcctttatttccccctacat

SEQ ID NO: 37444 - DNA, 1051 bp, Homo sapiens
agtatacctttgtgcatttccttccctcaccaaagtgccggcttgacagagggcttcttaattggtgtggacaaaaagtaatatccctgccatagtagtctacacatttcacaattcacgttcgatttcagcatatggattgctgttcaggtcaagtcaaatacatagctgtttaaaagcaagcaaggttaagtcacttaaattgccttctctttggacttggaatgaaagttaccaaactcgatgataaagtttgtcacaaaggaagtatatatagatgtggcacattgtttattttattattaaatattgtggaagtatttaaatttaatgctaatgttaccttccttccctgaacatggctattgctttttaaaggaaattttatatctgaatcacttctgactattctaagtccagtagttatcattctttggggagagcctttttttgtcacattttaggaatgcgtgtcttttgtataaaatactttatatgtaaatgctgacagtagactaagtagaattgggctctctgccagttccttaaccggtcctcagtggagaattgctttgacacaaagtgcgttttactattgtgaatctgaaactaactctaatagtaactgtcttatgaaatgcttggggactgcatataatttctaagtgctataaaggaaactccagccacctcattataccagtccaaaaaaaaaaaaagcgactagcctactttcactggcaccttgcaatggaattgtggttgcagagtaaagatgtttatgtggagtataataactccaatccctagagacttggtaggacatggaaatgtgaccacctgtgaaccccgtttaacctcgtattgcataccaattttagctttaaatagatcaacaatctctaatttgaaactaaaacatcttatttaattttaaaaaatgtcagttttggctagtctttaaaaacattcagcatgtaccaatatggtataagcagtatttttgtttctccatcagtttcaactaaagataatgcagttaaaaagccat

SEQ ID NO: 37445 - DNA, 1063 bp, Homo sapiens
attggtaccatttcttctttgaacatctgatagaattcagctatgaatccatccggtcctggactttttttgttggcaattttattattactgtttcaatcttgctacttgttactggtctgttcaaagttgctgtttcttcttggtttaatctacgatggttgggtatttccaaaaatttatccttcttctctaggttttccagtctgtgtagataaaggtgttcatagtagccttaaatgatgttttgtatttctgtggtattggttgtaatattagtatatcctgttccatttttaattgagcttatttggatcttctctcttcttttcttggttaatctcactaaaagtatacaaattttgtttatctttacaaaaaaccaaatttttgttttatttatcttttgtgttttttttgtttcaattttatttagttctgatctgatcttggttatttcttttcttctgctgggtttggatttggtttgtccttgtttctctagttccatggggtgtgatctcggactgtctatgctctttcagactttttgatgtaggcattaaatgcttaactttccttttagcattgcttttgcagtatcccagaagttttgataggttgtgtcactattggtattcagttcaaagaatttttaaatttccattgtgatgtccttgtggagccaaaaagcattcaggagcagattatttaatttccatgtatttctatagttttcagcgttctttttggagttaatttccaatttcattccattgtggtctgagagagtacttaatattttttattaagtactcttatttttatttttattttcttaaattttttataatttttattttcttaaatttattgagacatattttgtggccaattatacgatctattttggagaatgttccatgcactgatgaaaagaatgtatatcctgcagttgttgggtagaatgttctgtaaatcagtccatttgttctaaggtatggtttaagtccattgtttctttgttgactttctgccttcgagacctgtctagtgctgttag

SEQ ID NO: 37446 - DNA, 1027 bp, Homo sapiens
gtagaataaagattataaagagggttgtttaaagaaccttgaaatgtcaagcatttaaaatgttttagcaagtatgtacaaatatgactgtgattgacttttttggtaacattatcttttccccagttaatattatagaatactaatttgtaatgtttatcacattatatgtatttttgcatccaagaagttacatttaataaacatgttccacttcctaacaaagaagtaaaagcaaaaagccatgtcttaatgtaataattttgcataatgtaaaattttttaaatacttagtgtaaaatggtagtcgtggattctgaaaaaataaaatgtttatatttctgactatttcattttctttcttaccacagtaaaccaagaggagttcattgctattatgactggtgacatttaaagaattacaaggataaacactaagaatgttgcagttaccatcttatattctatttttgtgcctggagccatgtgaaaaaaaccaacttagttcttttatcctaaaggaccaaaaataagcatcttatatatctgtattttactactgttaagtttctttgtatgaactgtgttgttagtactcagatagtttagctttgtatttataatagagcttttatataaagttttaaaaattgaatgtgtgatatgtgttctttgaaggttttttaatttaacatttatagtcactttttagtgcacacattttccagactttcgttaataaaatatttattttattagaattttaaagtttggtaaatttgtttttattcctagtatctgttaaccctcaagagtggatttcttaaatcttccctttataattttactagtttctgaaacaaaaattgaaatacaattagcaatagagtggcacatttttccattacctaacatttcatcaattttgacattctatattttaatacaagctgactcaatataagcctaattccttttttaagagtcctgtctttgagtttagaaggaataagtattgtgcagatag

SEQ ID NO: 37447 - DNA, 2139 bp, Homo sapiens
atgcctggctaatttttgtatttttagtagagatggggtttcacctgttggccacactggtcttgaactcctgacctcaggtgatctacctgcctcggcctcccaaagtgctgggattacaggcatgagccaccacgtctggctgacttcaattacatttttgctgatagtccataaatctgtgtctctagccgagatcgttcttgagtttcagacatatatctacaactctgtcctgaacatcttccacttctgtatctcaagcagctccaagtcagcatatctaaaatctgcatttagcctctttttaccctccacagtgttccatttctcaatgaatgccatcgtccatcaagttgaccaaaccagaaatctaagcttcatactagacccactttatctctctgacatgaatcaggtgatacatgattaggttttaaagtattgatggaaatgaatgggactaatagatggtgggagagcctggcataccaattggtaatctgccagacactcccctcttcccccaacacagtggaataggatatacagacaggttatctcacagtggatgggataatacaaacaggttgaggaatgtataatatatagagaaaaagcttataaaagtgattaatcttgaaagtagttgaataatgcatttacactgagaagtttgggagggaaatggcttcagaaataagggggataaattaccaattttttaaattctaaggtatatatgcttttccacacattttagcatctttttttggaatggtggcatcttcaatttttggtgaagttttttttttccctagatatacataaaataatactgcatcttagagttatggcatcttagttttgataaaatatggtagttttagttgggtagcatttgtctatattccagtttccaaactggaataaagaacataactacccataatccttccttcacaaattgtttacaagcagaaggactgtggtatttatgcatgatgcacaaagggaagcagcaaaggattctagaatctacttaaatagcattaattagtgttactaacatatatgggtgatagtaaaaagtagttggtgatttcctaagattggtacatctaaagtggtgtagaattctcatctacaaataaaattaaaatttctctgggtgcaacttaatactactaataattcaactttttttttcctccaaaagtaactagaatgaatgactattgctgcctttattttgattggaattcagttgtatgttgcttttttttcccccccacaggtagcagatatcaagagagttaacaatctcatcagtgatcaagacttttttgcccttaggtctatcaaaattccagtaaaaaagttcagttccttgaccgaaacactttgtcctccaaaaggaagacagacttcacgtcattcatctgttcaatactcttccgaacaacaggaaattttgccagctaatgattctcttgcttacagtgactcagctggtagctttttaaaagaagtagaccgagacatagaacaaatagtaaagtgtacagacaataagagagagaacctcaatgaggtagtatcggccttaacagcacaacaaatgcgttttgaacctgataacaaaaacactcaacgtaaagacccctattatggagcagactggggaatagggtggtggacagctgtagtgataatgttgatagtaggtataataacaccagtgttttatttgttgtattatgaaattttagctaaggtggatgttagtcatcattcaacagtggactcttcacatttacattcaaaaatcacacccccatcacagcagagagaaatggaaaatggaattgtgccaactaaaggaatacatttcagccaacaagatgatcataaactgtatagtcaagattctcagtcacctgctgctcaacaggaaacatagcaattagctcataatcaaatgttagtggtcacatgtgcatctggaatgtggtgaatcagttatatccaataatagcttcaaaggcagaatttagagagattgaggatgcttttgtttttaacaaaagggtttcacactttgaaaattttttgagcaactagttgttgatgttgaga

SEQ ID NO: 37448 - DNA, 1029 bp, Homo sapiens
tttgggaggctgaagtgggcagatcacctgaggtcaagagttcgagaccagcctggccaacatggtgaaaccctgtctctactaaaaatacaaaaattagctgggcgtagtggtgggcgcctgtaatcccagctactcgggagactgaaacaggagaatcacttaaacctgggaggcaaaggttgcagtgagctgagatcgcactactgcactccagcctgggtgacagagtgagactccatctcaaaacaaaacaaaacaaaacaaaaaaacgaacttaaacctaaatgtttaaataactaaaaccattaaaacaaaaacaaaagattgtgtcctgaatgtacgatgcatgcaaatcagtcagttggatcagctacattccaaaattttctctgctttttttttcctccagattttaacattatggcagggaggcatcagaatcgtagttttcctcttccaggagttcagtcaagtggtcaagtacatgcatttggaaattgttcagacagtgatattttggaggaggatgctgaagtgtatgaacttcgatccagaggaaaagagaaagtccgaagaagtacatcaagagatagacttgacgacattatagtattaacaaaagatatacaagaaggagatacattaaatgcaatagcccttcagtactgttgtacggtaagttttaatattacataatgcaattcagaagaaattatttgtttacgcacactgaaataaattctgtgtccttttttaccttgtttattcctttctccattttttgctcttattttttgcatagaaatctgtgtcacatgggctgggcgcggtggctcacgcctgtaatcccagcactttgggaggccgaggcgggtggatcacgaggtcaggagcttgagaccatcctagctaacacagtgaaaccccgtctctactaaaaatacaaaaaaattagccgggcgtgttggcaggcgcctgtagtcccagctactctggaggctgaggcaggagaatggcatgaacctg

SEQ ID NO: 37449 - DNA, 1033 bp, Homo sapiens
ctgtagtgaacatggtaatgtttttgtttttgtgaacttgtgctgctatttctgtaagatagattcctagaagtagtactgctaggtatttgattaataataatgaggaactcataggttgggaaggattctgagagtgctcagtttatccaacacacccaggaaggtttttttcttgctatgacattgaatagtccagagagtgaaactccatattctttttcagtaatgctttcagtgacttgaaatcaaaattgattataaaagaaatggtagcaattatgatgctgtggccaagagagttggaagtgaaagtgaaaggctgaatcctaacataatactgtggtgagcctggtggacaaaccagtcaggtaacacagataaggggtcagcaaattatgggagcctcagatatttggatgaatttacattcatatagtagggaggtttttatttatttatttatttatttatttatttatttttatgagacggcgtctcgctcttttgccaggctggactgcagcggtgcaatcttggcttactgcaacttctgcctcctgggttcaagcgattctctgcctcagcctcccaagtagctgagactacaggcgcatgccaccacacccagctaatttttgtatttttagtagaggcggggtttcaccatgttgtccaggatggtttcaatctcctgaccttgtgatctgcccaccttggcctcccaaagtgctgggattacaggtgggaagtttattcttttatactttatggagaatagctatgagagattagttcactctgggtgtccaaaactgcaaacctcaagctggtcctcggcaagctggccccctttaggcctcggctgtcagtcaccaggaagtaggtgacctattgagagtctggccagactttaagggacctgaaatctgcttctgccacctattccacagtgcatcaggcctaaagaatagttggctatcctttacctggattgctttgcttgtgtcccaaggctgtttcccttgcagag

SEQ ID NO: 37450 - DNA, 1076 bp, Homo sapiens
gttccccgtcaggcagcgttgcaaagcaatcaatcttgctctcactctcacttggcggaagtgccacgacacgaagagtgcagtgcttcgctcttgccatgaagcctgggtgacaaaagtttttacaagaagctgactgtatttggggttatgaatatgcaataactctcattagtattgaagcaccagagcaggggctgacatcccccgccactttgagttgctgcagaatcgactaatgaattgtctcactccctcactcacacagtctgctattgtggctcctaagttccaaggggagttgcccattttgagaagaccattgactgcaaaaattaattgtcgaggactactcttgatttcatgaaacaatgtttagacagtgcttagattgtcaaaacagaaaagcactaaactctgcataagataataacatgaatagaaaaatttagagacacaagaaggtatatattatgtacttatattcatcattgtgtacagatatgcttccatcctggatcattgtacaatatgtgtaactgtatatagatgaaaccaagtcacagaaacctgacattctgttggtttgtctattatccttccaaatggaacagagatgatagaaaattcccagaatgaatagggttgaaacacaaagatattccatcaattctttaccatattctttcttttgtattcttgggtctctgccaaacattttgcagctcatacacataccatctttcatgaatatgttactgataaggatatgtttatagccactgattaagatatctgagctgatttgcagtgtgtaagaagatgcaaaagagctcagaaaccatttagaatgtcccctttcaatagaataaattaaatgtgtttttccacatccctcctcccttgaaatttcctttcaactagaagagcacttctgtgacttgctgcagattgtcacaggatggattgaattgaaattgataatatatgctaaaaggtaagggatattttgtaagctgtgcaaatatggcagtgaacaaagagttaaactcttatattaggatgcttgcttctgt

SEQ ID NO: 37451 - DNA, 1050 bp, Homo sapiens
ttttttcttgtaaagttgtttaagttctttgtagattctggatattagccctttgacaggtgagtagattgcaaaaattttctcccattctgtaggttgcatgttcactctgatgataatttcttttgctgtgcagaaactctttagtttaattagatcccatttttctattttggcttttgcagcaaagctgcaaggtgtcaggagaattcttaggcaggtatgcagtagcatttattaatataaataccactgtaggaatgggagatggttattcaggaacagcttgcgctagatgatactactgaaggtctgttttacctttggaagagtactgcagaaccatgatggaataggtgacttttcctagcaatttctcattgatttgttctttcaaaggccaacatcagtgatgttgagtggaagtaaatgttggccaattcagtaaatattgttttgtgggcttatgtatcaggtgctgctagatgtttttgcaaatgttaggctgcatgaatatttgtttccgttttcaggagaaaaaaacctgaagctcagaggccctattgggccatagctacttcaagtacttgattagttatctgaatattcctactaaaataggttctttgcctgaattcttaggtaattgcaacattgtagatatggttcttaatcatatttaatcatgtgctgttaatcacatgattttaaaatacttaaaaaactcttaatcaaatttaatcatgtgctgttaaatttctaagactatattagaagggtaattgaaaacatctattttaaaacacattttctaattttctagtaaataaagggctttgtggttgtattagtccgttttcatgctgctgataaagacatacccaagactgggcaatttagaaaagaaagacatttaatggactcacagttaatcatggctgaaggtaaaaggcacatctcacatggcagcagacaggaaaagagagcttgtgcagtgaaactcccctttttaaaaccatcagatctcttgagacttattcagtatcatga

SEQ ID NO: 37452 - DNA, 1112 bp, Homo sapiens
ctacaaaaatcttactggagttttagggaagatgataataagacaaacatactttatgagaagtatatataaaacaataatgtgaattgattgataagattgcattttatcagtgagagattcaggaaaatatctttattcttcaataaaaactatataatagtttgtattaactgtgtaattgagtgaatctgctgttagatttatttttgagtctggttaataggtgccattctagtaaatttattgttgactagtgcattgcatggtggaagaagaaatgtaatattccaaatgaaatagtgatatttcttttctgataatataaaagactcagattattctgtcctagtttctaaactcacagaaatacactgctagtttaatatttggtgttgccactatgtattttaaatacctctaactttacattactgtttgtggtacaatgaaaagatgaagagtcagaacatctgggttacggtcttggattttctgcttattagttttgtatctctgacagttcacttaacttttttggccattaatgttctcgtttgtaaaatagggctaacagtattatacttacttatataacttatagggttgttgtgtagcttaaatgagaatttatgtggaagtgccttgtaaattataaagtactgtttaatataccatctaaaatactttctttagaatgggaagggatataaagaaaaacagtacaaatgtaagttatttattattatttctttttacattaatatgagagatatcaaccatactctttattagaaagggtgagaacacttcagaaaggtcaactgttttgtctgttgtcagaggattagagagaagtttaatatgggccatagatttcaggtcatgtttgtccttatatttaaaattcccttcaggttagagtcttgtaatcttaccttttgaccttgtttacttcctttgaaaacactctgtaagtgtgtttgtgtggagtatatataaaatgcacatacacattttgtctggatgttgaaaaatactgcagtaggcataacaagaagtagttccttttgaggagaagacttcattcattcattttttgcgcagttatt

SEQ ID NO: 37453 - DNA, 1074 bp, Homo sapiens
ctgtatgaatttcaggatttttttttctatttccatgaaaaatgtcattggtattttgacaggtattgcattaaacctgcagatcactttgggtagtatgacagttttaacaatattcttccagtctatgaacatgggatatctttccatttatttgtgtcctcttcaatttctttcatcagtgctttatagtttgcagtgtagggatctttcacttccttggttaaggttattcctaggtatcttactttttggtagctattggaaatggaattgttttctatgtttttttcacatagttcactattagcatatagaaattatgctgatttttgtatgtggattttgtatcctgcaactttactgaattcatttattctaacaatttttttggtggagtctttagggttttctatatataagatcatgtcatatgcaaacagttttacttcctcctttccagtttgcatgtcttttatttctttctcttgtctaattgctctacttagaactttcagtattatgttgaatagaagtggtgaaagtaggcatccttgtcttcttcctgatcttttgcatgatgttagccataggtttgtcatatgtggcctttattgtgtttaagtgtcttgtatatttaatatgttgagagtttttatcatggagagaagttgaattttgtcaaatgcttttctgcatctattgaaaagattttatagtttttgtctgtctttctgttaatgtggtatatcacatttactgttttgcatctctacgatgaatcccacctgatcagaatgaatgatctttttaatgtgctgttgaatttagtttgcttgtgtctttttgagaatttttgcgtctatgcttatgagggatattgggctatagttttctttttttgttgtgttctcagtatctttttatttcttgcttcttacagacttattctgttgtatacatcaacatgttaacactgttttaaagtttcatgttgtcatgtatatgctgattgtttaaaatttttccgtttattgtagaaggaaatctctaaggacttctgtttctatttta

SEQ ID NO: 37454 - DNA, 1019 bp, Homo sapiens
tgatatcattgatgttattagattagacgtacctacagaataactctttttttttttttttttttttgagatggaatctcgctatgtcaccaggctggagtgcagtggcgcaacctcggctcagcgcaacatccgcctcccgggttcaagtgattctcctacctcagcctcctgagtagctgggattacaggtgcaccaccacgcccagctaatttttgtatttttagtagagatggggttgcatcatgttggccaggatggtctcgatctcttgactttgtgatctgcccacctcggcctcccaaagtgctgggattacaggcgtgagccactgcacccggccgaataactcatttttttgcatggctattacaaattactaacaattactctaattttatatttaagattaagactttaagattaggatttcatataatttattaagattattggaaattcttcagagtatgctgcctggggactcaaaaataatagcaggctgtgtaaagtcaactattttgagatgtctgtttcttctccaagattaaattatataatgtgccaacccatataattatatattctatggcataatagaatccatgctagtttttataataatttagcgttaatgaaagtttctgtcttctaatgattatgcaacttttgacaaatgactgtaatgcaccatttgcctttttgtcttggctgcctgtgagctcattgtgaaaattagttttcacttttattaatttcctgatctatggttcctcatataatcatgttctatatttgttcatttaattactgagttcccacttatctttagttttaaattaactttgtataaaaatattttattttattttttgagctagagtctcaaatattttcatttcttaggtcctgttaagtacttagtccctcctttcccatttctcttttcttgctttgcaggaatctaatgaccattgaactgtggccatgacttcaattacaagtattttcttcacta

SEQ ID NO: 37455 - DNA, 1030 bp, Homo sapiens
ccttctgcttgaaaattatgaagagtaaatcaaaggaggagcccatttgttatcatatttaaagttcaatttactttaaagctgtgtagttctgtgtcatgcagtgctgatgaaaaagcttataatggccaatattgtcagaatggcacattcttacatggctcagtagtttacactttgaaaaacactcatttatcacattacccctttagtaatatgtcaggctataagttgattttatattttgtctatttactgagattttattaattagaggttaaatgttctttgactattgtattataatatagttttaactgaggaattacaatgaagatactaaaaggaagcttaaggtttctggtattaactaggttctgttaaatgattttacttgttttagaatatatagaaatatactgagttagaatgagtggcgtattttctaaataattcaaataaaatggggagagagaggaggagattggaaggaatgaaattttcctgttcaagctgtaaacactaaaacctttaattttgtaggaagacattatatactctggtcattcaacttgtgtatccttagtctatttagtagtcaaaaacttctaagtaaatatgtgtgatttaatttgtgctgctgagaaacagtgatcaaaaatggcaataaaagtcacataacgaaataagaatactaaaaaaaaaaaaacctaagaattttactgtgtcccattcttcattcaatttctggcagccttcatgattacaaatcacttgattaactaactagacattatcaaagtgaattatgaatcaggttcatttttcctggttgatagttgacacatgctgtaactttcactttgtgatatatcaaattcttgtaacagtaataagagatataatcagctctttatttcaggaaaactacattgccttttaaaaaaatgaaatgcacttgctaacattttaacaacacaatgtaattcctgccttcggatttcagggtggaatccacagtgatgatgtt

SEQ ID NO: 37456 - DNA, 1086 bp, Homo sapiens
tctcaaaccggtcatttaaagcacgtgttttgaaaaagagagataagggaagcacttctccttttggcctaggcccccagttagagggcccaggagaagcagcaggaggaaggacggcaggagagcaagcactgacctttggatgcaaatcgagcctttttagaggaggaaaagtgacaatcattcttagcacaccagtgaagctagagccaaatatttactttttataaaaatcaagtcttagctatctaaatgcatttatgcaaaaagaaaaaaggaaataattgaagacttttatgttataaaatttatttattttaaatacccagcttgagtgaagaataaaaccgcatggctattctttccagggaaaatggattaggtttggatgaaagttgaagttttgaaatgagtctgaaggttgttggagtaccctgagaatacaatcaactgctctacataatcatttcccttaatagttacctgtcagagcacctatttcttctactacaggattagcccatcagaagtagatctgagttggatatttcactgactaaagactgctctaatatgtttcagtgtttaatgtcactttctttactgcctatgagataaactagtggaaaagtattggctcaaaaagccagcaggtctgctggtgttaccagtcatgttgcaattgtatttacctatcagaacgttgatctaaataataaacctaacatttccttctaaactgtcagtggaaagatatatttattacaatgtcctccatcgttgaggagagaggaggtttagctaaagtttaaatgaaaaaaaaaaaaaagcacaagcataggacaccactgatataagcaatagaacagtaaacaattatgccctttgttatgctatatatattttatttacccatttcaaaggtggaaaataaacctagcccatctttggggggagttaataaagtattctgaatgcatgatctaacaaaactcggggatcgttctatgttttattgttacccccctgcataaagtcttctgaagctgaaaagagaaaggaaagggcttttgtgttagttgatcc

SEQ ID NO: 37457 - DNA, 1027 bp, Homo sapiens
gaaaggaaacccctgcagaaatttaatggaaacatacatttaatactttatattctgttttttctggtatactggtgacctctcagtaaagaaatgttttctatttgagtctgttcttttgttggaccatccatatgttcaaatcttattccccattgatcaacagtggataattgtgaactttctgggaccctttaagggttcagtctgcagttggggtgtgtgtgtgtgtaaaatattaatatatgacatatatttatccgtattaaaacttttgattgcaccaaaatggcttctaaaattccacactggtataccaatgtggtatattattttcccattttctgtgctaacacgagcagtaaatgcaatagatctcattactttcagaaagaagtaagcaatcacactgtcttacactgaaaccaccaactggcttatattctagtagccctatgctgtagataagagcctgggatctggactcagctacttcaacgagtatttattgggagcctcttatgtgtggcactgtcacaggaaataggaataaagggtccacaaaacaaacttcctgccttcatggcacttatattcttacttactaagcactatggccttcgctgtatgatctctacagatctcagtttcttcatcagcaaaatgaggataatactacctgttttgaaagattattttcagggtacatgaattagtgtatgaaggggcacagtgccataccaggaatatagtaaatacttaattttaactttcccttttgtttattaatgatgataatacttattagaaatacatattaaaacttaaaatcgatttgcttaaaattgaattttaaaaagtcttaggctaggtgtggtggctctcgcctgtaatcccagcactttgggaggccgaggcgggtggatcacctgagatcaggagtttgagaccagcctgaccaatgtggagaaaccctgtctctactaaaaatacaaaattagccaggcatgatggtacatgcctgtaa

SEQ ID NO: 37458 - DNA, 1035 bp, Homo sapiens
tggaagattcgatggacatggacatgagccccctgaggccccagaactatcttttcggttgtgaactaaaggccgacaaagatgatcactttaaggtggataatgatgaaaatgagcgccagttatccttaagaacggccagtttagggctggtgcaaaggatgaactgcacattgttgaagcagaggccatgaattacgaaggcagtccaattaaagtaacactggcaactttgaaaatgtctgtacagccaacagtttcccttgggggctttgaaataacaccaccagtggtcttaaggttgaagtgtggttcagggccagtgcatattagtggacagcacttagtagctgtggaggaagatgcagagtcagaagatgaagaggaggaggatgtgaaactctgaagtatatctggaaagcggtctgcccctggaggtggtagcaaggttccacagaaaaaagtaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcaacaccaagatcaaaaggacaagaatccttcaaaaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactaaccaagaggctattcaagatctctggcagtggaggaagtctctttaagaaaatagtttaaacaatttgttaaaaattttccgtcttatttcatttctgttaacagttgatatctggctgtcctttttataatgcagagtgagaactttctctaccgtgtttgataaatgttgtccaggttctattgccaagaatgtgttgtc

SEQ ID NO: 37459 - DNA, 1020 bp, Homo sapiens
tcgtttaaaatgtatacctgaatctaacttttctctaatattctatgtctccccatcagttaagctgttaggatattctgttttgatggatttgccttagggatgatttatgagacaggaagcttcaatgttatctaacattaggtacatcatacctgaaaataaccaagttgtacagtaaagatatatgcatgtaagtagtgtaaaaattcatacaatatttgctaaatcattcaatggctttctgctaagaatattattagaaaagtatccatggtcttaaaaatgataggattctaattcccaagcctgctgtttccatataattgtatataaatatacaattattcttccgtttatgtctttctaagaatttcacctggaatttgtgttacttattattgtcaaaaaatgttatttcctcaccagatagaatttgtgcaatcccagttagaatctccaggtgtctaactagtcaaggagcaggacagagcaaatacatagttctgcaaggctccgtagcccactcctacagccacatggacctctgggcctctgttctgatctcatctagatttttcatctagtatactagtgccgtttctacctagaatggctgtcatctgacaactttttagtagtttagaattcacgtaacttgaaacttggtacagaacatccctgttgtctttactggcagtcgcagcagaaaccaggctgttgtctaactgtgaaggtagtgtctgagcacaagcctgaagctccaggggaggacagatttttacatttatttgtggactctggacatttggcaaaatccattgcactcaatagacagcagtcaaattaacagggagattgttctccacttatcgaaactgtcaaaaaactgagggaaggggggattccaaagagctgctcctagtgcattctttttatattaatggttagtgaataccagtgtcagaagttcacatcacagtacgaataagatgattggattttaatttttagacaaaa

SEQ ID NO: 37460 - DNA, 1046 bp, Homo sapiens
catgagcatgggatgtgttttcattggtttctgtcacgtatgatttctttcagcggtgttttgaagtttttcttgtagaggtcttctgactccttggttaggtatattcctaagtggttttgttttgttttttgcagctattttaaaaggggttgagttcttgatttgattctccgcttggtcgctgttggtgtatagaagagctaccgatttgtgtacattaatcttttatccagaaactttgctgaattctttcatcagttctaggagctttctggagaacttttcagggttttcaaggtaaacactcgtattgttagcaaacagtgacagtttgacttcctctttaccgatttggatgtcctttatttctttctcttatctgattgctctggctggaacttccagtgtatgttgaagaggagtcatgagagtggacatccttgtcttgttccagttctctatgggaatgctttccacttttctccattcagtattatgttggctgtgggtgtgtcatatatggcttttattacattaaggtatgtcccttgtatgccaattttgctgagagttttaatcataaagttttgctggattttgtcaaatgctatttctgcatctattgagatgatcatgtgatttttgtttttaattctgtttatgtggtgtatcacatttattgacttgcatatgttaaaccatccctgcattcctggcatgaaacccacgtgatcatggtggattctctttttgatatgttattggattggttagctagtattttgttaaagattttagcatctgtgttcgtcaagaatattggtctgtagttttcttttttggttatgtccttttcctggttttggtattggggtgatgctggcttcatagaatgaattagggagggttccttctttctctatcttatggaatagtgtcaaaaggattggtacaaattcttctttgaatgtctgttagaattctgctgtaagtctgtctggtcctggactttctttactggtaattttttattaccatttcaa

SEQ ID NO: 37461 - DNA, 1035 bp, Homo sapiens
actgttttttaatttttgtatcatggccgttcttgcaggagtaaggtgataccacattgtggttttgatttgcatttccctgataattagtgatattgagcattttctcatatgtttgttggccatttgtatatcttcttttgagaattgtctattcatatccttagcccccttgttgatgggattttttctttattatactttaagttttaaggtacatgtgcacaacgtgcaggttagttacatgtgtatacatgtgccatgttggtgtgctgcacccagtaactcgtcatttaacattagatatatctccaaatgctatccctcccccctccccccaacccacaacaggccccggtgtgtgatgttccccttcctgtgtccatgtgttctcattgttcaatgcccacctatgagtgagaacatgcggtgtttggttttttgtccttgcgagagtttgctgagaataatggtttccatcgtcatccatgtccctacagaggacatgaactcatcctgttttatggctgcatggtattccatggtgtatatgtgccacattttcttaatccagtctatcattgttggacatttgggttggttccaagtctttgctattgtgaatagtgctgcagtaaacatacacgtgcatgtgtctttatagcagcatgatttataatcctttgggtatatccccagtaatgagatggctgggtcaaatggtatttctagttctagatccctgaggaattgccacactgacttccacaatggttaaactagtttacagtcccaccaacagtgtaaaagtgttcctatttctccacatcctctccagcacctgttgtttcctgactttttaatgattgccattctaactggtgtaagatggtatctcattgtggttttgatttgcatttctctgatggccagtgatgatgagcattttttcatgtgtcttttggctgcataaatgtcttcttttgagaagttcctgttcatatccttcacccacttattgatggggttgtttgt

SEQ ID NO: 37462 - DNA, 1034 bp, Homo sapiens
gctctgactgtggtagtatctccttttattatacttctgattacaataaacgttcccctcaaggagtcccttttattctttttcaatctagatttcttcttttgacttctctcaaatgtcattcactctcctcccttcagacacattgatgttttgttgatatttaaccgccatcctttcatacatatatgcctaaaagaacaatatagaagctatctagcaatttatcacttcccttgtactgtacgtcttcagtaaaatttttctgaaaacacctctcttgttctcccatttctgtgccatgtctatttcacttataatcacattagataaaacctgtgtgtaattctgttttgtatattgccttttatattattaacactcagtaaaatagtttaagaattgcagtctgtagtactgtcagtctgtcacctttcaggcactactttaaaattctgaaaatgtaaatgaagtaattaacctgatatgaaacagtgatacataattgactttctaaattagtgaactactgactcttttatatatttgccattttatagaatttcatattggctacttaacaaaaggtgtgatgtaacaaaaattctgcctcctaccataataaatactgatgcttattaaacactctgtactgtgcttcctaagtatatttattttagaattttgctgtttgaattatttcatactcatgaaattgaggcaatacttaatgataatagaatagagactctgaatcattgactcaactgatggaatgtcctccaaagaagtgctaaggaatagacacatgaaagaaaatggaattttttaaagtagcctagagaataattcaccttcactcacacataaacgcttcctcagtgtaaatttttcagtgctctcatgcatcagagctgtcagatgtctaaatgacgggtttcagagttttcctcttcctgttagtgatctgaagtgctactccagtattttccattagggtggatattgatagaggaaacttgttgtatagtgga

SEQ ID NO: 37463 - DNA, 1005 bp, Homo sapiens
ggccattccactttagccattcaggccatgctgcctgtattgtgtattcagcagttcctattagatgtcttcacagtgagtgattctgtagggcttgctgacacccgcttcatgcatggcctgctgtgctgggtggaattttttttctgagctgcctgaaacattaaagacatcttggccatgtcagtctgtgtacagtgtgtgtgcatgtgccctcacatgtgcacattcctgagcaagtcagtattaaataaatgatgtgggtgtgcttttatatacatgtaaagtctaaaatttgaataatgatgaatttatcatgtattaaaacatatatttttaataatttagttcagctaacattagcaacttttctctagcttttattgtctgtggttattgacactagggggcactgcttatccttggttgcatctttcttcaggaaatgaataaaaatactcggctggtttctgtgctctcactttaattaacaattgaatttagagaactctaggctgtttgatcctttgttattttggttttatttctaatgcctatatgtagtgctaacaaagggggttggagctattggttctcacaaataaatagagtatccagtgtcccatacagtaactttttcttccattggaaatgtcattcttggcaaaaccagaagggcaagtttgcccagtgatgaggcttagatcccttgccagctgtgcttctagccagcaagtgtgatgaacagctttagaaatcaagtgagagaaagcattcaagagttagtgtgattcatttggataaaggtcaaaagaaagataagcaaaggattaagaatgaagagcacaaatagcaacaatttgtacctttttacttataaaaattactgtcagtgatcctatttgtaatttttcacatgttcgtagttcaaaagtaacttaaagtcttttaaaactatattaaagattgcatttcattctctatttcagctgatcatttaaaaat

SEQ ID NO: 37464 - DNA, 1044 bp, Homo sapiens
cctttctggaaagcagtgtgctttcaaaaaatggcaattctgagtttcaaaaaaactcagaattgccattcaacccagcaatctagtgggatttatttttatggtggaatgtattatattcctttgggtatattggatatataaatcattctactataaagacacatgtatttgtttgttcattgcagcactattcgttgcagtagcaaagacgtggaatcaatctaaatgctcatcagtggtagactgcagaaggaaaatttagcacatatacaccgtggaatactacacagccattgaaaaagaatgagatcatgtcctttgcagcaacatggatggagctggagatcactatctggagcaaactaatgcaggaacagaaaaccaaataccatatgttctcacctataagtgagagctaaacaatgagaacacgtggacacaaaaagggcctacttgagggtggagtgggaggagggagaggatttttaaacatacctattgggtactatacttattgcctaggtgactaaataatctgtacaccaaaccccacaacacacagtttacctatataacgatcctttgcatgtgtctctaaacctaaaataaaacttaaaaaaagattgagtgctgcaaatagtatcttgacacctaaaaggtagaaacaaattgatagtctcaaggtatctccagcttatagacttttttttgtctattttcattatgtttaaagttgaatcttgtgaaattgccatttttcaaggtccaaaatttctaatactggtaacttatatggttcaatttaatattttgggactgaataatgtccttcaattttgaatatgtttttagtatatgcatgttatagtgttacttttatgcatccagtatacacctagtactttaatcatcattaaatacaaatgcatacaatttgtaaaaaagcatacatttaaaatatgccaaaatgaagaaaacattttaatctaaattatttaattggataaaataaaattacatctcatgtgacaaggtaaaata

SEQ ID NO: 37465 - DNA, 1095 bp, Homo sapiens
catacaatgggaaccatagtagtagtttaatacatgttaattcataatacatgtaatatatgtacgtaatacctgtaaagtgcttgatccaaagctggtaagtagcaactacctgataaatgttagctgctataattagtataataattagtagtaacaagatatagtccctccccttaattttatattaacaattttatattttagtatatgcagtgttttcaacagatcaaaataaatataattatttttcttattttttcaaatattttaaaactttgtaaactaggatatgtttgctatacatgagaaattttttaaatagaatggtaaagttctctctgcattttgtgatggacaataaaggaaacatttggtgtgcccttattctaaaatcagaactgctgataaaatatactggtttgttattttactaaaatatattacgtttttcagttgaattgtttatatgttaagaaatctagctttgctagacttcagtggaggaaggaactgcagatgaggtggaaacagcaagagaactagaattagaaatggagcctcaagatgtgactgaattgctgcaatctcatgatcaaacttgaatgaatgaggagttgcctcttacagatgagcagagaaagtggttgtataagatagaaactacccctgctgaagatgctgtgaacactgttgaaatgacaacaaaggattacaaatattacgtaaacttaattgatacaaggacaggttttagaggattgactctagctttgaaagaagttctactgtgggtaaaatgcgatcaaacaatggttcatactacagagaaatctttcatggaagggtgagtcaataaatgaggcaaatatcgttgtcttatttcaagaaatttcttccatcacttcaactttcagcaaccacctccctgatcagtcagcagccatcaacattgaggcaagacccttcactgacaaaaagattgtagttcagtgaaggttcagatgatcgttagcagtttttagcaataaagtatttttaaattaaacatgtttttgaagtaatattataatattaataagtatattttcaaga

SEQ ID NO: 37466 - DNA, 1060 bp, Homo sapiens
aatgattagcagttttcattaaaaaccattatttctgtttagattttttacattttcttaattgcttgtgatactattgacatttgttaggtagatcctcttacagtgtctggcacatagtgggtacaccaaatattagttaaatgacagggtgatcgatacattttttgttttgacaaatatggcaagctgatattcttatgggcaaaccaatacagtggaatctagtgactagagaaaataaatacttttttaagactctaaaaaactaaaacaaaaaattttaaaattttaaagaaaatatttaaaaatatatttatgaagatatgtgtcatatttctttcaatggataattttaagtgatattaaattatgtcaatagtttgaatagcaatagcaaccattgagctaaaattatgcaacaaatagttgcttgttaacctaagatatttcaacatttttgaaagattagtaataaaacatgccatatttaaaaagccttaatgtgaatcttctctccactgtagttcaggggacactcaggatgctagagtaatgctataaaaaaagccactcagacaggtgcagtggctcacacatgtaatcccacctactcagaagactgaggccggaggatcacttgaagccaggagctcaagaacagcctgggcaaaatagcaataccctcctctctaaatatatataaatatatatatatagataattagttgggcatggtaatgtgccggtagccccagctactcgggaggctgaggtggaaagatggcccaggaatttgaggctacagtaaactatctcactgcactccagcctgagcgacagaatgagactccatcttttaaaaaaaaaggcactgaaatgaccccatcaaatccaaccagctatgccaggctctatttccatcctatttctgaggagtttttgtccttgctgggtttcctttggcttcatacccagattctgcttgccctatataacatggatggtctgtctgtcctttgttcagtacctgctcaagatgccacttgcccagagctag

SEQ ID NO: 37467 - DNA, 1864 bp, Homo sapiens
atatattttcatctgaatatataaaagtagaatatcctattttccttttgagctatgtcattatactgctaaaattatggatgaaaatggaaatgtttcaacctgacccattgcaatttctgtgttacacatttgctcttaagagtacagccaggctgctggggttactctaccctgtacaaactttgtgctttatggaatctgtaacttcaatttctgttctttcctgaatccaaaattctatccacttacaacccacgttataagtgcctagctgaaatgccacctcttcctctcactataaccgatgacccctccttactgagactcatggaatgtataatgattagctaatttacatggaatttaccaggtactgtcttgatatgtctcttgtatttttgtctaataatttaattaatattaccaattattttcatgcctctccactagatctccccataatcctttagatctttgagcgtgctttatatgttttggcattgcatgtcaatccttaaaagcagatatgtgctgctttttgcattagtacagagcatattatgagggagtcaggaactgatactagaatttaatcccttggatggagaacaaaacaacaagattaggcctaagtgatacctagataaaggaacctgcagcataggaatgaaggttattctgttatcaaactggagcataagaggacaactaaatcaaggaaggtcagttaatagaattttagagactatgtgtagagtataggcaaaagtgacttgatgctgatctgtctaatgttgggttggaagtgcttgaacatctctttcctaaagtgagacttatttgtagactctactgatgggaagtaaaggagaagaattagacccagcctctgaaagaaagcaaaaacagatgctaaggatagaggggaagagaattacatggacacaaaacgaaaagtccaaatgttaaagaaacatttacagaatagaaatcttagcaaagcctggaattgcacatagagatgcttaaatatttatcaattatttgttgacatccgtcaaaaatcttattctttaatatgtaagatagttggtgttgcctagttttctgattgatttttttcagcattcatgtgaatttttgcaatagtttagaaacagccaactctgataaactaaagctttctttccaaaaatatgtttttgatgttctgactggggtatgttcacagttctgaatctcttctgtgcaaatgccattgaagtcatttctatctagtattttagcaaccaagttcaatttatttgtattacaaacaatgattgtttaatttctgaaactattttattttccaagtatattcaagtatttggattttcttttctctagtatcttgtaaatagccagtctcctttcaaatttttgcaagtatctagtatacacaggcaaaagtaaatttgggcctaaaactttaagattagcaaagtataattttattttacttgctgagtataaatagatatgactggtagattatgtagcacttttctgagacattaggagcagagcatgagagatcaaagaacttactatttcatgtggcaagttttcttaactatgaaatagtgtacttgctagcatatattatggtttattaaggggattgatttggtctaggcaatacacatcatgtcagacttgcctggcaggaaaacctgcttaatatgttttgtaataagatggaattttttgttctcaaaaacatctgccaacagaattcaagagtgaaaacagaaaatgtcatcaatttagtggtaatcctataaatttagtttctttttgagcaagacataccaagaca

SEQ ID NO: 37468 - DNA, 1066 bp, Homo sapiens
actagattacctaactcttacgatctaatttaaagtagattacttaactcttacgatctaaaagctggggaaaactttttaaaaataagtctgttatgatgtgttcatatagatctctttgcctgtgcttagataaaaaaggagccacataacttgtgtttatatcagttgtgtttcatttgtaataagcattgtgctttgcagagaagtgctttacacaaaacagtataagattcaatatcttgttatttggaaaatttttaggctaccatattttaaggaaggtgagagtaagtagtaggaataaacatctaaatctcatttatatttgcctatggatgaatttgaatttaaagttaacattggtccgttagacattcagggtactcataacaaatacttcaatcaaactaatgaaatctcagtgtgaaaatcgaactctaaaactgcctcggttctttctcaattcttttatttttcccatttcatattttggatgaatagcattgcaatgagattggtacaaaagaccaacctcagcagttcttcctgagttgtagagaagtaatcaaagatgttagcttacaaaagttatcctagtttctaatcctaagtggatatataaccttaactttccataacttccagttcctgctggactaaaagttgtattccaaatatgaaaaaaaaaaaggaattggtaatgttgattttagaattgaaactgaagctgagctacgatgtctacagacagaaaattaatgatttttatagataagcccttatttggatatttgataattggatatcagtaatctgtctccctcttctcttctttttttcttcccttttctctccctctcccctcctcttttttacatgtatatactcataaattagcaagtcataatactagggtatcaaattactgcagtttgtcaattctctaataagatgcacattttcttaatattttaacacctcaaattggattcagctgtcttttctccacctaaattcggaaccaattgagagaacaagagtcagatgataaagatcaatgtgt

SEQ ID NO: 37469 - DNA, 1027 bp, Homo sapiens
taatttttgtgtggccaggctgatctcgaactcctgacctcaggtgatcctcccacctcagcctctcaaagtcttgggattataggcgtgagccgccacacgtggcctatagattacatttctgcaaaggaaaaatctcttgtctcttacagtgttggccacacatgtcagattatgacctggtttttggttttctggtgtctgttttttagagagtggggtaactgctccttacttgaacttacaactaaagcccctgtttttagtgttatggcctacccttacattccaaggttttccaagataactggtgccccaatttctgagtatttctggacttctatgggtgagttggcttacttttaagtcattttatccttctggaggcacttaagtttgaatttttgctgtaatgtcaagccagtacctactcctccattaacttagtcttctacaaatatatacagaggtgacatctgtatcctccattttctcttctaccatttattttgtcctgatgtttgaataccacccctctttcttctttttcatctctttctgtcttttgttcttttgttctttcattcttctcttcttcccattctttccctccttttctccctcctccctatctcctcacccctcccctcccctcccctctcctgccctctcctctcctcttttcttttcatgaggcagagtgtcacccaggctggagttgagtggcatgatcgtgactcactgcagccttgacctcctgggctcaagtgatcctcccacctcatccttctgggtagttgagagtataggcacacttttatttatttatttttttggcgagatggggtcctactatgttggcgaggctggtctcaaactcctgagctcaagcaatccttctgcgtcagccttccaaagtgctggaattacaggtgtgagccaccatgtctggcttttctttttcttcaatgagattttagtgacatttgtggcaagaatagagataattaaataattcaatgtagca

SEQ ID NO: 37470 - DNA, 1050 bp, Homo sapiens
aatatgtatccttaacttaccacagtttatcttcatagaaaatgatgccacttcacatataatgtgagagccttataacattgtatttctacttctctctatatctgggtttccatctggaatcattttctttagcttaaagaacttactgtaatatttgtcataccagtctgctggcaattaattttcttggcctttgtttatctggaatggtctttatcttgcttcatttttgaaggataatttgaatgtatgtagagttccaggtgatgggattattattttttcttggatgacttttaaagtgttggtccattttcttctggcttgtattatttctgttgaggagttgtatgtcttatctttgttaccctctatgtaatgtgttgtttttctctggcagcttttaagattttttttctttatcactggttttcagtaatttgattatgaatgtgccttagagttattttcttcctggttattctgcttgttgagcttcttggatctgtggccttacagtttttatcaaatctggaaaatgatctacccttatatcttcaaatattttatcttttctcccatccacaattcctatattctaattacatttgtgttaaacttattgtcattgtcccactggttactgaagcagtgttcattttttcagtcttgccaatcttttatttgagggagctttattgctatattttcacatttgcttatctattcttctgtagcatgtaatctgcagttaaatctatccattatattgcttatctcaaatgtatttttttttcagttcttggcagttccattttttatttttttaaatctatttcttttctcattatgcttttattttcctctatgtgattgaacacttttgtaataggtggcttaatattcttgtctcctaatttcataatctctatcacttctggtttgtttttattgactgatatttttctggttatgaatcacgttttcctgtttctgtgaatttctctagtaatttgtattggatggtggtcattgtaaatattatgt

SEQ ID NO: 37471 - DNA, 1035 bp, Homo sapiens
cctgactcatctcccttgctcaagttgtgctttttgccagttgttctctgaaaccaaaatgaggttccaaaatgacagattttgttaccttatatttctcagtgacttaggttccttgatatggcttacaggcctcagctgacctgtgtagcgtattttcctctgacacactctacactcaacccattatgaacttttttagttgttttaattttccttttgtgcctttagttgttttaattttccttttgtttttatgtaaaatagaaaaacctaccattaaaataataataattatactttttggtggttctatatttagtataataatataacaggaaaaaaccttacaattcaaagaaagtgagattgaggttaaggtaaaatgtattcttagatttatatagactgtaaatgagaaggctccagagaacttgacagtttagagatcccttcaagataacactataaatgatgaaaaggaattattattattttcctgaagatcttgggaaagcatcaactgcttgaagctaaggaaagaaaagtttgagctgaagattcagaaagaaaagttctccacttttacaatgagaccatattctgggccgtaatacaagccccaaaaggattaaagtcataaaatgtatgttttctgactatatacaatatgctttctcggttagagagctacctggaaagtctccaattttattgtttaaagctaagcaaaatgattctaaattatccatcattcgaagaggaaattgcaaagaaaattagaaaatacttaaaatttactgaaaatgaagacgcaatatatcaaaacttatggtatgcaactaaaacaatgcttgcaggagaatttgtagcactaaagttttttattaaaaaagtagaaaggtttaagattggtgacctaaccttccaccttaagaaattacataaagaagagcaaagtaaatccaaagtaagctgaagaaagaaatgatgaaggtaacagcagaattccattaaatagaagagagcaatgca

SEQ ID NO: 37472 - DNA, 1563 bp, Homo sapiens
gttttgagtattggtgtctattaccaggtatgcaaagcccagtccagagtaaatgtcttttcctgtcacacccatgacagcctcctagggctacaggcagtggtccaacgtagtttgttttccagctatgtgcagagcctttaccctagggaatctgtctcatcattgtatgcagtctttctgactggtagattggactgttcatgttgccattttgtgcctcagagaatacaagaggaatatgctgattatcagccaccatctgtgtccatacactttatgaacccaagtggctaactggagtgagcaccctaaggtattcacttgttggtttcaatcatcctttgattctggaagataataataataattgttattattatttgggacagagtcttgctgttgctcaagctggagtgcagtggcacgatcttggctcactgcaacctccgcctgttggttttaatcatcctttgattctggaagataattattgttattattatttgcgacagagttttgctgttgtccaggctggagtacagtggcacgatcttggctcaccgtaacctccgcctcccaagttcaagcgattctcctgcctcagcctccctagtagctgggactacaggtgcatgccactactctcaactaatgtttttgtatttttagtagagatggggttttcccatgctggccaggctggtcctgaactgacctcgggtgatccacctgtctcagcctccgaaggtactgagattacaggcatgagccactgcgcctggcctggaagagaattattttgatgtgtatcaacatgtcctactttaatgagttccttaagtttctgtagaaccataccttatactcatgggtagcactcatggactgcaaactccagtctccatttcttcattacttcagtagtccagtttcttattgtccatctgtttgaccgtataaccaagctgttcactcccacctctgagtcagaatacacacaaacttcagagctcttgctgttgtctatgtcttctgttactgcacggataacagcatgcagttgagctcagtgaactgatttattcttaccttctttgatcagagttttttttccatcagttagtcacagtatggcagctttccaaacaggatgctgtccatcaccttggaactgccatctgtaaataaagtggctttttgtttgccaactagggcctggtagaagggcacacatatgtggcagtaggatctagtaattctccagatgcctccagaatcagtcataagttaagggaggctatctgcttgtgaatatgatgagtatttccttgcttttctcttttcctgtataaaccatttccattttattatgaaaattctcagtactgccttccttgttagaatgaatgtttctctgagataacccaaaatgttatatgtattgcagctttcaagattttttttttagtcgtggaggcagtttgaattagtgaccaataacaagccagtgttttatcttattttatttatttattacactgtaagttctgggatacatgt

SEQ ID NO: 37473 - DNA, 1052 bp, Homo sapiens
gtatccagtcttgggtatgtctttaagagtgaaaacagattaatacgccattatacagctcttcactgaaataattgattcagattaggatcactaatggacactaattcctttaggtgaaaggatatgaaggaatagaatatttgcacagtaccaaaatatcacctcaaggtttattggaattgtgtagggaagaatataccttacaacagagatttagctgttacaactttacctaagtgaacaaagttaggatcactgataatacagcagcctgacattgtgtgttttctgatgtgatgcaacttgaagcacatagcattaactgtgaatcttcttttataagttgaatctgactgtattcagacctttaggtacattttccaattttaatgaaatacaggggatagatgaaaagttaaataacatcacaaggacacaattagacaaatctagaacacaggacatacgaaaagataattggcctggtctcttcaaaacataaatgtcattaaaaatgttaagatgaatgtgttggaaatcagggagactgttacacatgaaaatgattaaggagatatgaagaccaaatgcaggccagatgcagtggctcacacctgtaatctaggcaccttgggaggctgaggcgggtgaatcacttgaggtcaggagtttgagaccagcttggccagcatggcaaaaccccatccctactaaaaatacaaaaattagctggacatggtggcatgctcccataatcctagctactcggaatgatgaggtgggaaaatcgcttgattctgggaggcggatattgcttcactgcactgcagcctgggtgacagaccaagactctatctcaaacaaaacaaaataaaacaaaacactccctccccccgccacccaaatgcagtgtgtgaaccttgctgtgattttggtttaaaaactaataaaaatacctatacttttaggggcaattgggaaagaattaagtttcttaagggagataacggtattatggttatgtagagaaatgttcttattcttaggag

SEQ ID NO: 37474 - DNA, 1030 bp, Homo sapiens
tcatagaataataagacagatattatttgctacttttaaaggccaagtagaatgttttctgtattcttttgagaaatagtgacatccttgcatggtgaaattcttcattcaagtgaaagaaccaagtaacaagtaacaattttctgtagttgtcaagttacgtgaactaatggtcatgaatttgattcagcttatgcatttcaaccttgagcgttcaactccctggtatccaatttgaactcctaattaaattatagagaaagatgctactgtttcacatgttatttagaataaagtgtctggcaataattatctgtgacaatgttttaaagtagttttccatgatttttcaggcaacatccttgttttaaaatttattaattcagttctgaatacaataacctttacacttgggatgtggaggaacatactgtagattgcaaggatgtttctggaacagagaatcatgtgtaatacacccttacacttgaagggtaatattattacagggtaggtgcatctgagttgtagttttctattggttgttctgcattaaccgaattggtgctttgtcatcactgtatttgtggatattcctttccaatatcagttatagatattaagagttatggtgacagtcatcgtgtactaagatgttgagtttaaaataagagactagaaactttgatcttttctctgatattaatttttatactttttaataaaagttattttataccagtagaagtagtaatatttgttgcgtggaggggaagaggagtttaagcaattggcctgtagtgtatttctctcctgattaccccgggaatacccctggggaaaaagtcatgtccaggagacaagtggcttcgtcttttctccttataaacatgctgataattaactcatttaataaattagactggccaggtgtggtggctcatgtctgcaatcccatcactttgggaggcagaggcgggtggatcacttgtggtcaggagttcaagaccagcctggacagcatagtgaa

SEQ ID NO: 37475 - DNA, 1203 bp, Homo sapiens
taaatgtgtaaatggatgaagagagatgaatattccatacagaataattccaataatatatttaggtgttctttgctatgggaggtagagaataattcctcctctttttccctgagggtgggccagacatagtcacctcgaaagaatagattatgaagaggaaaaaaacagtaacgttatagtggagaggcctggcatatagtaccttaaccaggtaatgaaggctagcatcactggtgatgtcctgttgataccatgttccccttgccatgatctgttgagaatggcagttgacctcagtgatattctttccagaaatcataaccctagtctaatcataagcagaaacattagacgaacccaaattgagggtcattctataaaatacctgacacagtcctcaaaactgtcaagatcatggaaaagaagggaagattgagaattatcacagaccacagagactggggagagataataattacatgtaatgtggtgtcctgaatggaatcctggaaaagaaaatgaacactaatggaacaacttgtgaaatatgaataatgcctgggctttagtttgtagtaatgtaccaatattggtgtcttcattttgacaaatgtgacatgatgttataaaatgttactaataggggaaagtgagtaaagggtataacacactcttcgtactgtctttcaacttttccatcaatctaaaattactccaaaactcagcgaggcatggcggctaagcctgtaatcccagcactttgggaggctgaggtgggcagatcacttgagttcgggagtttgagaccagcctgggcaacatggtgaaaccccatctctgtgaaaaatacaaaatataacctggcatgggggcacccgcctgtagtcccagctactcggaaggctgaggtgggaggatcacttgagcctgggaggcagaggttggagagtgagccaagattgtgccactgcactccagcctaggtgacggagtgagacctcatctcaaaaagaaaaaagaaaaagaaaaactccttgacagagtttttttggttgcatggattcaaatgatgtgaagaacagaaactatgtgaaataatttttgctagttagcgtgttttattttaacagttttccccctaaaaatggaataatatgctatattaatactatttacatttataagtttctttattcgtaa

SEQ ID NO: 37476 - DNA, 1022 bp, Homo sapiens
caaagcagaaaaataatttctgacagttcctttctgtatgtcttctcaatgctaatgaaataaaaaaatctatatcaggttctctagttgacaggaaaaatttgaggaatgtctttttatttagttgttcgttttatcattcaaaggaacattttgagcaaagccaaagcacatttttgtattcataactgtttattctatataatcagagaaaaggagggctagagtattataaggttgatatagcatatagaatcagtatggtgatttttgaaagagtgctgactttggcttttagggatatgcttattttattaatcccatctactactaagctgtgattttggacaagccattttacctgagttcattttcttgtctgaaagacagtgaatatgataatacttgttactatttcataggattgtgatgatcaaatgaagtaatgtatatgaaagtgctttgaaatctttaaagtgatatatagatgtaaggctgcatttatggtctaggctaacagatacagaaaagagctgttagaagcaagatctgcttatgtatggacagtttcgatgtctgattaaaaggtttgtaagttttgaattgtagatgactgcgaagtcaaggaatctgattttgtcccagagcctcaattcattggaagaaggaaaatgagaacattctggctactgcaagtcaatttttgatattaaaacccttctgtctttattttgaaaagatttacaaggtggtaagaactttactaatgaatgaagaattgtcaacatatgtccctttttaaacccagtatatgtgacatttttgtcttactagagtgtacaaactttttttttatattggggatagtatatttttatgtgagttgaatttgatataagagttagaagagtgctaaacagtggttcttttaatgaagcatttgatggcttgtttttgtgttctacagagagaggctagtgactgaaggtagacaaaatacttttttctctagcatattttga

SEQ ID NO: 37477 - DNA, 1031 bp, Homo sapiens
actttttattactatttgatctcattactcacaactggtctgttcaggttttctatttcttcctgattcaatcttggtagattttatttgtccaggaatttattcacttcctgtaggttttccagcttgtacagttgtttataatagtctgttatgaccttttctattactgtggtaattgtattgattcctttatcattactgattttatctgggtctcctgggtttttatgtgtgtgtgtgtgtgtgtgtgtgtgtgtgtgtgtgtgtgtgtgcttagtctggcaagctgtttagaaatttatctttttcaaaaaagttaccttttattttgttgatttttttatctgtatttcatataattctgctctttattattttatcctttctaattttgggtttggttttttcttctcttcattgaggtgcatccttagattatttgaaatctttctacttttttgatgtagtcatttattgctgtatcgtttccttttacccttgcgttttctgttttgcgtaggttttggtatgtcgtgtttggttttcatttgcttcaaggcagtctttattttttcataatttcttccttgactcagtgctcattcagaagcaagtttagtttccatgtatttgtacattttctgaagttcttctttttattgatttcatacatgatatgatttttttttggtaaaatttgttgagtcttgttttgtggcctaacatatggtctatcctggagaatgctccatgtgttgatatgaagaaaatgtatactctgcagctcttggatgaaatgttctgtaaatgtctgtttggtccatttgatctaatgtgtagtttaaatctgtttctttgttaatattctgcctagatgatctgtctaatgctgagagtgaagaattaaagtccccaactattattttattggaatctatctttctctttagatctaataatgtttgctttatatgtctgtatgctccagtgttgagtgcatatatgtttagaattgttatattctattg

SEQ ID NO: 37478 - DNA, 1028 bp, Homo sapiens
ctttctggctccgtcttgggagggtacatgtgtccaggaatatatccatcacatctaggttttctagtttgtttgcgtagaggtgttcatagtagtttctgatgcttgtttttgtttctgtggggtcagtagtaacattcccttagtaactgctaattgtgtttatttggatcttctcttttttcttcttaattagcctagctagtggcctattttattatttttttcaaaaaatcaactccttagtttgttgagcttttgaatggttttttgtgttttgatttccttcagttcagctctaatttttgttattgcttgtcttctagctttggggttgatttgctcttgtttctctcattctttcagttgtgaagttaggttgttaatttgggatgtttctagttttttgatgtggacatttaatgctttgaatttccattttaacattgctttagccatgtcccagtgattctggtatgttctatctttgttctcattattttcaaggaacttcttgatctctgccttaatttgattatttacccagaagtcatttgggagcatgttgtttaattttatgtatttgtatggttttgagcgattttcattgtgttgacttatatttttattgtgctgtggtccaagagacactctgactttttgagttgccatagtccttccacgggttcttcatctttgtggcctgatgttcctttaatctttgttgttgctgtcttttggatgggcctttttgcttttatactctttgatgcctttgagggtttgactgttctttaagttggtttcagtcagctgtcttcatttctggatgatttcaggggaccaaggttcagctcagcactcctgggctgcatgctctaaccctgaagggttgtgtccaggctcacagctttgttctctggccccttgaggttaagcacctgctgtgctggaggagttgaggtgttcccagttcactggtagcaacactcatggagggtgctgacagaatcccttcattaagccag

SEQ ID NO: 37479 - DNA, 1026 bp, Homo sapiens
tatagtttgaagtcagatagtgtgatacctctggcttttttctttttgcttaggatggttttgggtattcaggctatttttcagttccatatgaatgttagatattttttctagttctgtgaaaaatgtcattggtagcttgataggagtagcattgaatctgtaaattactttgagcagcatggccatttaaataatattgattcttcctatccatgagtaaggaatatctttccatttgtgttgtttccgatttcttcagcaacattttgtaattctcatcgtagagctctttcacctccctgttgagctgtatgcctaggtattttatttcttttgtggctattgtgaatgggattgcattcttgatttggctctcagcttggacgttattgctgaaatgctactgatttttttgacattgatttagtatcctgaaactttgcagaagttgtttatcagatctaggaaccattgggtagagagcatggggttttataagtgtagaatcatatcatctgtgaacagagatagtatgacttccttttaatttggatgcctttcatttgtttctcttgcctaattgctttggctgaaatttccagtactatgttgaatagttgtggtgagagtgggcatgcttgtcttgttccggttttcaagggaaatgtctctagcttttgcctatttagtatgatgtttgctgtggatttgtcataactggctctttttatttaaggtatgttccttcaatgtctagtttgttgaaaatttttaacacatgttaaattttatcaaaagccttttctgcacctattgagatgatcatatggtttttgtttttaggtttgtttatgtgttgaatcacatttactgatttacatatgttgacccaaccttgtataacaggaataaagccattttgatcatggtagattaggtttttgatgtgctgctggttttggtgtgctagtgtttgttgaggatttttacatctatattcatcagggatattggtctaaagtt

SEQ ID NO: 37480 - DNA, 1043 bp, Homo sapiens
ttcactttgagacagaatagagaagcagtggtaattttagttcatctactatcaagataaacgacagtatgataggtataaattcaaacctggattccagattttcagttcagcgcacctgactttttggaagtgctaaaccttttgttttgttttttgtttaaatttctactctttggtagaatgaaattgtatgtcccaaactagtgagccattctctattaatgtttaacatccataatacattaacgttcacttgatccaactcagatactttggcaaggaagaggattagatctaccaaatctgggttctacatctaaaaagatttggggccatgatacaaaaatgactaatttggaagtatatgttttaattctaattggaaataactatttataaatacttgaataagggcttttggggtctatatttgttaaaggcaatatgatatattacatatataacaatactgcatattttgttagaaatatggtttaatagtcactttgctgacttaatattgttgatctttaactctgcaagtagttaaaaaacccagaacagagttcattatacttctgttttaaaaagggggtgggagggatcatctcttgaaaaacaaaaagtattaacattctaaaaaaaaaaatcacttatatctagtactaaggattgtatttcaagctttttaaaaaacatagttcaagtgtatttataatcaaaactatatacttacactaaaaaagacatagtaatacattcaaatataaaaagtattaggaacagcttgtacatattttagatgttctgtaagataagtacttaagaggacaaactttttaaacatctaataatcaataatgttaaaaatgttttatttcctttgaaaaggtcttctttgagtaggatttgccttaccttgaaaatgtatactcagagccaagtaaaacaacacttcaaccttttctaattaatttatagcctataataatttcaaaatatatatcacaacaaataactaccaaagtatattctccaac

SEQ ID NO: 37481 - DNA, 1023 bp, Homo sapiens
atttgatgacagattttaaaaggaaaattttatcccaaagcatttgcttttcaaaactgcaccaacattacaaaccatattattttgtcttttggcagttgagggtaagggagtggcggtggactgggtgggagtgcagtagtaacaaagcaaatgaagaatgagcgaatatttaaaaatccttagccaataatcatacatcagcacttggattttaaagtggctattaaaaattttcttcacagatgcctcaagtgacacatcttattaatgaaggtcctgcatttaatatttgcttacctgcatttaatatttgcttaccttattgacattaaatgtggtggtttctaacacatctttcactttctaccttcaaatcaagtttctggatttcattctcttgctcaagattttagctctatggtgattctcaaggctagattatggtgtctgcattttcgaaacattttgaaatcatttttctttatctcaaaggaattctttgtaggaactgaaaccttcctggattgaataggaaggtcatatggttattatagagtataggctctggagttagccaggcattgtcccaacccaagttctgtcactttttcctgagcctcagtttcctcttctgtagagtggagaaaaataactacattgtaggatggttgtgagtattggatgaattatgagaaaagtactttacactacttaatgagtgtctgtttatattccatttctttccaaaaataatttaagatagcttataaaaatattaaaaatagacaagccaagtaccagttcatttatttcttctaaccatcttcctttagtaacattaaagaaaattggggaaatattcttattacaaaagtaaaatatgaattgcaaacaatttgaatattacaggaaggtatgaagaagataaacttccattactggaatattttcatgcatctccttcatcctttttttccccaacataggcattttaaacctaaattaggattacactatata

SEQ ID NO: 37482 - DNA, 1048 bp, Homo sapiens
tgtattttgccttagcacatttgtactacgtgcacttctcctggttaattccttcccatcattgttatcttgtgctggttcttgcttgtatacttccaggtgatcctcacttactcttctcttgcaaatcacattcttttggggatttggccaatgggagatactggaaggagactgggaaaagggaagaaggaagaaaacaggacaattctcttctctcattctccctcaacccccttgatatgtctctctggtttcacggacattatccagcagtgactaggtgactgggtctcctctgtggttcagttctccaccagacagatccctccataatcccaaatattgtactgccaagcacccgctccatggtgccactcctgccacagagttggtccatgtgaccatcatctgggcttcagtaacgtccctctgctagtggctttctgcgttgctcatgtctgccacactctatttgatgctcaattcttccatcacctgtgtagctacttccttgtgttcaattccctttgtttgaaatacttagagtagtttctgttttcctgaccaaaactgttctcaactacagagttttatcattagagcagccctcactgaccactgggtcactgtccagcccatgtacccatttcaggtctcttcattgcgctttttactatctgctgtttttgtttgtttatccatgtatttgcttggtgctatcttgcttatcattgtatccccagagtccagtatcctcagagcctagaatagtgtctgatatgtagttggtgttcaataaatatttattgagtaaatgaataaaagaaatgaattgagatttggctaaacaaaatactactcaaatgaagagatgacatgaatgaagtgaatgataagcaggcccctaaatacaaactctagccagtgcgggggaaagaaaatgagagagaaatcaggcagaaaaaatgaaaatattaccgtttgggaagaaagacagtgggtgagaagaaaactagtatttatatagtatctattagcatgccag

SEQ ID NO: 37483 - DNA, 1032 bp, Homo sapiens
taaatccttttaaataatttctagaaccatgggatttctctactctcatccctcttacagagggaaaaggccagggttttgctcattgctgaaatctaagcatttggcccagagcataaaacatgtaaggcagtaagtgtgtgttcactggagcctggttctattgtttctgtcttcaaaagcctgtgatggtttcatgttgcccacagagtgaaacctccttagctgggcctcactgtatatcagtcttcctttccaccttatttctcatacaatctagtgatgcgctttttgatgattgcttaccatcgggctcatgttgattttttctgatgctccctccttccaaatcttcacttgtcaaagtcctgcacatattttcagaccctgctccatggttatctttatgaggcctcctgagagtcttctcccatcataattgatccactgtccttctctcccaatgacttcataccttcagtatattacagtcagtcttttattatagctcctgaatggacagggtttcattttaagtgctaatttttatcagttggtaatggctgcctagagcactgtattgagaaggattctaagggtatacctgggttcctcaaacagggtgccaaagcagattggatgcattacatgagtgtaggagaagagagagaacaaactgcccatggattcgccaactttatttagattcccattgatgtttctactcagctggatcaggtgctcgtaaagatatctttctatccttgtagcctctagcataattcattttcaatttgaagcttaaatactctattccatgattttaaaggttcataatttaaaatgacaaatatgacatttgagatagaatgtggtaatggaaaataaagatataaagtgctagtgaaatggtccttgaagactgggtagaaagacacgggaaacaagaagggaaggcagccctggtcaagagtgaaggacgaagatacaagtttttaaagtgtaagttctattctgttaaggaaaaatgat

SEQ ID NO: 37484 - DNA, 1124 bp, Homo sapiens
gtaaaatagaataattgctccgagtagtacctgcttcacagagtttctgtgaggattaagtgggatggtctatggcaagcacagagcagagtgctgctccatggtgccaatgattacaaacatattttttagttgctgtgagttctctgcccttttccttaaggcgtatcttcaattcttaacttcatatttcaaggtcatttctggacatctagagacctgggtaaggatgctttgaaatgaatggccacggggttagagtgagagtaagtgagaagttagatcaattacttaagatcccaacgggccttgcaggttggccttgtgttagggattttcccactgtctgtggtctggcccaaagccccgtgggcccagaaaccacacttgtcagcagcttcagagcacatctgtcctccagaactggactcatattaatgaaactcttacaactaatgtgtgagatcagaatgccaatgtttccatttagaatgagaagtgaaacagctgaagatgggcggctcatcttcccacccagcgcattttgctcctgtaggcagactacatggggagcaaatcgctaacccggctgtcagtttattaatttataaggagagacctagctgctgagttgctcctcaactccctcaagttttaagcaaggtctccctaaagacatgccagacaggatcccatatttgtgtcagaaagcagcttgatgagcatggaatcagaagggcaagctgttctcagacccatgggtataatgaaatgagagaggcagagccacaaaagggaaggccaccagcctctagcaccctaccccagtgtttcagtggctactgcctgtgcttacttccaaggctgctttttgcctacttcctggtctgagacggactgtccatgggacacttctggcctttaaaagcttttgtttgtctcatattgtgtagaggctaagatttaaacatcaggaatattcatgtaacaacccagagctgtagcctttcttgaaaaaatccagagatctagccccttcccacatctggtcaaccatctggagctgagcagagactgtctcctttaaaggaagcttgagtgctgccttcattcagttcactgtg

SEQ ID NO: 37485 - DNA, 1036 bp, Homo sapiens
ttggtgcatctatcattgcatcacctagttattaagcccaacatgcattaactatttttcctaatgctctccctccctccacctcaccccttgacaggcccccatatgtattgttcccctttcttctccctgtgtccgtgtgtcctcattgttcagctcccatttataggtgagaacatgtggtgtttggttttctactcctgcgttagtttgctaaggataatggattccagctccatgcatgtccctgcaaaaaacatgatctcattcctttttatggctgcatagtattgcatagtgtataggtaccatattttctttatccagtctatcactgatgggcatttggctttattccatgtcttttctattgtgaatagtgctgcagtaaacatatgtgtacatgtatctttataatagaattatttatattcatttgggtatatactcagtaatgggattgctgggtcaaatggtttttctggttctagatctttgaggaattgctacactgtcttctacaatggttgaactaatttacattcccaccaacagtgtgaaagcgttcctatttctctgcaaccttgccaacatgttgtttcttgactttctaataatcaccattctgactggcatgaaatggtatctcattgtggttttgatttgcatttctttaatgatcagtgatgttgagctttttttttttttttttttttttttgagacggagtctcgctctgttgcccaggctgcagtgcagtggcgcaatcttggctcactgcaagctctgcctcccgggttcatgccattctccggcctcagcctcctgagtagctgggactacaggcgcctgccaccacacccagctaatttttttctgtttttagtagagacggggtttcaccgtgttagcgaggatggtcttgatctcctgacctcgtgatccacccgccttggcctcccaaagagcttttttttcatatgtttgttggctgtgtgaatgtcttcttttgaaaaatgtctgttcatgtccgttg

SEQ ID NO: 37486 - DNA, 1104 bp, Homo sapiens
gttgaagagagggagaagggataccaaggcttagaaataatgattaccaagacatgtacatgaggagaagcaagtgcttaaatgttctgggaaggtagaaggctgatgctatgcaggagatgaggataataaagtagtttagggacagattttaaaacctacttcaattatattgaaatctactctaattgtaagcttccaagtggatgccagagttggctttcaatacatttgcttgtgattctctgaaatgtataatgtttaatgaactgatttggaacaataaaccagtttttactgtagttgttttcagtttattgaaccaaaatactattatgcttactgcattagtcagggttccctagagggacagaactaataggacagacacatatatataaaggggagtttattaagtattaacttacacaaacacaatgtcccacaataggttgtctgcaagcttgaggagcatggagagccagtccgagtctcaaaactgaagaacttggagaatgatgtttgagggcaggaagcatccaacacgggagaaagatgtaggctgggaggctaggccagtcttgcttcttcacgtttttctgcctgctttatattcgatggcagctgatcagattgtctgccttccccagcccactgactcaaatgttaatctcctttgccagcaccctcacagatacacctgggaacaatactttgcatccttcagtccaatcaagttgacactcagtatcaaccatcacactaaagctaatgatatttcattcaacttgaaaacttgtttattttataggactttttggattcaggttataaacaataagtcatagttatcattaatattctcaattcaccaccatagtgtatatttttctttctttctttgtgatttgttgatattatggtccctgactgaaaagttgagaatatgtattcttattatctactatatctttccagagttatagaatctgtctccatatttgttttgcaaacataatttcttttctttcagatttgtttctttatactggtattggaactatgcctgatctagtgaaatactgattttcacatacctcagta

SEQ ID NO: 37487 - DNA, 1073 bp, Homo sapiens
acaaaacccatatgattatcttaatagatgtggaaaaactgatgaaatctgatatcccttcatgttcaaaaccctcaacagcttatgcattgaagacacatacctcaaaataataagagccattcatgacaaacccacagtcaacatcatactgaataggcaaaagttggaatcattcctcttgagaactagaacaagataaggatgcccactttcaccactcctattcaacatagtattggaagtcctggccagtgcaatcaggcaagagaaagaaataaaagacatccaaataggaaaagaagtcaaagtatctccctctgctgaatatataattctatacctagaaaaccccaaaagactgcaccaaaatgttcctggagctgataaatgacttcagtaaactttcagtatacaaaatcaaatacaaaaatcagtaacatttctatacaccaataacatcctagctctgagccaaatcaagaacacaatcccatttaaaatagctgcaaaaaattgaagtatctaagaatgcatctaaacaaggaggtgatagatctctacaaggagaaccataaaactgctgaaagaaatcatagatggcacaaataaatggaagagtattccatgctcatggattagaagaatcaatatcattaaaatggccatatttcccaaagcaatttacagattcaatgccatctctatcaaaatatcaacgtcattttttccacagaagtaggaaaaaaactattccaaaattcatatggaaccaaaatatccaaaataaccctaagtaagaagaacaatgtcaaaggcattatgtgacctaacttcccactatactacaaggctatagtaaccaaaacagcatgggactattataaaaacagatacacagaccaatggaacagagtagagaactcagaaataaagtcacagaggtacaaccatctgatcattgacaaagctgacaaaaatgagcaatggtgaaatgattccctatttaataaatggcgttgggataactggttagtcctatgcagaaggatgaaactagactcataaaaccc

SEQ ID NO: 37488 - DNA, 1052 bp, Homo sapiens
tgtccctaaatttgcttttgagtttaactatttatctaaaattacagatgctatttaagtgagttaaattccttttggaaaatgttgggaataggcttgatattccttgttgttatttttaaaatctggcttcttaacaatggcatccttcttaaaaagtaccagatttactatttattgctatacatatcctgtaatttaaaaagccatcacagccttttgtatttccatttttatcatattttccatctcagccaggctctcaagttaatttgtacccagaggattgtataatttttgcaaagctgcaatgcacaaaggcctatagaaagtgaaatccatcaaaaaatgttttgtgactaaaatcttgagatttacaataaatgaatgatatgtgatgatgaaaaatgccagtggaatgtgtttaccattttaagaatgtttacaaaaaaagcaagatattgtcacagtccatattgtgcaggtctgtgtttgtggaattgactgccaggctcaatatgtaacattttcgttgtgtctacttaatatcaattctatttatttacttaattaaccaagggctttctttagtgagatcatgtatgatttgttctaggtattataggtatagtagatgtagacttgcactaaacactgatttttaatgaactacaacaggggttggcagatattttctgtaaagaaccagtaaatattttaggctttgcgggccatgctgtttctgtcatgacaactcaacattgccggcgtaatgggaaaacagccataaacaataaatgaaggaaagggagtgactgtgtttcaataaaacattatttataaaaacaggcatctggctgacttggcccgtgagccacagtttgctgatccctgctccatgtaatcatatattaatttcaaaattgagaagctcttttaggccatgattgcatggtgactttgtttgtacattacttttccataatgagaaatcttaaaattttttcccagtatttttaatggtatatttagttgtttatcccttgatttga

SEQ ID NO: 37489 - DNA, 1050 bp, Homo sapiens
atctccctgctgccatctgattctccttcactatttgcaatttgtctaatcatatcactcctttgattacaaaacttcagtaacattctatggctcacaagagggcatcaaaatttctgccgttgtatacaaagcacttcatgatctggcttcttctgcctacttttccaacttcttctcctgggctttctgcatctgtgcccttcatccttacctagctacttgcagttccccaaacatagcatgctgttctcacgccttcatatatttccaggtgtgttgactcttttgcatatggtttaccactgcctgcttatctgcttggtaaatttcttatctgctaaaactcagcttcaaggttaacccctttagagaagatctctatgatcactctaggtagaacttgatgcttccctctttgtgtttctgttttattcatagtacttgccttatctctacactgtatggaacatcttccagagaaatgactctcaagcttcaatgtgcttcagactcacaagtggaacttgaaaaaaaaatcaaagttgtgcttcagaaattctgatacactgggtatggatggtgctaagcttctatatagttataaaatcctaagatatatctggtacatactcacattttagaaccattgttgtgtcttagtaatctctttatccttagaacttaacatagtatatagtacatgcattatgggcacttcacaaatgatttttgaaaatagaatatgacattcttttgctggtgagctgtatacatagtgatagtataactgatatacttggcacacagtagttatcagaaagtgtgtaatgtttggatgtaagaataaatgaatgaaaagagcttagggaattgagagaaagcaactattagcatagcctcttgaatctctcaaatattgcaaattccatatatgttttctgagttttgggtaattaggatttgaagtcaatcattgatgtcttcaaaggcatatctggagacatgatattgtggtttggaatttttatactaagttagtagacacag

SEQ ID NO: 37490 - DNA, 1046 bp, Homo sapiens
aaggaatagagggaaagggtaccaatgtttgttgaaacaggtgccagtcagccacactgagtgaaaaccaaactgagtccaggaacacgagtttggtttcaagcttcttgtgccatttcctgcgtgtttgcctgctaaagggcagttgagtgttcaaagctatccctctcaattgaaaactcatctgacaataatgaagcgtgtcagctcagaaaggcattaggagctggagacatagccaagtgcttgtattcaacattgattaatgaattggttctaatctcagagcatcattttcacttataatttttaactcaaaaaattgatttaaaagtgcaatataagtttaattctatttttttcccactgtgtctggagaacaagtttttttcttgcatttttccctttttccctcaatttacttaagcatagattttatgtcattctctcatcacataccaaaaaacttagcagttgtgccaatataataaatgttgaagtaagaaagacagggagacaaatggaaaaaaaagagaatacaaaaagtatggctaacattatgtaagaagaaaaatacaaatggctttctagtaaccaaataagatgtacacatgaacttcataaatatcctattgctttgtggagactttcgttttattttagaataattaaaaatagtaattaacagtttattgagtacttactttatgccaggctctgttctcaggactactcatgaaataactcacagaatccatacagcaaccttatgaaggaggtctgaggggagtccccattttacatgtgaattacgctgtgaggcaagggagctgaagtagtttgccaaaggtcacacacctagtaagtaggggaacagattcaaacaagaatgagacagacattttctgttatttttcacatgcaaaaatgtctctattctacctcaccatttgattaataattctgggctaagaaataatttcttttagaatttgaaggcttgttcttataacttttaacttgtaatatttttttgagaaatctaa

SEQ ID NO: 37491 - DNA, 1071 bp, Homo sapiens
tctggttccttctcatttggataggctatgtcagagggaagatctggaactcaagtgctgctgttcagattcttttgctccatggggtgctcctttgatgtggtgttctcccccttcccctagggatggggcttcctgagaggcgaactgcagtgattgcttttgctcttctgggtctagtcacccagcagagcctaccaggctctgagctggtactaaggaatgtctgcaaagtgaaatagactctgtgtgggtccttgcttgtatttttctttagtgtgctggttttgtgttggttggccttcagccaggaacacaagagtgcaccactgcactctagcctgggcgacagagcaagactctgtctcattttccagagcgtatcagctgcagctgtataagcaggatcaggcagtgggtggggttatagagctcccaagagattatgttctttgtcttcagctgccagggcaggcagagaaagaccactaggtggggacaaggataggcctgtctgatctcagagtctccttgggtgggccttgctgcagctgctgtgggggatgggagtgtggttctcagcccaatggaggtatgttcacagggggattatggctgcctttgctgagtcacacaggtcaccagggaagtgggggaaagacggcagtcacaggcctcacccagttcccacatagcctgcagtccacttaggagcatgctgaccaaagtcaagagtttccccattctcaaaacactacagaaatttgatttgtaggcactacatttttttgctttcccaccacctcactgactgctttatcgtaatctcttttactaaatttttcctattttacctctacaatttgggatcccacctggtatagtacttaacttcctcctgttttctgtctagtaattccttatatgatctcaaccagcttgggttttaaatagacacaagcaaaattccaattttggttaccagtcagtgtacattaactgtggtaattgcaataaagcacaactgctacctcttcagtccacaaatcactatgcaaataacgaatgtgc

SEQ ID NO: 37492 - DNA, 1026 bp, Homo sapiens
ccccaaagcctaaactgatttaagactgcctattctgtttctgcgcgtcttcaggagatttctccagggtgcttagatgtgcatcataacattttcagaattttgccactggagggctcaatggcctttttaatgtttcttctacgagaccaaatgttacgtttgtgtaacagtgagatgtgagaccaagttttttctcccctttttgagaaaatctgttttgggtggtacagttagatgcatgatagccaaaaagcttttgtaaattccctgaaagatggaaatttgtcatagctacatgtatactgaaatcaaaaaggatgccattcatctctccccagagaatacaagggaattgagattataccgagcaaggcttgtgctgagttagatgtgctgcatatacgcggtgtgcttgtgtatgtatgctggtggcagtgtggaaggtggtggaatagtgagggcttaggggtctgtagtcatccaggaattgtatgattaatgtagttggtatgagaatgagaataattttaaggactaattggaagaatatgaggcttggtatcaggcgactagtgatcatgcattgttccaggattcctgctgcatgttcggttataaaggttgtgacggcagttctgcttttcctgaatgagctatgtgtgcctgtggtccaacctctctgaggctggtcctggatcctggactgagcaagtgaactctgatatgagtgacacattgatttggcatctgcgtaattttttgtgatgtttaggagtaacaatgaggtgttatgaaaaaagttggaaacagtgttagcccccatgcaaaagtataaaatcaacataaagcagagagatagaaatatcagaatgcctctcccagaatgtagcaaaaacgcaattctattacatttggtatatgattaagagttaactataaactaactgaaagattcacgtatttaatgattaataataatataccaatccaaagacagatggctgctcagactgaaacctcctt

SEQ ID NO: 37493 - DNA, 1025 bp, Homo sapiens
gagagagagggagagagagagagaagacaacaaaaaaggaaatacgaggatttaactagtcagaatttaagctgtaagtatgaaaagaatgtggataataaaaggaagataagagattctaaaggtagaggaatgtttagattaaacctaaaatggcacactgctaagacttcagtgtacatgaccaagttttaaacctgccagcctatacacacctaacaaagatctcacaaaaataagcctgcactgatttgatagatatgtttgctgaatatttttaaaagtctgttgaatattcactatttgtcaaacactatcctagacaaataaggtaaagcatctaccctcaaaaggtccatagtgcagtgaggggaacagaagcagaccagaaattactgtcaagggcttagggatggattgaagttcagccttggcctcactgctccacccaaaccttgagaagttctcagcctttgaaagctcaagagcaaatgcccaccttcactttgtttctgccatccctgaacttgcgtgtgaacaccaggttagcatcatatctaatctatactactacatctcttatgtgtgcaaggcatgattctcaaacttaaggtcagtatctgaatatcagcttttaaatgcaggtaagcattgtagatataacctaaaatgaaaatagccttatgttatttttatgtcaaatgttgaattccaaaaaattaaatagaaataggcaaattgtacaaacattaagagatactgatttcgctagttaactatatgaagaacattatatgttttcaatacatatacagttataaaaattatgaaatttgtatgtaaataaatatatattataaaagtttaaatgccaatgcaaagaataataatacagatgagatcatagtatatttccaacctttgtagaatcgttaacccatatagaaaactttatgactcaaaatttcatgaggaggaaaaattggataaaaatgtgtaataacatatgtaagaaatcttcaatt

SEQ ID NO: 37494 - DNA, 1048 bp, Homo sapiens
ggcctaggagagttgcctgcccctgggtggagactggactggttgactttgcccatggggaagagaggtggaggcagactgtcttccagagcttgagtaagtcttaacctctctaaacctcacatttcttttctgtaaatctgggggaataacataccaacctgatggtgctgttaggagggtacaatgaaagttcctggcacatggcaatgctcaatacacattctttattctcctccactccatcacttctgatagtcgttcatctccacttttgaggcagcaggtatctttaaaagttatactggtgtctcttggagccttcaggaatgaccatttatactttagcatgaattaactcagctaggttcttgccttctaatttctggatagaacattgtaaattttgagcagtgggcgtgggtgagagtgatttagctcaatctgtagaatttgtggcagcaacctgggcctggatgggtgccacaggacttagtatgggggaggtgacaagaggctggaaactagtggagctttgaatggaggtgcatgggaagggaggcatgagatgctaactacagacttgctttgatccatagcttggctgaagaatggctctgggtctggcaagggaatgggaaactgccctgttctcctctgccaccgtcctgtccctcatgatttcttgctctcagaacttgggctggagctgctagaagtacattaggaggtctcatctggaaaccaactcccattagtgacattgcttctctgggcaaatgaagccagtaaacatagcttcctagtgaactctggaccttccccagttcaggaagccagagactgcttgcactgcatagataatgttttcataaggcttagccttcgtacacttgcacaatttttctgtcacatcttaaaatggaaggtctaagcaggagtcacttgtagtcactccctttgcttcatatatgctttgcacatagtaaatgccccataatgcgaaatcaaattgaataacaaatatatgatttgtctactgattgaa

SEQ ID NO: 37495 - DNA, 1052 bp, Homo sapiens
tttgcttataaaggacgtttttctcccatggaggactagactagagcagattttttcactgagcatggttcattgtctctgtgtccttgtccctttccctcctatttttaaacatctcacatgcctattctttaacatccacacccactttcttagtcctgccagctttcttctttctccttaatattctctctcatcccgactttctctgcttgcaagatctgattcttgtaacaaccatttagcatccagagatgtgctgttccatgtggcaactgctacccgcattttgctatgggactttggaaacatggctagttagaattgagatgggctataagtgtaaaatgcatacatgcacactgaattttgaagacttgtacaaagaaaagaatatgaaatatcccattattaaactttttatattgattgcgtgttgggataacattttggatatattaggttaaattaaatataatattaaagttagttttacaagtaaaattacatatgtgtctcatacttgtatttttattggataacactgatctaaagcagggatttcaaactccaaactccaatgcccacaggggccaccaaagtaaagacaaggagccaagagggtttggtggggccatggtggaccagggagcccctgccctctggaaggagcagctgcttctcagctgaatactggcacctgggaaagaaaccgtgttgccagagcttctagattctttaatagaagccaaatcccagatttttgtgtgaagtctttagattcctgaatttttgtcaaataaataatatatttttaaaagcatcataggttaaataaaatatatctctggcatgaatttagctatcagttagaacttctgactcagagaggtcatatctggtttctcctctccccacttccccttcccccaagtgctgggcaagtgctaggcatgtgttgtctggggcaatacatgtaagcatcaatatgacatgtaggcgtcaatacattttacaaactaatgggatgagttcaccagccaggagaaatg

SEQ ID NO: 37496 - DNA, 1033 bp, Homo sapiens
tgcttttactagaaattttatgtgtgggacccacaatgtgtcccactgaatagccgtttttactccctcaatttcgaagaggcactgctctttttgtaaatgtttatcaaatcattttaattctagaaaatattttggaagtttcactctgccagagacctaaagaacatttttctcccaatatatcttagtttacttacactttctcattgttttgactctgattaattatgttagatgaatgacacttgcattaaaactttagttattagtagattaaaagctcagctacaaagaaacaggctgtgtttgaagggtaagatacgggaatagataggctttcagttggaagtttttatagttcatggactgatttcttagtgtagctccagaaagtaaagcagaatatgaatatgttttgttccttaataaacaaaattgcttgctgtaagcaaacacctgatgatccagaaaaatattttattctcagaagagtaagtagagataatagtgacaaaaagaccaaatacatttacctttcctgtcatcttgaaagtgaactggatagagcccctgtttttggttttaaaagtaaagtgataaatggttttagaagaatgttttaaattcagtatagatgaatactatatattaaaggaagtatttatttttgagcgtgtacataatcctaatgtagaagaatttcagagttggggaactttacatttttttctttcactatcaaggataatagaataacaaataataattgaattattttgaaaggtatatatcatattaccgtgaatgttaacttattaaatcacattacagttcactgaaccaagatatttttaaagcaaaaatagataactctgaattttttatgttcctttttgccaaaaagttttcagaaactgtcaatctttattaaaaaaaacactactatgtaagtatgaattttgtatacaaaagatataaacttattctggagaagatactaaattaacactattatgtatgccttcaccat

SEQ ID NO: 37497 - DNA, 1111 bp, Homo sapiens
gaaagaaaataaaaaccaaaaatcttgttaaatatccaactctttttagtcgttaagacatttccctgcctgcccatagggaactgagcatgagaaggaaatacacgttgtcagcaggttatttattccaatccttgagggacttctagtgactagtccccttccctcaacttacttttctttaaatatttttctgtatgtacaagcaagggcacatgaaagcattcaatttcctggcttcctaactcaaactactaatatataaatagtttcaagggtgttttctataaactccaaatatgtcaaaactttaaactgtgacatagtcatttcctatatttagatttttggaatatttagaactcaaatgtcatatatgatttcacttactaagaggttatttagatgttattttcctgaaagtctaaaatctaaatatatataagtgcttttgtggtaccaacttaataaaatatgaataagctattgtaactagcaccaaagaattagtagaattaaatgaacaaaaatctgtggattcagctaaagaggaaggtaacagaatgctattgcacagagataaattaaaatacctttttttttttaagggcaattttgttgttacagactgcagaagaccaagatacttacaatgttgcaataagaaattacggcagattgttatggtaagcgtattttttctccattaattctgtcaattgattgtatttttctggtgaaagctatgggactgctgatatgctgactagttcctagaatactggtacatgtaggatacataatttccatagaaacaggctctgttaacagtttcctatacctataatggtaaccaaccccagtgtgctttatgtggagcagagttagaactcatggtttgttgactggagatgagaacatttggaagagaggtagtgactgtctctaacagtagaagcctcgttaattggaagaggaattagatttattctgatttgctatatattattaaaccggggagggacattaggggtccagtaacccctttgaaacagtacacaaaaattgttgtgtgggtaccttttggggatggggaatgagctctatatct

SEQ ID NO: 37498 - DNA, 1071 bp, Homo sapiens
tctcaacattgttgtcctggagattgagttcccaactcatgagctttgtggggatgtagtcaaaactacacagcatgagagaagatctaaaagcaaaaacctgagtttacaactgtcagttgtaagagagttacaaactttactgccttggtcattgcttaaacacaaaaagcatagttttaacattttaatattaaaaggaaattggtcctggaaaacttatttatttatttgcgtgattgctgctacttctaataaaaatggtgaagagtaacaaaaaaaagtgtccacaaaatttctggcacttaaagtaatcccttcctccttccctttctccttttcttcttcccttcctattagggaggtgatatgatatgattcagttaggaggagactagtaaagtacttaatgtacagtttttctgttttaagtaataatcagggagataaacttcatgctttttataaataatttgtaagaatcacaatgtttctttttttagtgctctacagcatcgagctgatgtgtcctgcctctggaagctagctggggatgcttgtacctgtctgtatgctgtcgcaccatctaaagtgaatgttcatgttttaggagtccttctaggtcagaaagaaggaaaacaagtattaaagaaaaatgagctcctccaccttggaggaaggtaatttgcaaagattgccagttaataacatttgaattgaattaaggcattgtaacaaaaaacattcacttttatattcccgtaggtgttatggtcgtgcattaaaactgatgtctacatctaatacatggtgtgaccttggaattaattattatcgccaagcacaacatctagcagaaacaggcagcaacatgaatgatcttaaggagttgctggagaaatctttacatgtatggtataaataaattttttataaaccttttcaaaaacataatgcttttctcgaagttgttttggatgaagtaaatagtgttttcacataaaaccacatatatcttgatatacatgctgctattccaagaaataaaaattaatctaatttaacttcttt

SEQ ID NO: 37499 - DNA, 1021 bp, Homo sapiens
tgacaaactgagatggacacctgtcctggtaggatagaaaactcgagttcttcaagataatcaaggaaaagaaattttgttcagcactttttcaaaaaaagcattttattcttattctgaaattaaaataacatttcttagcattaaaaaaatcataaaaggaacaaatttatctgctttaaatagcacttttataagtagaaggagccacagatatatatgtttacttgaattatttattttatattttcctttcagatttggagatagttccatacttttagttctcttacggttttttaaattttagtttacaggcagcattaagagcagacccaaaggacttcaattgttgggaatcgttaggagaagcatacttaagcagaggaggctacacaacagccttgaagtccttcacaaaagccagtgagctgaacccagaatccatatacagtgtgtttaaggttgcagcaatacagcaaatcctaggcaaatataaggaggctgtagctcaataccagatgatcattaaaaagaaagaagattatgtgcctgctttaaaaggtaatttatttttagtagctcctttgacttttatgatcctgaagtataaaatccttgagtagatttcctgcctaaatgtattgaataacttgaaaaggacttctttagtcaacagcaagcatccatatgaacctcttacagtatagcttatataaatttgaatataaaaagatcaaatcttgtttcacaagttaataaatagtaatgtgacagagatttaacttttagacaaacagtatgataactattagatctaaaaattgatctctaaaacatgtttccctactcttacattttgataattaattcatcatgtctccagaatatcttaatacctttaattactttgtaagttatacaagctcattaaattttttttaaacttcagagacaacttgcattgttttgtagttatctaagttatttttggtaatataaaataaaataccaccatcca

SEQ ID NO: 37500 - DNA, 1021 bp, Homo sapiens
aaaaaaagacagtcagacacaaccaagtgcaaatacacctgaagacctgaagtatccttgggaatcttcaaacctctgaacccaactactaatatacagaaaatacagggaaccaaggaacatgttaaacaccttgagaatacgtttagcaaaatccagactctgagaaactgtgacaaataggccatatttttcaacagttaaattgtaaggaagaaaaaaaaaagagaaggagggggaccttattgattaaaagagacaaggcattatcattaagttcaaatgtatgtgtcttatttagattttgatttttaaaattgttaaaatatgagacaactgagaaatttgatagtgttaaggatgttgtttttgtttaggtatgataatggtaatgtggttatgcaacttagaaatgaacttttagatatagatactgaagtattacaggtaaaaagttacaatatctgggatttgtgtcaaaatcatctgagcagaagtgtggtaaaattagtggaggtatagatgaaaaaaatgattgcttgtgagtttgtggttttgtagctggatgatgggtacatgtgggtttattatactagtttctgtaatttttttatgtatatgagattttccttaataaaaaggttatgaagagtgaagatgtgttattagtgatagaaatcaggacctctatttctttattctattaggaccatgcttttctgtgttcgttcgttaattaaagcaaacattgctgtggttgtgttgaaggagatttatagcagttctttacaattattttctagatttctgatgcagataatatcccaggacttttggttctcaaaagcttggcctatcggaacaaaggttcatttgatgaagctgcaaaggttggcttttttattcaaactgagcattttttgagttaaaagcatttttatttggctatagaattgacaggtgtctactttatagattatggaagaccttctctcttcttaccctgacctagctgaagttc

SEQ ID NO: 37501 - DNA, 1025 bp, Homo sapiens
gtctttccataaggaagtcagggaagaatttatatttagctttgagttattcttcatgtatattgttttggaaatttatgcttattgtatctgcaatttattatatgtcatccttaaaaaagaaaaaataaacagaagtgatatggctgtcttcatttggatacccttaattttgtcagctctgaagatcgtagataatcttggtgcgtctggtaacagtctttatcagaggaatctttgtcttcatttgaaagcagaggctttgattaaactctcagattatgactcttcagaggaagcaattcgtacgcttgatcaggtagacttgtcaagtttttttcttcaactctagttagtttccaatcaaccaggcaacaaccattctctgcctaccacaaaatttacttatatggattttgtgttagaggtatgaattcaccacatctgcacttttataagtcattcatacatttgggaacttctaaagttatttgtttgctttttgattaaggacttatagtactcatcatataagactatttcgttagttctagacttcattctcgtttcttccttttgccctcttaggttattactacttgattattattaatttgagattccaaattttttccttcaggaagtgttctgcagatttgacaagaataattaaggacactgttagcttcatggtagagaatgtttatttgtttcattcaaagaaagattcatatttcataatgaaaccgatttcttagtgttttgagttaaagcaatttgaaagtccatagtgaaaaaaactataactggtaaattatgaattatagcattatgccctaaagatttttgtcaggtaaagactattactggtctaaattaaaattgagtttttaaatcagttttatgtatttcaaagggctttgtatttcataatatttctttaaaatcagaaccgttgtcagcatctttcaacaattaatattttcttgttttctttttgccatcccaccaataatgtgttttgt

SEQ ID NO: 37502 - DNA, 1023 bp, Homo sapiens
aaaagtaaattgggagggagagggagggagggagggagggaggaaggcagacatgtagatatatatgcattaggaacttaggctttaacttagtcttactaggtatgatgtttctggaagaacctacattcaaattatagatctgaatggtaaatacaagccaggtaggtggttgaagggaatgggaagaacattttaggcagagatgaatctgtgaaatagcctgagctaagaggaaaactgttgttcagagaactgcaggtagttcaccagggtttgagaatgaagtgtatgtacaggaggggacaagaagtgagattgtagaagggcctagcaagacttggtaaggagtttgcacagtatcctgacaacagtggggaatcagtaaaagatttttagcaggggaattttataatctgatttgtctttttagagatattctagctacagtgtaaagaatgcattggggtggatggcaagcacttgtagtgatttgggataaagatggtggaggtctgaactgacgtggagatggagaaaaatgtatggtggggaatgaattgaggcagagaatcagtgtgactttgtgactgatgagatatgagagatgaagaggggaggagtctgatttggagagtaggcattggtgctgttcatctatgtagtcacagaaaccttgttttttgtgattgtttttatccttttagggttaaaggaaagccctgtctgcacaagtggatggtatcatctggcagaagcccaagtcaaaatgcatagacctaaagaagctgttctttcatgcagtcaaggtatttttgatactttttgggttgacatataagggtgaccaaccctatttgtttttatcttaaaggacaaagatagtgatttttaaaaaccaaaatgctatattttgtattttaaattgctaattttaatttcaataagtttaaataaaagtctgcatgcatgtgtactagtgtgtttatttttaaactgacaatgaatgtttagcaaaatttt

SEQ ID NO: 37503 - DNA, 1027 bp, Homo sapiens
gatacttcaaagaacgtgctagtgatttcagaattgttttaaaaatgatatgtgagcagtagcagctatactagcatataagactatactctggttgactactttgtaggagacagcaggcacttggaagtgcgttttgttaaattaatgttgttaatgtatagttgttacttaccagttgagtgcagtttgctggccagttggagttagaatgcattccaaaacttacatgtacatttttttcctcgttgaagttgtcagggttagactgtagaatacatttgcagttaattgaacgtgtagtttgtgtaagagagtcttatacatttaatcatttgtcatttaagtatgatacagatgatagcttttttatttgtttcagctttttactgcttttgagaatgcactgggattatcagataagattcctagtgaagatcaccaagtactttataggcatttcattcagagtttatccaaagtaagttgattttttaaatctctaatgtgacttgtatgtatttctaattaggaaagtgttcataaatacattttactactactagaatgtagtgtattttgcttttatattttcaagtttcctcatgagtctgctagattgaagaaggcctgtgaaggaatgataaacatctatcctactgtacagtatccattagaagtgctttgtttgcatttaattgaatcaggtaatttcttccttattatagtgtgtgtcctagaggtgtgtgattatgtgagtgatgttattaatcaaaaaatgttttagtgtctaccatgtttaaggtgttgtttctgtgtttctggacataaaaagaagtataatgtgtagtctttgtgtatatgaaaagactaataaatataggaaagtacagtaatacagaagaattatgagttgccagatttattgttagtcagtgaaatctttttaatggtggaaattggagggggtcttgaattttttatagaaactaggtaaacaggagtaggtgaaatatattccagctgg

SEQ ID NO: 37504 - DNA, 1032 bp, Homo sapiens
ttaatttttaattttcataagtttttgaggaacaggtggtatttggtcacgagtaagttctttagtagtgatttgtgagattttggtgcacccatcacccgagtagtgtacactgaacccaatttatagtcttttgtccctcaccttcccccaagtccccgaagtccattgtattattcttatgcctttgtgtcctcatagcttagagtgagaacatacaatgttcttatcatatgttcacgtatgagtgagaacatacgatgtttggtttatcattcctgagttacttcacttagaataatagtctccagttccatccaggttgctgcgaatgctattaattcattcctttttatagctgagtagtattccattgtgtgtgtatgtgtgtgtctgtgtctatctatatgtatatatatcacaatttctttatccactcattgattgatgggcatttgggctagttctgtatttttgcagttgtgacttgtgccgctataaacatgcatgtgcaagtatcttttttgtataatgacttcttttcctctgggtagatacctagtagagggattactggatcaaatcgtagttctacttttagttctttttttttttttttgaggcagagtgtcactctgttgcccaggctggagtgcagtggtgcaatctcggctcactgcaacctctgcctcctaggttcaagcaattctcctgcctcagcctcacaagtagctgggattacaggcatgtgccacgatgcctggctaatttttgtattttcagtatagatggggtttcaccatgttggccaggctgatctcaaactcctgacctcaagtgacccgcccacttcagccccccaaagtgttgggattacaggcgtgagccactgagcccagcctacttttagttctttaaggagtctccgcactgttttccataatggttgtactagtttacactcccaccagcagtgtagaagtgtttcctttttaccacatccacaccaacatctattttttttattttttg

SEQ ID NO: 37505 - DNA, 1047 bp, Homo sapiens
ctgtgtgtttgtgtgtgtgtgtgtgtatgtgtgtatatgcactgtgagggagacagtcttctatttgtgtatctgcatgcacgtttgtcagtgtttgtgtgtctgttgggtcttgaatgtagaatacaggaaggggatgattgtggtataaaatgaaaaagtccatttctattggagtctatcttccatgtgtaagaaaaaagaaatatattttaattacccaaaactctgaacaatatgtgaataattgatgatttaatgcctataggtttttaatttttatgaaactattttattacaaaagaaatacatgtttactattttgtttcaaataaataatccaaccacccattgataatcacttgatatgtacatttccatatatttttatgaatatatgatatatatccttccagatatttttgaaaaatgaattttttttttttacttttttttgagatgggctctcactctgattgcccaggctggaatgcagtggtgcaatctcggcccactgcagcctccacctcccaggttaaagcaattttcctgcctcagcctcccaagtagctgcgactactggcgtgtggcaccaggcccagctaatttctgtatttttagtgtagacaaggtttcaccattttggccaggctggtctcgaactcatgacctcaagggatccacctgtctcggcctccaaaagtgctgggattacaggcataaaccactgtgcctggccctaaataaaccattttttaaacaatgtagcatggagtcaataaatactttttcattctatccctaatacatagcacagcatggtagacattcagaaagtatctgttaaagaaacagagaaatactttgtgatcatctgtataagttctttgccattttccctaatttcaaatgtttttgtactcatttataaattccatatgaagtgaggattttagccctttgctaaatatgttccaaatactgttttcccctgcttatacttaaactttcctttaccaaaagaacagaaaataatactcaaacata

SEQ ID NO: 37506 - DNA, 1049 bp, Homo sapiens
catgagaacccttaattctattttctttgtttctttgttgtgctgtagctagtatctgggactctgggaatctgaaagcagtatttttttttttttttttttttttttatggatagggcacttgggaagcagtgtttgctacccttctagaggagcagcaggcatctgtaatttttcagccttccatggacacctgttttagctgattcattctcataccttatctttctgtattttgagtttgagacagttggaaatattgctagttgttttcattatttgtttatttttccagataccttatttggtttccatttacactaacacttaagctttgacccagaagacttgtagccccttatttttctctaaattatgaagattcagaatgagtatagttaacttttgattatccgaagagcttgttaccagaaattacttcaaaaataaaacatctcattatagtaaggaaggcatgtgtgtgttagaatcaaacaggtcagaattggagtgggagctccccaatattgtctttgtattatcaaagcaaacattttttggcacttactgtgtaccgggccttgtgccaaacaccttagatgggttatctctgaacttcacatcagtcatatgaggtgggtaatatcattatctacattttacaagtatggaaactggggattactgaggttatttgcccaaggtaacacagatggtagattctggagccagagttggaaactgggtagtttgctccagacccaatgatctagcatcctagatgtggtccattagggctctctcttttcatccgtttgtaaaagagaagttttcactttcttctcaaaccattgagaaacaacttggaactggaagtgcaaagggagaattctaaagaaagcgttttaaaaaggagaaagaacaagaaagcaggacaccatttcctacctttggtattctccaaatagttggcaccaattctcataaaaaaaaaatggcacaaaatggtgcatatttttacacacacacttttgtaatgttcatttaag

SEQ ID NO: 37507 - DNA, 1016 bp, Homo sapiens
cgtctttctggacttttcttttagccatatatcataaaccaacacagtaattgccttacatgacttgaaagatataaacagatcttctatcagtagcagtattgttacttctttccaggatgcaaggtctattatcccaacagaagagaaaatatttttatatttaaggattatgctgcactgtactacaaaattgtagtacttttttttgttttcttttttaaagaaatggaaaatgtttactattacagggacctcaacactgccctcccatacaggctggataaaactgtttttaagtcagtgattttagactgacctccatttaaattatgtttatatatgaactttactctgacctgtgatcatgtttcaggaaggaatgaaagagagttctttcttaataaagaaaaacactcaaggactttgttcatttccaaagctacttgtttacattgtacactgcgaccaccttgccgcttttcatcacaagcttgaatatttaaattctgtacttatatctgtaaaatagccaggaatttcctgtttgtgatctattatgcctttttacaaaaaaaatggctgtaaattattgtaaatattaaaggaactttccttacttccttccctttctcaggctttttttgactgttcctttccctaccaactcaggccttcttattaaaaaaaaaaaaatcagtgtaataacactttttaatgatttgtcttgatggaatcattgtttagaatgtaaaaatggggaaaggggccacttaattccattagtcctctttttatactgaatattttattagatacatgttattcccttttttttccttttttagtcaatattgtgtttgtagttttaaaaaatggcgagatatgtaaaatctaaactgcatgctctggaaacacttttttcagatgcatctggtttaaaagggtaggtgtataaacacttttcagaatccaaaacggccaaaagttattgtaaatccgtttgttttcccgtt

SEQ ID NO: 37508 - DNA, 1060 bp, Homo sapiens
tgaaaccagcctcgtagcatctagtcacctcccatcgttgccggccacttctctgacttacttggttccagcgacactggcattcatacttttttaaaaaacatgtcaaacaagttttaggactttcatgtttgttttttcctctacttggaatggcttgctccttcattttctttaggtgtcctctcaaacattgcccttctttgaaatcttgcttatgataagataggaagctccctgctctttcttcctttatttttctttatcacagttgttgtcatctgacatactatttcttgttcatttactggctctcttatactagagtccaggttccataaaggcaggatctgttttacttacagctctatttcctgcatctggaacaatgcctagaacatagtatgtactaaacttacatatgttggataaattattttctaacagaatataaactgccaaagttgaacaaaaaataggaaacataaaagcaatgaataaactaaaagttagaaaggaaattaaagattttccctttcttaaagcatcagatctgactgaattctaattttatttataataagagaggtccttcaaagcagtggtgtgaggatttattattttatttttttgaaatagggtctcacttttgcctaggctgcagtgccagtggcatgatcacagctcattacagtctcctgggttcaaacagtcctcccaccttgacctcctgagtagctgggactacaggtgtgcgccaccatgcttggctaattttttttttttttttttttttttttttggtatagaatcaggatctcactgttgcccaggctgatctcaaactcctggactcaagtgatcctcccgcctcagcctcccaaagtgctggggttacaggcctgagccaccatgcctggcccaatttcttaataaatgatgttggattatctaaatgcattgtctgatgttgacccatcatccttatattcctagaactaaaccagcttgctttctgtgaatatgatgttaaatttttatttgtttttgcatttacaaa

SEQ ID NO: 37509 - DNA, 1022 bp, Homo sapiens
gtttagaattcattctcagaaaaattaaatttttggctctggcatacgtataaaaaatacattttgcattgagtttattcctacaaatattaataattgaaacttgttggtgaactatatatatatttaaatggttaagcattttttagccagtacatttctcatgttatttattaagacaatctgaaaaaatttattgctttttcagattcttccagatgatcccgataaaaaaccacaagcaaaacagttgcagacccgtgcagactacctcatcaaattacttagtagagatcttgcaaaaaaagaagctctttctggtgcggtaagttaaagcccacatgcctaagaccagtttactttttagtaaggtaaattttgtttacttcaccatgctaaacatctgaagtcaatatgagcttatataaatggatttttctgtaattaagtagttttatttgatgttgccatatttaaattttaccttaaattatctcagcatacatgttaaaactgatgaatcatagctttcagaagtaggattctgttttttttttctagttttagagagggatagagaaaactcgtttagcgtgcggagtactttttgagaagtcaagccttacatagcctacatgactgttttacttggagtcattagaatgcttaagggacagcgtcataggttgccaagcttactgaaaaagaaggaaaaagacaccaaaaaggaggtgattggaaacttagagcaactgttagaagtttacctgtgaccataatgtcaataactacctgtgtagcgttaaaaatcattcctaatgcagtctcttgtgctatagaattaagctgaaggccataataatctcagagggtaaaaaatttgtttctacttctctctgatcctttttttaaaggaataataatggctagtatttattatttacattaatattatatttgactcattaagttatatcacctttattgagtttctgatgttggtacagcttattaccaataga

SEQ ID NO: 37510 - DNA, 1014 bp, Homo sapiens
aggaatacttattgttaaataacataagtaatagcatcagttgcttggtgttttgtagaattatgttttatacttttaaaaatactggtttttttaaaaaaaatcaaggtggtagactcggaaaagtgaagggtccaacattccgaatatcaggagtacaggtgaatgccaaactagtcatctcccatgaagaagaattaatacctttgcacaaatccattccttctgatccagaagaaagaaagcagtgagtgatttattttctccattgtaagatttttgttattcaataattgcaaaatgaatgtgctgaatttttatggtgttattggctagttttgaaaaaaaaaaggaagaaataaagcatattattttgaagttctaatgactcacgtttttcaaaattaatttttcagttaaggcaattacaaacttatcattagttattaactttgatgccaggtatactatcccatgccacacaaaggcagctcattttgatatagactggggcaaagaagatgattccaatttgttaattggcatctatgaatatggatatggaagctgggaaatgattaaaatggatcctgacctcagtctaacacacaaggtatttatctatttctgattctgttaaccattcatgttgaatttaatttattctaattcttgcttttaaattatgttggaaataatggaaatctggaaaccaaggcactagctggttgtgtgaccttggtgcgtttagaagatgctttgcatgaaaggatcaaatttaaatgatttctgagattttgcgttactgtgaaattatatgttattaaggcattaggtgtattatttttcaaattacgaggttaaaagtcttattccatcattagctttaaaaaaatttttgatgcataatagatgtacatatttttggatgcatgtgataatttgatacaatcatataatatataaagatgcaatcagggtaactggaacatttatcaccttaaatatttatct

SEQ ID NO: 37511 - DNA, 1035 bp, Homo sapiens
aactgtagtcccagctactcaggaggctgaggtgggaggatcagttgagcccgggaggcggaggttgcagtgagctaagattgtgccagtgcacttcagcctgggtgacagaaggagacactgtctccaaaaaaaaaaaaaaggattctaatacttgatttgtctaacttcttcatgtaactgttgtaaaggtgaaaatgtcagtaattaataaaagtgctgtgtaactgttatatttttaactgttaatgttaagcatttttgtttttcctgttttagttctactcctttcaataaagaagagttatcagccattttaaagtttggtgctgaagaactttttaaggaacctgaaggagaagaacaagagccccaggtaaaaaaaaaaaaaaaaaaaaaaaaggcctgcctcagaatatgtgtcatatatttgacaggatgaaaggattcaagtatatttaaatattgtctttttaattataggaaatggatatagatgaaatcttgaagagagctgaaactcatgaaaatgaaccaggtcctttaactgtaggagatgaattgctttcccagttcaaggtagatttaaacaaaattttccttgtaattacataaattgagaggaattgagttatgtcatttagtggtttgttaatctttctttaagcataatcaggaagattgctgtgttatgtaaaaactactctctcttgttcagacaaaccagtagcaaactgatttgaaagagaccaaacccatttatgaagttacatttagttgggtggaaagagctgttgtttcctaattagcaactagaatagtgtttggcaaatagcatgtccttaaatacttaggtaaataaatgaatcagtgtgatctcttacttagatttccatgactgaaagctttcagctgatatttttttgaagcagtttttgacattaacttatcacaaataagaaaactcaagtaaatcagtcaaagtaagcaataagctactatatattgatacttaatatccctggtttgttgagg

SEQ ID NO: 37512 - DNA, 1039 bp, Homo sapiens
gtgatttggtaaatggtaatctaaaggacatcttgacctcacatcttaacccttcctggtacttctggaagataagtcagaagtgcgaaggcacagctgcaatccagccactgtagtgcattgaagggctaggatcagcatctagaattaatacattagaatgcatttgcttactctttttaaacctttggttgcttagttgctgctgcttctgatgtcattgttcttcagctaagatttttggagaaacactgtggtatagtaactagcaaacagagtgaacagtacttttttcctccccgatagtataacaaaacctaggtgtgatatggcaaagggtattttagcttcagtcatagagtgaaatggtaaaggtcttagaaaattttgaaaagtgaaataagttgttttctaacatgaaaatttaaaatctcaatttaaaataattcaggcaactaaagtgttacgtggacaacttaccatttatgtcttttaacatataacaacttgaattgtttctgtagcacttaattcgtagtagcggaaaattgattcttcttgacaagctattaattcgcctaagagaacgaggcaatcgagttcttattttttcacaaatggtgcggatgttagatatacttgcagaatatttgaaatatcgtcaattcccctttcaagtaagcatttaattgtatttgttgttttaaattttatctaattcctgtgcatattttacagaattaactgaaattattttataagtgtttaggtttttatataaactgtactttttctttaaaaagatgtatctgctttaaaaaatatttgtcattcccggtttttcttgactttacatattgcaacaaaacaatttttcttcctttcctgtgatttttattttcttttaattctgtctttttcttctatgcttgctttagattttaaaaactgaactaaggcagaattttcttgattggatagatctaaaagcaggggagcctttagtcttcaatctgaatgaggaaaacagccagtagtc

SEQ ID NO: 37513 - DNA, 1032 bp, Homo sapiens
tttaaaattttcacaatttaggaaattattgctctctcagcagaatcaatttcttgataccaatattcagtatcagtgttcaagttttctctgttgtctcaaaaaatttttttacgtttactcgaattgggattgagataggttcatatatggcaattgatttgtctctgagtttattatctataggtacttcttttttgttaaaatgtatacgatggggaaaacagttattctgtagaatttttccacaatctagattttgcatagtacttccctctaaaatagtttaacagtatcctctgtatttcctacagattggtaggtagatgtaggtgcttgataatattcaaattaataattatgagaagagtatattttgtagtacacaatggcgattatctaattttgttatggggttctttaaaaaaagtaatgcattttgtagaatatttagaaagaaaagtcaaagtaggaagaagacacattcacctgtaattctcttagtgctagtcatatatcatggatgttgaacttaaactcttcaaggtactttttggcaactaaggtaataagatactgccataaatttctggaaaaattcttagaatttttacctctagagaaattaataataaattttttctggataaggaaaaatattctttattcttgattacctcttagggcattgagcattgtccatgggtttcgttttgcttttcattccagttttggggaactgcctgtataactagtggtaaagaatggtaataaaagagtatgtacactagatatttgagactttcaagtcccttcaaaaactgaccttgtaaaaaggaagaaaataaaaggtggaaaaggtcatggtgagaggaaatttttcttttcttttttaaattcagcttttattttagatactggaggtatatgtgcaggtttgttacatgggtaatattgcatccaggtagtgagcatggtacgcagtgggtagttttcaacccatgttcccctccttcccccctctagtagtcg

SEQ ID NO: 37514 - DNA, 1046 bp, Homo sapiens
taaaatatcatttatttgctgttcactgacgtataactaagtgattagcaaaactagagttgtgagagaagtctatgaagaatattttccagagtgtttttgttttataaatatttcatttttagcatgagtaaaagcaacagtatttttgatagcgaatatagtttggttgatttgatcatctttgtattagggataaaacttgccatataagtacaaataaaaatactttataaattttgtctgcagtgaagattggcaaatgtctgggtcaggatctccatctcagtctggttcagattcagaatctgaagaagagagagagaaaagcagttgtgatgaaacagaatctgattatgagccaaaaaacaaagtcaaaagcagaaaacctcaaaataggtatggtctcagtttggtgctgaaaattgattgtggaaagtatttgttctttttgtatatagtttctcaaatcttgtttttttttctctttgcactttcctagatctaagtcaaaaaatggaaagaagattcttggacaaaaaaagagacagattgattcatctgaggaggatgatgatgaagaagattatgataatgataaaagaagttctcgtcgccaagcaactgttaatgttagctataaggaggatgaagaaatgaaaacagattctgatgacctactggaagtctgtggagaggatgttcctcaacctgaggaagaggaatttgaaaccatagaaagatttatggattgtcggattgggagaaaaggaggtagtttttaaaaaaccatttattgtttggttatttaaataatatttacaggagtagagggctgggcacagtgggtcgcccctgtaatcccagtactttggggggccgaggccgatggatcaggagttctagacctgaggtcaggagttctagaccagcctggccaacgtggcaaaaccccatctctactaaaaatagaaaagattagctaggtgaggtggtgcgcacctgtagtcccagctacttgggaagccgaggcaagggaattgctt

SEQ ID NO: 37515 - DNA, 1050 bp, Homo sapiens
ctataggtatgttgactactgactatagttaagtaaatagaagagtcatattgtccacccacaattttttttttcttttcttttcttttgagacagggcctcactctgtcacccaggctggagtacagttgtgtagtctcagctcactgcagcctctgcctccacctcctgggctcaaacgattctcccacctcagcatcctgaaaggcgtgcatgccaccacactcagctaattttaaaattttttgtagagatgaggtctcaccatattgcctcagctggtcttgaactcatgggctcaagcagtcctcccaccttggcctcccaaagtgttgggattacaggtgtgagctgccacacccggcctcacattttcttattcatagttggaatggaatggttagtaggtagaaatacctagaggaaacaaaggaaccaaactattcataaaataggagataagactcgagagtaaatcttctagttggatatgcagacagatcatgtgctggtatattctgactacttacctgttccaatattttatatatttttctgccatatctaaagcgaggaggagtaataagtccaatttgatactacaggtgaaaaaaaattaaaccttgtggccgggtgcggtggcttacgcctgtaatcccagcactttgggaggccgagcaggcagatcacctgaggttgggagttcgagaccaccttgaccaacatggagaaatcctgtctctaccaaaaatacaaaatgagctgggtgtggtggcctgtaatcccagctgctcgcgaggctgaggcaggagaattgcttgaacccaggaggcagacggaggttgcagtgagccggagattgcgcgattgcactccagcctgggaaacaagtgaaactccgtctcaaaaaaaaaaaaaaaattaaaccttgcgaaatcaaatttaaggaatcttttacaatgcatactcatcttaaataattgcaaagcatatttctttaattattcggagttgttaattctgctatacaggttttgtgtgcttctgaaa

SEQ ID NO: 37516 - DNA, 1028 bp, Homo sapiens
agcgttttcagaactttctcactcaagtgtatgaagttcttggtgataggagtgagggcttgattaaaggtaacctcctcccacccccccccccacttcatttattcgaccaagttatctaataagactccgttatctactcttgggatgtatgcatatgttacatcgtatcaccttgctttaggagtctataaaaacattgttagttgcagttagtctctaaaaatcctttcactccacaaatattttaattttttctgtccgaagtatattagcagtagcatactaaattctagttagcagtcaggagtgtagttattacaagtctagatattttaagtatttaataaaaggcccccacttcttccttaacagctgtagtctaattggcctacgtagatttatacgttttagacagggcttaatttaccttttttctgcaggaaattttgttaatttattaatatattttctttaggtgaatcaaaggagagtcccagaaaacctgtgactgttgaagaaaattcatctgtgaatttttatattcaaggagtcagtatttatattcatcttttaaactgggaagatttatattttactttaaaacttcttgataataatttacaatgaatggacacagtgatgaagaaagtgttagaaacagtagtggagaatcaaggtaagtaagcactttgttatcaattgtttactatgaagagagttgaaaacttgacttttttctttattgttattgttgttatttagttttcctcataggtagcagagttttcaggttttcctcttagctatccaaatactaaaaaaattctgatatacgaaccttttttcataatacaggttttaattatatttttcattcagatacacagtagatcttaaatatagaaagtttttgtttacttaaatctatttggaagtttatatttgagctaataattaagctggagcatgtataatagatttaaattgttttgactgttagtgaaatttctagatgaaggcaataa

SEQ ID NO: 37517 - DNA, 1048 bp, Homo sapiens
atgtctatattttcattccttcccatcaggtttttttaaatggtatatatttgttatatataaagttttggtgccacaaaaggaatagcacttgaatataaaattttctttttaattatcagcaaggcaacttacttttatagaagggtgcccttacagatggagcaatggtgagtgcacacttggacaagggagaggaaagcgttcttattcctgactcacgtggtccctgctgctgtgtcattcccccgttggctaggattagaccgcacaggctaaactaattccaattggctaatttaaagagaatgacagggggagtgctttggtgggagtcacggcaaagcaggtagcaggtaatctaaatgagttagggtggagcaggtgatcagaatgagtgagggtggagcaggtgatcagaatgagtgagagtggagcaggtgatctgaatgagtcagggtgtagtagttaatgaagaaaggttgctttacgaggaagttcactttaaaagtagaaagcaaagaattgaacatactgacatattaattatttgaaaagtaattttgaactcatatctaacatatttaaagtgtataatatgatgtgctgatgtacatctagtgaaacaattcctacatcaagcaaattagcatagtcatcatctcacataattacttttgtgtgtgtgtggttagttcttaatgaagttgttcatgtcttctcattggctatccttacacatccctagctgaataaagaaaatataaacactctgctaggactaataaatctatgtcaggtctacttttatttttgcttctctaatgaaaccctgaatacaatttgagtgcaatataataccacaggaatcttctgagtgaacaagtttcttttccactcctgagttgttggaaattcacagtaattatgaaatattaaaacctaaaaaaaatatgagccttcaaactccagctatgatacacttctggttaacagtcaaagtttaatatatacgatgaaaccaaattttcacattttttaaacaaat

SEQ ID NO: 37518 - DNA, 1027 bp, Homo sapiens
ttacttttgcacctactacctcaagtggagtgtcctagctaacatctttccgaactgtcccttagacttattggctatgagacacaaataagtttctaaaatatatttgagttagcctaagacaaaaatttagaaatctactgctgaacattttcctcaatatatataaatgtctcctttgtataaatttgtagacgttaatgatcacagatagagattttgatgtaacgcttcaaaaataaaaatgtagtttcaatttcttccttaggttttatatctatatgaataccctagcttgtgtaatctagtgacaatctgcaggaacactattcaacctgcctacacaccttaatctaattaaaagaacaaaaagtttttatatcaacatttaaaaagaaagacgacgtgtgcatcgcatggatccatgttgtaggagaggcagtgagatgtgacagagctgtcaattttcagaggcatttgtggtgctgagcagcacttaatgttgtgtagatttagaagctaaatcactaatgtgaataggaaaattagaactttaaaatgacttcgtaataaagaaaaaacttactgtttccgttaaggtaaatattgagtatttgtactaatttatcatatgggatcatattaagaatgcctgattataacatttgtcagattaattttgttttcaaatattacttttttaacaatttaaaatgttatatgtacaaaccgcatctttctgtattgctaagtggtctcacttgtcagctcataaacattaaataactagaaaatcattggtagtgacaagtagaaaatatgatggaaaatgtgaataagaaattgtgtacttatgaacttcctgaattatcaacttgttaataacctgttacaaacaaaatgtattggtaaagtataactacgcctattagggctcacggtagtaagaaagagcaccatcttgacaatcttagtattatctgagaggaaaagatatcataggtttgaggcctgggcttaagtcgtt

SEQ ID NO: 37519 - DNA, 1041 bp, Homo sapiens
taatggattactatgtcaggatattttggctagaaacaaacacggcaaccaagataggaatcagccaatttaaagcatctagagagcaactgatacttaaccatatttctcagtattattactaagataagtatataaatcacagttcttcttgaacaattcttcttataattcaaaaatacataaaaataattcagttggcagaatttagataaccacatccaccttttcactctatcatggcaggatgagaatggatttaatagtgggactatctggcagactttagggttttgtgctagcaaaatagaacactttgatttatcaccctacaaagatgataggcaatgaattggatgcagtaccccaccttaaaaatgaacaaaaaatgatattagaataaaaaataaaaatattcactcttttgacatttattgaaaataaaatttaacaaaggaagtgctacgtgttttatttcttcctggacacataaggatactatactggctaacatctactccctactttgcatctaaatactaccaaatactggaatgtggataaaaatatcaaatattccaggtctgaatactaaggtatctgccatgattgtccatcctgtctcttttccttatacaaggagttggaagtgaaagaccaggaggtaacagatacaaataatagaagaagatgcatccttactcctggaggaaaacatttaagaaaactatctgaccagaatctgactgtcatgcaattaggaaccagtctttattgagttaagtcactgacttctgtttcttattttaactaatacatgaaaataattatatttggaatttaagtaatgaacgtggcctatcactcatggaaactctctttttctttcttttcctttttttctctctctctccagtaaaccaaattgccttgattgtgtacataagactcaacaactgttactttgtctgaatttccatttttaaaatacgagatatgcttcctaatataaaatataaagttattcaagtggatacaaac

SEQ ID NO: 37520 - DNA, 1035 bp, Homo sapiens
ttggctatgccctgtccccagaggtggagtctacaaaggcaggcaggccttcttgagctgcggtgggctccacccagttcgagcttcccacccactttgtttacctactcaagcctggcaccccttccccagcctcactgctgccttgcagttcgatctcagactgctgtactagcaatgagtgaggccccatgggcgtgggaccctccgagccaggcatggaatacaatctcctggtgtgccatttgctaagaccattggaaaagatcagtattagggtgggagtgatgcgattttccaggtgccgtctgtcacagtttgcttggctatgaaagggaattccctgaccccttgcgcttcctgagtgaggcgatgccttgccctgctttggctcatgcttggtgcactgcacccactgtcctgcacctactgtccgacaagcaccagtgagatgaacccagtacctcagttggaaatgcagaaatcacccgtcttctgcgtggcttacactgggagctgtagactagagctgttcctattcggccatcttggaaccaccccccaaaaccggtaccagccactgcaaaaacatgccaaattgtaaaaaccatcaatgctacgaagaaactgcatcaaataatgagcaaaataccagctaacatcatactgacaggacaggatcaaattcacacataacaatattaactttaaatgtaaatgggctaaatgctccacataaaagacacagactggcaaattggataaagagtcaagacccatcagtgtgctgtattcaggaaacccatctcatgtgcagagacacacataggctcaaaaaaaaagggatggaggaagatcaaccaagtaaatggaaagcaaaaaaaagcaggggttgcaatcctagtctctgattaagcagactttaaaccaacaaagatcaaaagagacaaagaaggccatttcataatggtaaagggattaattcaacaagaagagctaactatcctaaatatatatgcacccaatacaggacca

SEQ ID NO: 37521 - DNA, 1034 bp, Homo sapiens
aatgttagctttaaataatagtataaatgtagcaaactcaaaacagcctatgtcataaactccagtacactgtagcaaaacaatactcatattacattaatgatattagcttgaattttattcagtttgaagctgctggagctctgaaaatgataccataaactttggcacttggacatgctaagtgctttgaactaaaacatgttggagaggactcagaagcagagtcactctgaccttctcctgccctccattctccttgctcctctttctctcccaaggcaagttgtagaatctagaattcctcttccccaatgtggatcatagaaactagaactcctctcctccaaagttagccatgaaccccagaaatactacttcagccttccttcacctttctgtgtaagagctggccataaagaaatggacttgccttgtctgagagcagatcataatactctcattccagaaagggtccggccttatacttgggaagaagaaatgtcacacagagaagccaagaagaatccgatcagacaggccttgctgggtttgcccgctcaatctagtactattacattatttcgtttttgtttaatcacgtgtctccatggctgttcacttgttattgaattcaagcataaaaatgcacggtcttcccttgagtctttaggtcttcatttctcaaggctcctgtgtcatataaaagtttcatcaaataaatgtattatgcttttttcttgttaacttgtcttttgtttgaagaatgtagctaagatccttacgatgggaaggaaatgtatcattcctttccacctctacaaagcttttaaaaaatttgatttttaatagtttgtaatttaactttggttttatttctttataagggccctcagttaactcatatatgagaaacactcttatatatcttctacccctctaagtcatgcagctcaatttaacctataaataagtacattcaagtggtatgttggacagcataaaaatgagcaaattgtgagcttctggcaaaa

SEQ ID NO: 37522 - DNA, 1040 bp, Homo sapiens
atatgttaaacctggaaaccactatggctatatgctaaatcttgacatctagaattatttttccacattattcttcatttgtaaaaacactattttagctctattgttttttatacaatttttagaataatattttctatatttgcaaatatttttgttgagttgggaatcttgcttactctatatatcaatagggggagaactgaattatttactatgttgagatttgcagtccattttatcgctctccattaaaaaattttcttgacttattttatagttttcagcatacaaaccatgaatcttcttttttagatttaaacttaaatattccatcttttgtgcaattataaatgatattgtattttaaattttattccttacttgttcattgttagtagaaagaaatagaattgagtttttgtgttctctcttatctttcaaacttcctgagctcacttttaggatgttttgtttgattctttttttttttttatgtagactgtcatgccatatgcaagaagggatagttacatttccttctgatgtttatgatatttattaccttttctctccatatttcactggttagaaattccaatactatattgaataagattgtgagaacagactgctttatttccaaccttaagagaaagcaatcagccttgctaaacaaaatgtgttagctataggggttttttttttctttttgatagatttcctttattacacccctctgtttctatttttgaaaaattttgtcaagaatcagtgttgaatttgtcaaatggtttttctgagcctttttttatgatcatatggttttttttaatcatttatatgatgaatcgcattaatagattttgaatactgaaccagcattgcatccaatggtggttttgatttgcatttccctaatgaataatagtgttcagcacctttataggtgtttactggatatatatatatatatattatatatatatatatacttgtaaagaattctatgaagatcccttgtccattttgtaattgtg

SEQ ID NO: 37523 - DNA, 1111 bp, Homo sapiens
caagtcagtggcataactactataagaaaataattattcccagtacatttatgctgtatgcactaaatttgtgggatataggtatatatggaggtatgaaaacaatcctctgattgcttccttttttttttcaatgaaacagaaggcaaggagatcagttgaggatgagggtcagtgtgaatgtgttggagctgaattgggaagaagtaagagtgagtggaccatagaaatgagatgtgatttctgtatagcactagaatcacacttgaagtgagtagagatgtatttaaagagatgaagatataagatgaggttagcagttgtgtgtttttctcaagtaaggaccacttgaagatcggtgttctaggtagacaattggcttaaagcaggatagggtttgccaggctagtatcacaaacgaaaaaatcatatgtctggcagttgaggttgtatgcaagagaatagtgataacgatggactgcgaaacttaaggtggatagtgagggtaacatgaaattaagagtattggcagtgaaaaggtcattctactcaatgaataacaggatgaagctgggtcctgaagtgaatccccatctgctgaccgtagaacctgagaaatcagcaacttagctatcatcctcctgtgtgtacagtagtcttcctaaagcctccttgaggcatggtactgagcctttggcatgccttatgttctgaagtatttacaagtggtagcttacgtttacaagctactgagattattaatttttgttcattcacaggacaaaacttcttggtggtttttaaaatttttaaaaagtctgtgtataaaaatagcccaaaagaccattatatggattccttctaagagaagacaatattatatgtatcatcagatatttcctagagagtctatctacaaaatgtgaatagcatatattcatcattctagattcggtaataataagtacctagaggtaaatggatgaaaataacttctgcatgggctagctaagatgcaattctatagcacatttgtatacaacaaagctaaatattagaatacaagttattatcttttttttgcagctataccagctgtgccacttgcttt

SEQ ID NO: 37524 - DNA, 1051 bp, Homo sapiens
gccaccgttagaattttcataacagcagtgggagagggaccatgatctgttctttttgttcttattattcttttttttttttttttttttttttgagacggagtctcgctctgtcgcccaggccggactgtggactgcagtggcgcaatctcggctcactgcaagctccgcttcccgggttcacgccattctcctgcctcagcctcccgagtagctgggactacaggcgcccgccaccgcgcccggctaattttttgtacttttagtagagacggggtttcaccttgttagccaggatggtctcgatctcctgacctcatgatccacccgccttggcctcccaaagtgctgggattacaggcgtgagccaccgcgcccggcctgttcttattattcttacttccccatttgctctgctgtttctggcacctccagaaagggatcggggtagagtcacctagagtcagggtgaattaaattcctctttgtttggagctgatgtaatttggcactgtatgttatatgaccaaattttgtctatctcttgcatgaaactcttttgcttattttttgaaatgctttctttgagggctgctgcactgaacttattacctgttgtaagtaatgctctatttaaataacttctcatatggcctcctatattcctaaccactagcacttcagcatttctattagaacaggggtccccaaccctgaggccccagacctgtacctgctcattgcctgtagggaaccaggctgcacaataggaggtgggtggtgggctgagttctgcctctggtcagatcagccatggcattaaattatcttttttttttttttttttttttttttgagacggagtctggcattaaattatcttaagagcatgaaccttattgtgaaccacgcatgtgaggatccaggttgtgtactcatgagaatctaactaatgcctgatgatatgaagtggtgcagttttatccacaaatcattccccttctgccccgcatctgtggaaaaattatctcccactaaaccagtccctggt

SEQ ID NO: 37525 - DNA, 1025 bp, Homo sapiens
tataaaatgcaactacgcatcaagtctacataacaaccagctagcaacactatgacaggataaaaatcacacatatcaatgctaaccttgagtataaatagtctaaatgtctaacttaaaagacacagtgtcagactggatacaaagacaagacgcaaacatctgttgtctctaagagacccacctcgcatataatgatatccaagggctaaataaaagagtggactaatatgtagcatgcaaatggaaaaccaaaaagagcaggagtctattcctgtatcagataaaacaaactttaaaccaatcaaaattaagaaggacaatgaagggcattacataacgataaagggtacaatccaacaagaagccttaactattctaaatatatacacccccaacattggagcacccagattcataaaatgggttcctggccaacaaaaagacttagacaatcacagaataatagtgggagacattaacaccccactgacagtgttagacagatctcggaggcaaaaaactcacaaagaaactctggacttcaacttgacacttgaccaactgtacctaatgacacctacagaatactttaccctacaactacagaatatacattcctctcatctgcacatggaacatattctaagatcaaccacatgcttggtggtgaagcaagccttgataaatccaaaaaaattaaaatcataccaaaccaaacacactcttggaccacagtgcaataaaaaatagaaatcaataccaagagtatctctcaaaatgatacaaatacatggaaattaaacaacttactcctgaataactcctgggtaaacataattaaggcaaacattttttaaaacttgaaattaatgtaaataggtacacaacttaccaaaatctctgggatgcagcaaaagcagtgttacaaggaaagtttatagctcgtaactccttcatcaagaaattagaaagtctcaagttaacaatctattgttacacctaaaggaactggaataaaaaat

SEQ ID NO: 37526 - DNA, 1055 bp, Homo sapiens
aaaaaaagaaagtgctgaattcacttgcccgttttcattccccttcatgagtgccacggaccatagctgcttctaatcggccatcttggatcatgcgaacagtactgtgttcagcatcatttagtattatttgctagttttcttcattttctgaggcttcctgctgcagagatttggaagtaaagagcagcttttatttaaataattcttgaattcttagttgattaataaggtccttttgtattcactattttttattgaattttaggtagtacagcatatgcatacctaactggatatggatatgcaattaggaaaatgtatcatttaaatgtgaggtgcttttaattttctgtgcaaactttcatgatcctaaaatatagacataaacaaagagctaaaattgaaaaagcaaaagaaactccatagtgttttctctgcaagttctttggaatttccagtaacctttatatttgactatcacatcagcaggttggattaaagcagactgtaatttcattttaaaagtataagctgttatttaaaaaaatagtttaaaaattgtgccattctttttttataaggacattcatttattttgcaattcattttataaggacattcaaatgtcattgattttcctatcaccaagggtttgtctttgctagttcttatattaatggccaggtttctaaaacagactaataagataatagctagtaaagcaaaacaaagccaaaaatgaatcaatcaaccaaaaaataaagacagaatgcttggtgtcttggaaggtaatttgtatattctgcaaagtgaagagttgatgtcaaatcttgcatcattaaatgacttttctcgggaattatcttgacacaattttgaagcatttttttccattagctaaccaatttccacctaagtgataaaatcaagttcaacttgatagttatagcgacaaagattatgctgtcaaatcagatggacctatgtgaaggcattgtttttttagacaaatatagaaaattaagtgctaaagagaagcacaaaaataaaac

SEQ ID NO: 37527 - DNA, 1077 bp, Homo sapiens
ttatacccttgttgtctcccaattttggagggacaattgattacattaattgtcttcaggttagtttctttgcctcattatccactcctgactttgccattttgtagaataagtccccctgctttctgaaggcttagcgggaccacgtgttctctcttgttttaggattctgtcatcctcattgagtacatttgtattgaactctccaactctgagccctagtctatgggagaaagtcatgcaactgcatgagaggcacctatgaattctctctatattgcaacttttttgaaaatttgaaattattcaaaaataaaataaaggttattaaaaatgaaatgctaatcactattatgtaattgatacgattttatatacattattcaaagtaacacttttaatacacattgtaattgtcttgtatgtaatacaatctagtagaattgcatttttttctaacataattatgagtatcattaattatagttgctataggcattatgatgtaatattgagaaacaagtctaaaattgtataatcaattcaatcttgtcaatggctgtatcattaagaatctgctaaactaagtagctaggtcaattggattataaaagatgtcacttcacttttttgattacaactgagtagaaggcattccaggataggctgggtgcagtggttcatgcctgtaatcccagcagtttcaaaggccaaggagggtggatcacttcaggctaagagtttgagaccagcctggtcaacagggcaaaatcctgtctttactaaaaatacaaaaaagattggctgagcatggtagcgcgcctataatctcagctacaggctgaggcatgagaatagcttgaacctgggaggtggaggttacagtgagccgagatcacaccactgcactccagcttgggtgacagagtgagactcttgtctcaaaaaaaaaaaaaaaaaagaaagaaagaaaagaagaaaagggcattccagtgtactttttactgatccaccatgaaaaaaggcaaaaaggcattggcaccaccagtgatgacaaaaatgacaactttccaacaa

SEQ ID NO: 37528 - DNA, 1048 bp, Homo sapiens
ttaacattttaatgtccttcctgggacttctaatagcaaatattgaaataattagaaataaaatcagatggttataaattcagaggctttattcacttacttaacccctgcaaataaaagacaaaggataattggagtctgttatgctataggaattatttttaagaagttaagattgttagatttgtttgttaatattgaaaattagtatttgctatagtgtggatgtttgtccccctaaacctcatattggagggaggtgtttgggtcatggagatggatcattcatgaatacattaatgccctgggaatggggtcagtgagttctgtttgttcccaacaaaactgtttgttaaagagagtttgagctaggcgtgggggctcacgcctaaaatcatttcggaagactgaggcagaagaatcccttgagctcaggagttagagaccagcctgggcaatatagtgagactctacaaacaaaaaaagattctggcccctcccctgtagctctcttgcttcctctctccccatgtgatctctgtgatctctggctagctgccctttgccttctgccctgagtggaagcagctagaggccctcactagaagcaggtgctggcagtatgttcttgtacagtagaactgtgagccaaatcaatttcttttctatataaatacctcaggtgttcctttttagcaatgcaaatggactaagacaatattaaagtattaatctttcccaagatcaattttccaattctagaatgataacaaacaggaaaatattctcaataacaaattatatattacacagcatggttttagaagtgcacttattaggtaagtaggcttcattttagaagtaaaaatagaatatgtaagcggatgaatggagagtatttttaaaatgtggtagagtttggaatgaataagataaggagaataagttatcagcagagagagcacttacatagattctagcacattatctgagattggacaagactgcacaaggcaacttgacataatttcactgggaatagttttag

SEQ ID NO: 37529 - DNA, 1032 bp, Homo sapiens
aagtaattataattacacacacacacacacacacacagattttttgccatgtaaaataccttggatttatcattaatgtttcatttctaaataatacatagcaggcttaatataaagacattttgaaataaaactaatgagtctccttgcagttattgatttaatttttattttatgataagaacttttgtttatgactatttttctgaaagattgtttcctgtcttcaatactcacagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcggtatgtatatattactcattattattgtttatttaatatataagaaaagtaattttggaaagattttagaatattgtagcaaataatttactctgtgtttcatggtagcaaatgcagaggaaaagttgttaaattgacacaattcatgtgtataattatttctcttttagctaacttatttgcatagagtatgtaaatatcacattgtttaactttaatttaaaacaatgtatttacctaatttaacacacatagaaacattataaatataggaaaaaaatattaattttaacagatttgattataatgttaactcattataattggtcataggaatttattaactatttacatccatattgcttaatttgactatgagaaagcatgagtgtcatcaacaaaggagcataataacttttagaatttcagtatataatttttattattattctaaacaaaaccaacatttattatttatgcgttcttcctaaatatatgaaatccatttaatattcatttgtatcatagtgcagaataattgttttgttattttcaattttttttttcaagacgctaacaaaaaactttaaggcgtgaaaagcctg

SEQ ID NO: 37530 - DNA, 1053 bp, Homo sapiens
cagcaaagtttctggatacaaaatcaacatacaaaaatcaataatatttctatacaccaacaacagccagctgagagccaaattagaaatgcaattctattcacagtttccacaaaaagatttaaatacctaggaatgcagctaacccgggaatttacagatctttacaataaattacaaaacactgctcaaagaaataagagatgacacaaacaaatgggaaaacactccatgcttatgaataggaagaatcaatatctttaaaatggccacactgcccaaagcagtttacagattcagtgctattcctattaaactaccaatgcaattcttcacagaactagataaaaactattttaaaattcatatggatccaaaaaagagctcgaatagccaagacaatcctaagcaaaaagaacaaagctggaggcatcacattacccaacttcagactatactacggggctacagtaaccaaaacagcatcatactggtacaaaaacagacacatagaccaatggaacagaatagacagcccagaagtaaggccacacacctacaaccatctgatcttcaacaaacctgactaaaacaagcaatgaggaaaggattccctattcagtaaatggtgctggtatgactggcaagccgtatgcagaaggttgaaactggactctctctttataccatatacaaaaatcaacttgagatggattaaagacttaaatgtaaaacccaaaactataaaaaccctagaagaaaacctagggaataccattctgcacataggaactggcaaagattttaggacgtagactccaaaagccattgcaacaaaagtaaaagtttacaaatgggatctaattaaacttaagagcttctgcacagcaaaagaaactatcaacagagtaaactagacaatctacagaatgggagaaaatatttccaaggtaagcatctgacaaaggtctaaaatccagcatttataaggagcttaagcatttataaggagcttaaacttagaagaaaaagaaagccccataataaagtggg

SEQ ID NO: 37531 - DNA, 1028 bp, Homo sapiens
ggctcacgcctgtaatcccagcactttggggggccgaggcgggcggatcacgaggtcaggagatcaagaccatcctgggtaacacggtgaaaccccatttctactaaaaatacaaaaaattagctgggtgtggtggcgggtgcctgtagtctcagctacttgggaggcttaggcaggagaatggcatgaacctgggaggcagagcttgcagtgagccgagattgtgccactgcactccagcctgggcaacagagcgagactctgtctcaaaaaaaaaaaatcaggaaattcaaagtacccttgtgagatattatacaagatgactatccccaagagacatagttatcagatcttccaaggtcaatgcaaagtaaaaaacactaaaggcagctagagtgaagggaaaggtcacctacaaagtcaaccccatcaagctaacggtagacctgtcagcagaaactctacaaccagaagagattgggggtctatattctggaattttaaagaaaagaaattagaaccaagaatttcatatccaaccaaactaagcttcataatccaaagagaaataaaatactttttagacaagcaaatgctaagggaatttgttaccaccgagcctgccttataagaagttcctaaggggatgctaaacatggaaatgaaacaccattactgaccaccacaaaaacacactcaagtactattgacactataaagcaaatacacaatcaagtctacataacaaccagctaaccacacaatgataggatcaaatccacacatatgaatattaaccttgaacagaaatgggttatagctcccacttaaaaggcacagaccgtcgagtcggataataaagcaagacctaactgtatgctatcttcaagagacccatctcgcatgcaaggacacccataggcttaaagtaaaaggatggagaaatatctatcaagcaagtggaaagcaataaagagcagggattgctattcttatttcagacgaaaccaactttaaaccaacaataa

SEQ ID NO: 37532 - DNA, 1023 bp, Homo sapiens
cattgtagattctggatactagccctttgtcagatgagtagattgcaaaaatattctcccattctgtaggttgcctgttcactccagtggtagtttcttttgctgtggagaagctctttagtttaattagatcccatttgtcaattttggcttttgttgccattgcttttcgtgctttagacatgaagtccttgcccatgcctatgttctgaatggtattgcctaggttttcttctagggtttttatggtttcaggtctaacatttaagtctttaatccatcttgaattaatttttgtataaggtgtaaggaagggatccagtttcagctttctacacatggctagccagttttcccagcaccatttattaaatagggaatcctttccccattgcttgtttttctcaggtttgtcaaagatcagatggttgtagatatgtggcattatttctgagggctctgttctgttccattggtctatatctctgttttggtaccagtaccatgctgttttggtactgtagccttgtagtatattttgaagacaggtagcgtgatgcctccagctttgttcttttggcttaggattgtcttggcaatgagggctcttttttggttccatatgaactttaaagtagttttttccaattctgtgaagaaagtcattggtagcttgatgggaatggcattgaatctataaattaccttgggcagtatggccattttcacgatattgattcttcctacccatgagcatggaatgttcttccatttgtttgtatcctcttttatttcgttgagcagtggtttgtagttctccttgaagaggttcttcacaaccctcgtaagttggattcctaggtattttattctctctgaagcaattgtgaatgggagttcattcatggtttggctgtttgtctgttactggtgtataagaatgcttgtgatttttgcacattgattttgtatcctgagactttgctgaagttgcttatcagcttaaggagattttgggctgag

SEQ ID NO: 37533 - DNA, 1054 bp, Homo sapiens
gtttgattatggttttgttgtaatcaaatacctaaagttgcttttttttttcacttttctttattaaagcactacagtcaataatggtagtccagaatggctatggacttggtggattaattttctttttgccgctgtcgttgcatggtgtacattaataccattgtcatgctttccaaacaatatgccaggtgactataaaatgtaatttattaaattggaggatagtagtttcttccaccatggttcttattctcatagaatgactgtattacatttttaataaaatgagtatgcctctcgctgtagtggtttgtcatagagatacagtgtcaagtgctagtgttatttaagcaaataaagcagcattacagccaaatattatttgatttatgtaccagaatttcttcttctttgtatttagttttgagacagggccttgctctgtcactcaggctgagtgcagtggtatgatcacagatcactgcagactcaaacttctgggctcaagtcatcctcctgcctcacctccagagtagaattggactacaggtgcatgccaccatgttcagcaagtttttaaaatttttcctttttgttctagagatggagtcttgctatgttgtgcaggctagtcttaaactcctggcctcaaactatccttccaccttagcttcacaacgcgttgagattacaggtgtaggccaccacacctggaccagaatttcattagaattagtgcatatttttgtttctcattatttccttttaaagatgctttatatctagagttcatacagtgtcttgaaaacaagcatatttaaatctacttacctagcatttaatgtattgactaccttagaattgtaagataaaataataactgttaaaattttcttagaaacactgaaaaatacatgtaaagtcaaagaaatcaaataactctcctgattatagtacatttcattggcacaaaatagttttagttatatcaaagattattccctcatattttagggcaaatcaagtgtggctaaattttaaaataaattaa

SEQ ID NO: 37534 - DNA, 1023 bp, Homo sapiens
aaaagtctgtagttatcaagaaaaatagtacttatagcacccagatatctaacattagtttcaacataggacctgtaaatcttatattgtgaaggaaagatgtaacaagcgtcactgcaatattataggtggtagcatattagaaattgtagcaaaatgtcactactgtctatcagggaggaagtaaaaatcatttaccaggaaagcaaagcaaatgagaaaccatttactaaaagagaaaacagttctatatctcttaatagttgaggtcatcttatattaagctacattattataatttgcaccatcatgcggtttatctacttcataggctcatttgctaaaaggattatatgaattatcatcaatatgttactttagtgagtagttcttcctacatgtttagagcatttagcggaaatagatattacatagagaatataaaagagcacctcataaacattcattgtttaatttaagctggtttcttgaatatcttaagcacttggattgctgaactcatcagggaatgctttagttggtagctatatttcattgcctgtatcgaaattttatactataattacttgctaacttttaggaaacatgtaattaatatgcatacattttaagattcaaagataatttttttcacatttaatatttctggaattgagatagttttataactctgatcgacatcatctataaaaagatttttaaaatcagtgatctgtctcaggaaaatacatacaaccatgttaatttcagtatggtcagagcaaaaattgaaaaacaatccaatacccatcaatataaaagaaagtggttaaataaattatagtaaatccataccatgaaattctatcatgcatggtactatcataaaggtagccaaaatgaattaagtgtgatgttttctaaggttaaatgagcaaggtaaacaaatatccacaatttctacttaaatacttagagtacaatttttgtagctggatgacagtgtcctacattatgtaataa

SEQ ID NO: 37535 - DNA, 1075 bp, Homo sapiens
ctgcattagtttgcttaggattatgggctgtagctccaaacatgttgctgcagaaggcatgatttcattcttttttgtggccacataatatttcatgttgtgtatataccagattttctttgtccaatccatcattataggcacctaggttgtttctatatctttgatattgtgaatagcactgtgatgaacataaagtgcatgtatctttttggtaaaatggtctattctcctttggatatattgcctgcaattggattgctgaattgaacggtagttctgttttcagttctttgagaaatgttcaaactcctttccatagtgtgcgtcatgtcctttcctttccaaagctttctcaagagagtgaggcactttgttttttcagataaacttctgacaagttactgagtattaagaaagtcacactgctatcctcatttgtttatgaagtaccaagaaagttggaaatctttttctaaggaaatctattatttctacaatgactttgacacaattgaacaaccctgtttggtttaattgaggatactacgtgatatggcttggctctgtgtccccacccaaatctcatgttgaattgtaatccctagtgttggaggtgggacctggtgggaggtgattggatcatgggggtgatttctgatggtttaacaccactccctagtcctatcttgtgatagagttctcacaagatctggttgtttaaaagtgtgtggcatctccctctttgtcttcctcctgctccaaccgtttaggacacgctggctttccatttgccttgcgctgtggttgtaagtttcctgagtcctctccagccatgcttcctgtacaacctgtggaactgtgagccaattaatacgcttttcttcataaattacgcagtctcaggtaggtctttatagcaatgtgaaaatgaactaatacactatgcataggtattaaaaatatgtgacaatttatttataatgccatagacattttctctctacaattgtgtatagtaagtttattaatatatttgattagcacagaattgaactagggtgaagtctgtttt

SEQ ID NO: 37536 - DNA, 1050 bp, Homo sapiens
aaaagtaatgtaactgtacattaaaaaataactgaaagagtaaaattggattgtttgtaatataaaggataaattgggtgatggataccccatttgccctgaagtgattattatgcattgcatacctgtatcaaaatatttcatgtaacccataaacaaacacagccactctgtacccacaaaagttaaaaatttaaaaagatacttgatagaatttctacttttaaaaatttgtcacaacttgttttgtagtccaagatatggtctatcctggagaatgttttatgagctgatgaaaagtatttgtattctgtagcagttgagtgaagtattttgcaaatgtgtatcaggtccatttggtcaagtacgtagtttaaatctgatgtttctttgtggattttctctccgaatgagctcttcattactgagaatgtggtgttaaatgcccctactattattgcattgcagtctatctctccctttagatctattaatgtttgctttatatacttgggtgttcccttcttgggaacataagtatttataattgttatattctcttacttgtaatatccttcatgattacataatgaccttttttgtctcttttacagtctttgacttgtaatctatttcatttaatataagattagctactactgctcttttttagtttctatttccatggaatatcttcttccataccttcccttttaatctatgtgtgtcttcatatgtgatgtgtgtttcttggaggcagtatatagctgagtcttctttctttacctattcagccaccctatgcattttaattagagaatccagttcatttacattgagatgttattgataagtaaggacttatcgcctttttgttgttggttcttttctggttattttgtaactcctcacttcctgtcttcttttttcactgtcttcctttgaggataattgtttttttctggtggtatcttttaatttgttgctttttatttttagtatataaatatgtattagtctgttctcacgctgctataaggatatacctga

SEQ ID NO: 37537 - DNA, 1033 bp, Homo sapiens
ttgtcattagattgcatgtaagaactgaaattctccatgctgacccaatctcaatctttgtatggtcttcccttccctcagagtggattgttttcttgcttcgtctttcccatgattatctgatgcctactttcaaagaagccctccacatctttgaaatcaatagtctacattcctgaggttgcaggccttctatgttattttgaatccattgcttccactttgtgcctttactgaaagaaaaatttagaaacatggggagttttcttggcatcttattattttcatattttctctttccgtaaaagatgtttcatcccagcaaataaaatgcaatacagttttcaaagtcaaacaaaacccagcatattcacatatggtatttcctttctaaatatttcttgtctcctttaacttggcattctggttgggtcggtgctgagattcatcaatattattttgtgtgatttgacgaaacccatttccttagctcctatcccagagataatttttgttttgtttttctttgtgctctgaacaggcaaagccttcttagctgtcatataatctttagggatgctgttgggctcttgggagaaatattcctttattcaaagaaacgatctgtcagggtaggctagactcagcagcaaaccctggtagtgtttgacccatcacatcaagaaacttagcagcacttgtatgattgggaaggagaagaaggggatgtgaaataattgtattatcagggtctctagcctctctgctcctgtgctaaaaagatactagatgagtagccccaggagtaagtaatagtgaagagaaatgctttaaagtattttctcaaacttagcaaactttgtggactcccaaaaaggcataagaagataaaaggctgagtgatatgttcttctcaccaattgggtgattaaatgtctgagctgggggaaaactcttaccttacatgggccctataagtaaaggaaaaaaaggaaagcatttggctgtgatgttgtaagagaatagttatact

SEQ ID NO: 37538 - DNA, 1099 bp, Homo sapiens
ctctttttgtggctgatatccagtttggtgaccagtaatctcagggtcttttcttcatctcaggtcattaagaccaactaataggtgagaatgtggtaatttatgaactctgagttataactgataaggaagactatttatttcctgtttactggtttttatagtaggtcatggcttaaaacctctgattattctgaaatatacatgcaatacacaaaataacaaattttagatttttaggtatctgcaactacattgtaggagaaatctcgaaagcttcacctcactttgcagaagactcctagccatggatgaggctggcttcatccaggaggagttaggggaagatgccagagaatgtgaattgctttgttgctcagtgccctgggcagcatcttgtgtaggtgagtttcctaaattctgtataaagtgaggacgatggagagtctacctactgccttcatcaggcattccatgctggctgcaagcaacgttattcagtaaaaatctcaccactgttaaagcaaactaaatgtggcctgagaaggactccatacttctatacttgagtccttgtggatgaactgtaacctagcttaacagtcagacaaaattggaaacctaacttagtagtatgcacctgtaacaatagctgaatgttagccaatcccagcagccatacttcaaccactcatagactgctgaatgttcaaactgcctgcaaaataaggcaaatgccgagttgtaaccaatctcactgtttctgtacttcacttctgattcctgcacatcactttaccttttttgtctataaattttttctgagcacaaggcacccttggagtctctgtgaatctgctgtgattctgggggctgcccaatttactaatggttcattgctcaattaaactcccttaaatttaattcagctgaagtttttcttttgtcaccacttaccagtgactttgtaataaaaaaaaaaaaccttgtagaagctggaaacaaatgctttgccttcttccttgtggttatttgttaccaacctgcagaggtatattcatattgcagaaatcacgtgtagctgtgaatacactgtggt

SEQ ID NO: 37539 - DNA, 1050 bp, Homo sapiens
tgcctgcggtcccagctactcaggaggctgaagtaggagcattgcttgaccccaggaggtcgaggctgcagtgagccgcgctcatgccacagctctccagcctgggcgacagggcaagacctgtctcaacaacaacaacaaaagtatccgttaagaattttttctgcaatcataaaatcataaaataaccagtatcaaagattttaaactgtaatttctatgatattcataaatataaaataaatattgttcaataaatatttattctaaagcactatgaaaagaactgtgggaaaagtaaaagatgagtcaaacgtgtacctcattcttataaaggacttactgtctggtaggtaataaactatgtaagccatgtacagcacaagttaaggcatgctaaattgcagaagacaggtgtagataatgtacttagggaggcaaaaagagagaagttgtttttacataggaaatttgtgtttatccttatggaagaaggatcatttaagcttgaccttgaagaatgtataggatttggtaaatggatacaaaagaattaggggagaagtaatacacagaaatggaaaagtattgtaatgattcataaaaaggcagggcttcttgttgtctacactgcctcgggtataaagtgaagaagcaagataatgagggataaagctgaaaaggtaagtaggaaaccttatggagagctttgaatactattaaggattgatatgtgcccctcccaaaatttgtgttgaagtcttaacccccaccacctcaaaatgtgaccttatttggaaatgaggttgttgcaagtgtaattagttgagatcatatttcaatagggtgggctctaatacagtattactggtgttctgataaaaggggaaaatttgaacacagactcaaggagaatgccatgtgaagataaaggcagagtttaagattatgtttctatatgccaagaaatgacagagattgccagaaaactaccagaagttaggggagaggcattgaatacatttttcctcattcctcagaagaccaacc

SEQ ID NO: 37540 - DNA, 1077 bp, Homo sapiens
aaacgttatccatctgactcttttcagatagcttaaaatgtcaagaagtatattttcagatttcctataacctttaaacagccagcatataaaatgaatattgaagagaagagatcttgattagtttttacttttgaaaactgtaaagctagttaaaaataatagtgctttaaaaatacgttgttattagatatataattatttttaagttttcttaatattttcagaatgaaacaggtggtaatacaggtaaaattgatgaacaaaagatcatgatgtattttattcatcgaatcaagacaaattaagaaattatcattccatctaggcaaatatcccaggtagactgtaaacttaagctggaaatagatttttttaaaagtgaattaaagaaaaaattaaaggaagttaaatgttacagtaaatacagcttaagaccattaactttttgaataatcaataccagaaataataaagtagataaaaagatttactcatcatgtctggaatattgaaaagatatttgacaacacataaaagaatacttaacttgtgaggagatgtctgattactaattttatatgtattttgaccacataaacatatttaaaacaattttgtaaccttttcgatgtctgcactcatttcatggtagcgagatcgagttgtgactccatagacagggactgaccctcccagaagttcaggtttccaaggcatgaagcttatgatcaatgcttcagcaaactctattaagggaatgattactaagaaccctagctagaaagtgccttttggtgaaatgtattatagataacattgtgtttctggtggcgttgcaggggatgaaactccattaacctgttaagcacgaagggtgtaaaaatgctaagagagaaaaatcatagagactggagaaaagattttcctgcagtgctgtgttctaaatggatgagagagcttcagatagttgttgttgcatggagctaggtcttaatctctttgtcgtagaaggggagggacattttgaaaatggacacctgctcaatctcctccctcctcaggaagctctggcag

SEQ ID NO: 37541 - DNA, 1028 bp, Homo sapiens
ccccatcggaatgctaaaatctcactgccttttaccatatcctcagagcatgctggtgaatcactgtgaatattaaaggatctgttttcatgtaagacacaaaacatttctatgtatatgttcataaaattttattttttatgtccaaatctgtagataaaagtaataagactattgcacaaaatagaaactaattcaacatacttagttttctctagaaatttacatgcatcattgaactgacctaaggaactttattttatttaaatatttttgctattgtcaatagtaattggtctggagaagtataatcacattgccaccacaaattcgcacatctcttgtgccacaaatgtaccagtagcctgttgagccaaatgtgatccttgattaccgaggcaaaataagttttaaggataaataaaacttttctacgattgacttccacactcctaatgtttcccataactaaagaaaaataaaacctaccaaagcactcgttgaggcattagtctgtcgcatactatggataataagaacctgtaaatatccattcggttatcaattcagtctggccatttaataaaactagattaactgagaggagtggtcgccctctaccaactgcttatggaggggtgtgcctggaggccctgtgtgtttccttcctctgtggtgtcctcttctccccgacctgctccagatcttcactggtttccttacccatctcccttgatcatctcaaagcttaagggaaataaaattatttcctcttcatggagagatttgagcccccttatgtaaatggagaatttttttttttttttttttttttgtagaatttctcttccttatggtcctagaaactaacggacattaaggtccactttttcctccaatattgtaaccaggactgcatagtcaatgaaccttagggaaacttaccctgagtaaatgctgtgcctcaggacatacaatagctttcctgttaaaactgacaggaagagttagagttttttccctgaagc

SEQ ID NO: 37542 - DNA, 1018 bp, Homo sapiens
aacttcccaaagtacccagattgacatgggacacagaaaaggaggattttggctttcagaattaagatttgaagctgaataaggttaggcagagatgttaagtttgactaatgagtacagtgttgggcctgaaaatgtgaaagaaaacaatatttccttccttttctgctaaaactttggttcttcatgaagaagaatggttgttaccttgatgattagggaacttttgagttgtttgaagtctcataatctttgtatttaacttgatggcctgtgtagaagataactaataggagttttttggtagtaagaaaagttttaacttattttaaaatcctttcatttcaggtatttttaaagaccacctttccattctatttctcctatttgaagaaaggcattctccttaagatttatgttcacattttgtatcaactcattttggtttacccagcaatttgtagttaaaatgagacatcatgctaattgcaaagaacagcacaggttggctgcattagcaaaagcaaactaagttgtatgcgaaggaaaatgaaaaacactttttaatactggagtgagaacatttaaattgatatgtcttgttgtatttcttcaacagcagcttataattacctctcttcaaggcatattttaagtggacttgtaacagtagcttgaaatgtaaactagtaagggatccagttgttgaggcatggcagcagaatcaggagtgcacagctctgtgggagcaagggcatgctggccattagcagaacatgccagagtgtcttagtccttcagtccgaagtcagctttaagcctttaactacacagatttgttagtgtacagcattgtatcagctcttaagaaattacccccaaattttgtggctaaaacaacgtttattatttcacagtttccgtggaccaggaatccaggtgcagcttagctggatcctttgagtctctcccaaggcaacggtcatctcaaggctcagtgagaaggattcactttgca

SEQ ID NO: 37543 - DNA, 1098 bp, Homo sapiens
gatttagaaatgccagactaatgagaactcgccatcacttgtgataatggtctatcatttcgagcttgaaccatgtgtacttatttggcctcatttcagaatagtaaattatctcaaactcatttcatttcttgaatatgttcttatgatttaggtcataagttggattatatgaatagtatccctataatccaccatctgaaataagctatatgattctgggctattttaagattgagaaacttcagacatttttcagaaattacataaagggtttacagggtttctcaagcctctaatttacctctttatgctcatgcttgattgttgttccatattaaggtttattttccttttaaaatagctctgcacaaagagaatacactgctaaatactactgcaagggaatgtttacagatgcaaatgacttctatttagggagctcatgattaaaatttgaaagaatgtggcactagaaagcatgtgaataacctttgaaaaatctcacaatagaactgaatatgggatatttatatctagggttgcagatataaagctatgtgtgaatatgtatgttcaatatgcggcaaaggacatcaaattgaaatttgttagtctaatgttactttaatttagacaaataactattttattattgtgaaactgtaatgtagaatgcagtagaaggctactacactaggaagaactagtgttatgtttgcctgcaacgggtgagccaggcattttccacaaatctgtctttctgataaagagaagagacatctaaattctttcaatctctcatagatgcttggatactgaaagtattattcattatttcattttttattgctcacagagcaggctgctaataaagtcagaaaaaaactgtaatcattggcagacataatattttctgtctattcctgtccagagatgtgttcttgttttaaagactaaccttctcgggtcatcaaagggatcacaagttgtgcaactcattttggtggaaatcgtgtctaactcttttgggtatagtaaacactccttctgcttccctgtggatggttctggagactggcgtggttcaggccctgg

SEQ ID NO: 37544 - DNA, 1025 bp, Homo sapiens
aaagaatgagtttagggaattgtgtctgtttcaagttgtccctagtcattttttaggaaagcatgaatgaatttcaagggctcttaaatgaaggttaaataaagaacatgaaagaggatatttagggacttgtggaaattattctgttaattgtaatttcctcttatgaaaacagttatttactgccaggtgccctcttaaccttctgagcatgcatacgcagcatcagctcaggtgctgttggagctagacctgtacctctgccttctggtaatggcttcgcctagcacacttcacatagtttgagtgaaatcaaaggtggaggaggcaattcataggaacacagggtattgaaaagtatttttaaatttgttgacaagttatttgatcaagtagcatggattttaaaaggaaatgcatgccctgttaagtgactaaaggatgagtctagtttaactcctgtttaaaagaatcagagaaattaatgccaggtctgtgaaaaaggaaaatagagcagatatcaccgcttaatagatttttacattgggaccatcttgaaagtttgcaaaaggagccttaaaagttactcaataatcaggacttgatggaaattcacggtataaagccataagaaactgaagactcctaagtacccttcccattgtctgaatttttcaaaggctgtgacactcagacgagaagttcaaaaccaaaataatttttatttgtactgcttttaagaattcagaatgctattatgagacagaggaagcatgtagagttctgacctcctaagggaaaaggaggaattatgtcaccttttgcttcctttaccctactgagactcaatggtgaaatggaaacaaattaaaggattgttctttttatccttaaatgtcaaacgtggttgcatctcctaaagaaataatgcaactgattaattgtgtaatttcacagggaagcagtaattctcagccttataaacatgtaatgcactaatttggtttcagagttaactgaaacag

SEQ ID NO: 37545 - DNA, 1018 bp, Homo sapiens
agtcctcatttaactatcgatgtgtttcaaaaccttatttgcaggtgagttgtttagaattcagaatatagtttttcgtagaagtgcaagttttccataatatggataatctgcttagccataatattgatgaaaagctatatatttcaaagaaaaattgcagaaagcagcatctagaagagttactcaggaaatatttattgcatggataaatgccataataaaccacatatggcaaaaaaccaattaattttttaaatttctaattttgttttttagaaaagcagataaattacagggctcaagttttactgcaccctctccagcagttccctcgtattttagtactttaaaaaaataatatgctaggaatacataacatcaaagcagagagtggaacatggttgttgttgtttgcgtgtgttttttttcttttttttttttcttttttttttttttttttaaaagcacagactctggttaagtgtagctttgggtctgaatcctctttctgtgctcttactagctgtgggaacttgggcaatgtgcttaacttcactgagcttcaattccttcatctgtaaaatgggtgtaataatcacaactcttttctgatttttgagtctcgatgaaatattgtttaaggaaccagttgattgccaaaataacaacttcagtaatccaagtccaaaaagttttgcattttttgaaaagttaaggcaacttgaatatcccagattgatattttagttcagtaaaaaatttcataaatgcataaagattaagttttaagaccatttcctatattcttaaggagcattatgctaggattactatgcataaggaattcttcattcctcttgatgtctgatttttcagtgccttactttagtcatctacattaagaattgttttgctctggacagttcacaccaatcaccttttttacatagtttttcttattgaaatagaagagtgtcaaaatggcacaattatcaaagcaggaggtagtcttttt

SEQ ID NO: 37546 - DNA, 1056 bp, Homo sapiens
tcaatttgtgctgtatccattttgcactcatggatagttcatggtcccttatgagcagaaatagtcagcaggcaataatagaagacatggagcagaaatggttagggccgataatcctttgctccatggtgctagatccatgtcttaaattcatttttagtgtcttaaaaaaaaattctcgtctcatcaatatgaggatggcatcagcaaaatcaaaaaggagatactttccaagcctttacatatgttctgcttttattccaatacagattgttaaatgagggcacagaaaaggtccctacctcttgattagcagagtaggccattcctgcatggaattccttattggctacagtcatcttctgtataacacagtagcctttcctgattttaaaccagaaaagccaaaattgccctaaaaatgttacctctgcagtggttaaacagttcctaaggctaagcgtttgaggcgtgcagagtggaagagagatgaagtggtgatggccacctgtagctgctgctgtctagctgaccctgctgtttgttggcaactggagacaaagttaaggctattaaagctgactccagtcaagctgcccttatcatctgatgtttcctcatatgagattccaggtggtgctgccccactgagacagtgtgaactcaccaatcattgcttgaagctaggaattttcttctgctgtgccattgcgtgacaactcaattctgaccactttccttccactcctgtggagcagaggaagaaactctcaactctcacagggtcttcaattttttttacatttacagaactccaggagataatttttgcagcactgtcctggaattcaggaattcactctactctgagctttgccgttaatgaacttggcaatgttagccaagtgacttcacctttctgggtgtcagttactcaactataaaacatgaacataggataaatgatcttcaggcccacttcactttaaccatctatttttctgtagttctagcctttgttctgctttgttgttctacatttcttttttttttttt

SEQ ID NO: 37547 - DNA, 1092 bp, Homo sapiens
tatcatcactaatactattaacattattatttgcagtagctgagagaaacacggtcttgagtcactgcaagtatagacgcttacgataaaaatatttgatgacgccatcgtaacctagtgacaaaacatgtaataaaacaagtgtttggaagtactggtttgactagttgtgagatctgctagatgtctaattactgtaggttaaattagcccccaagcattgtagagaatggatttgtctttatttcctttaatatccacatttactcttgtttttctggaataataaattattcaatcaaactttatattttgtgtgtatggctttgtgcatgtgttttctgtgaatatctatagcttttcagaacttgtgtatatcactgcagacttaaggctatttgcactctttgaaacaatatagcagttatttctaaaacgtatggacatggatataacttattaaatgttaaaagaaacaatagataaatcttcaactacatgtaagaactactacatatgtaatatcactgtctttattatcccctatagctacaacaccaagctatgaaggagaatactgtattctttgatgtttaaattcttttttcattagttaccattcacatgtggatggatcaccaaatacatcttttcagctgttgtaaataatcacaatccatggtccagccatcactaagcaacatggccttgccctacccataatttacaagtggattcacctattagtagaagtagttcattatcggttatccaggctacattattcagttggaggattaatgtttctatcatcaactgactagcatgaatttgtagaccatgtgccccaaaatgaaggataaagacaagatagtgacatgatccttatcaatgccaaggaatataaaatgttactgggaccatgtctcagatttagaaaaaataatctctgtaactgcacacattaagtgtaataatatcctcagtcctgtgcagtctcagaaagggaagagatcttggtgggctatgaaggtaatgaaagcttaacagaacttaaccactgaagaaagcccagtggaggagtgagggaat

SEQ ID NO: 37548 - DNA, 1146 bp, Homo sapiens
tggcgcattaacatttttaggaacttgaactctacccttttttacactctaccagatattatagttgatgctatttcttgtgccagttaataaacaatttcttagaagcagagagcatctttgatacatctttgtaccccttcacagggcaagaagttgtaggtagatacaaaatacagttgaatttaattttaaataaaagtaatgactattgagtggataaaagtgtatactgttttagcaatacattgatttatggaaaaattgaatgtgagtattagtatatatttcattaagcattcatattaaaatagtaatctgttggcttttcccattttaactagagctttgtgaatatgaagcatattggtggggcacttgggacatggaaatatgtattattcttattttctcatgacttgtttttacttatataagcaggtacttagaggttttagacatcacattgtagaattaaatcagtatgatttcaattgagttttggtatttaatctttctttttgaaaaagggtaatttcggagagtacgagtattgtactcagaatcttctttccttttttagttttttaaaatatactggtgtgcattttttccattactttaagatagtgtagcaaattaagaccatgagctctggagccagagtctgagactcagtttgtcagtgtgatgggaccagtaatgattctttttcatcaggatgttgtgaagacttgagataatacctggaaagctcttagcaaaatgcctgtcacacactcattcaacccctggttaggtaatatattattcttttgttttaattggaatttgcatagggagggagttgtgtattcagtggggaaaaacctctgaatgaaagtctcatggactttctggtgccttcttgttcatgaacaccagtggcaatgagtggctccctagaaaacttccatgtctcgagtaacctcaaaacccacagcgacagtaaatcacttgttggcctgaataaggatagctataatttaggttgttttttttttttaaatgtgttttcatttattgaggtcagtgcatttgtgtcaaacaattgaaacctgacaagaaaaatcaagggtagcctgggcactgctcaattattactct

SEQ ID NO: 37549 - DNA, 1671 bp, Homo sapiens
gaagccggtaggctaaataagtgcctgtgaatatacatagggttgaatttggcagtgtggcttttttctagcagggcctgggtgctctttcacacacactcaggaatcatctgatttgttttttcctttgtttgctatttcatgtccatcaaattattggaattttatttgagttaaaatgaatcaataaggattggtctctgttttactgtaacgcctttaatgtcatttcacctgcgagacactcatttctcgtctcagcctagtgaaaattgcacatttaccctcaacatgacattgtcttggcacgttttaaaggtgaacctgaaagtttaagggcatctaaatatgccgtgctcgcttcagtatccagttggcgaggttcaatagaaaacaaatcaattgtcatcccctgttgaaaataagcacacaaagatctagcttaaaaaaaacgaacattgtaaaatgaattcatacgcagtagaaggtgaggtcgagacccgtggagaactttatctgagacagtgtttgtttacctagaccgaacatttcatcctttcttggtcaatctctttgactttttctttcctactaagcctgacttttaaaataagtgagagtcagtgaagcaaaccccagttccgattagttccccatagcataaagacagaataagtgagtatctctaacttttgaacataatccataggaagtaggtatggcaataattatttctggtccagcacagaaagctaacagatcaattcactctttctcaaggaccaattctatcacaaacattttcttcccagagaaaaaaagagagagagagagagattcattcagtagtaataggacttgctgtttatctgtcatccccaaaacttgaaacagttacactagcacacctcagggggttacttgctggcttccacttctgcctgagaatttgctactgtgaaatgtgtgtatagtcttgctttcttttttacattgaatttgcattttaatgtttttcattcttcatagctaagagggaactttcttttttctagtcatttctaccttgggactgctacaagttgaagtctggctagaattggaccatctagtgcagacaaaagttgagatgcagaaaagggatttgaatagaagtgcaaggaaaaagaacaggattaggaattcaaaccctcctcttagatttgtatttcctaccttttttctttttttaaaaaaatctgctttgttttttcatttttctctgaaatttcttaatttgtatttcctacctttttttctttttctttttaaaatctgctttgttttttcatttttctctgaaatttcttcatttttctttcatctctccatcttccaattttctacttcttgttttttgtggtacctttatttttaagatgtgtttctttttctataaacatctgaattgggtaattactgtacctgcttgcaaatattcctcaactcagaaatctaaaaaaaaaaaatacaaaatcataactatcacagttaacagctcctcatcttccctgtgctctacctaggtaccctgagtgttagatacagtatctcacttaattcttcaccaccatcctatttaattaatttgcctgaagtcctacagctggaaagtggcagagctgagtttcc

SEQ ID NO: 37550 - DNA, 1027 bp, Homo sapiens
ctaagatagctgcccttccagaggtgtctggcatatgtaaaatctttcaaaagcaaaggtaagaacacactaaaagaggagaaatattgtctggtctgtgtgaagattggccatagttggttaaaataaacaaacaaacgaaaaaacagtactaattgagcttagtgatattaacttggtaaattaagccagtttgtctctttgctttatctgtcttgtggaatctgtatcagtggaaattaaatagtctttacatttgatgaaccctgtttaggtgttggaaatacccatctatttgttaaaaaggcaaggtcccatgatttagtgaatgggggatacagacagcctttattcaagtaactgaataaacaaaagaattagagagtgtgatgagtttgaataaaaaatatagttcataaaaaccagaaatgtgatagagcatagtggctggaagaaagttacccaagtggcttgggtagtcaatgaagttgactccaacatgcagtagtacttggactgaggccagaaaaattagaaagaggccaggcatagcaactcatgcatataatcccaaccctttgggaggccaaagtggatcactggaggtaacgtcgacctcaagtgagatcgtgtctctaaaaaaaataaataatttatttttaaaattagctgcatgtggtggcacgtgcctataatcctagctacttgggaggctgaagtgtgaggaccacttgaactcaggagttccagcctgcagtgagctataattacactactgcactccagtctaggcaacagaaggagaccctgtgtctttaaaaaaagacaaagaaaaaaagaaagagagtgagaaagagccaggagacataggttttagtggctctgtgaggcataaagtcctgggtgaccccatggatatttcaaagaggtcttcacatttccttgtatcacaaaatttgatgggtgactaataaaacatgtacagatgtgccttagaatacatgtagcattattatcccccaataat

SEQ ID NO: 37551 - DNA, 1056 bp, Homo sapiens
gcctgtaatctcagcacttcgggaggctgaggcgggtggatcacaaggtcaggcgttcaagataagcctggccaacatggtgaaaccccatctctactaaaaatacaaaaattagctgggcatggtggcatatgcctgtagtccgagctactcgggaggctgaggcaggagaattgcttgaacctgggaggcagatgttgcagtgagccgagattgcgccactgtattccagctcgggcaacagtgcccgagactccatctcaaaaaaaaaaaagaaaaaagaaaaaaaggttgttttaaaagaaaataaagtttatctgaataacccatttatacatctacttatatgattatattataccctttgcagttcaaatttcatacatgaaacaaaacaagaacatgggatgttttggttttctggctaatagacaaaatgccaggtcatatttatgtccagaaacttagggggaataaaagcacaaatattttttcccaacacaaaggtattttttcctgatttatccaggagaaaataaagtaaaaatctggcattttgtggctaatatggttggttattctgtatcaaaacatgtggtacctatagtcaatatattaaaagaacagcataggtgaaggccctatttttttccactttaagccatcttgtcataacttgtagacttttctaatggttttataatattttcctggcattgtaagctattttattactatattgaagaaagtagaatttcccattgcacttacattttgtcctcatacttccatttttactacatgaccttattatttaggaatttgctctccttctgatctcctagggataacttgctgctctactgatttagttgttagaataaaataatgtactttcacattcagaagtaaatcctgttcttttctatatacttttcacttgggaaactaatcagagaatctatttataatccatgactgaatagaaaagcacatataaagatgatttctagaaaggcagaactcatatactttttgccttatgaaatacagcag

SEQ ID NO: 37552 - DNA, 1065 bp, Homo sapiens
ccggccgaaaaatctacttcttatcctattgagtataagtttcctgagggtgccgtgtgttccctgtgtctccaaactgtaaattgtgttttgaattattgtcagtgccaaaacatattttttgattgccatgttggcaggctgattgcaagactttgagctcctgtttgatatattttaaataaataccttctgccttaagaatttggacatagaattcatcaatctttattttaagggtggtatgttgaccatcctttagaaataagattataaacagtatcctatgtgtgctaggcatgcaatataagaaacaaaagtatagaataattctaataacaatgtatgtgaccaccagtagtataaagatacagttgagtgacttatggtaggaaatgaaggatttgaaagaagttttaattctttatgtcagtaattttctgccctagttatatgttaatcacctgagttgctaaagaaaaaatatcagatgcctgggctctgtccctattaaattaggatttcttctctgtgtagagggtcggcctgttgctacaggtgaatggtatgaaacaagcagattatttgaagatttccatgtgccaccatttaatgtcttattattaaacttagctgcttctctggcagtgagaatgttgaaaagaaatagaacaaggagtaattgtatggtgtcatctgagtcttattagaagttcagtgaatgcctccctcatatcagtcaggtacgtggtgataaaagtatgcaaactggctcaagcagtggttcctgccactgatgagtgcttggctagtggggagagggatatagaggattccagggaatcagcagggaagagagggtgcactgtgccttaaaagggtaagggaagaatgagctttccagatagacaagtgtagactagacaatgagtgaggaattctggctatttataaaacaaaccatgttagtatttcctctaaaccctgcacacagtattgatgttccatcaatattaactgggagtaatgatagtgatgatcttcatgactaacattaattaaaat

SEQ ID NO: 37553 - DNA, 1025 bp, Homo sapiens
tacagtaggcgaatgaagctacagtaagtaatacaaaaagctacttcttttgcagcttgattgaaacagtccactggtggttgcttggttgtcagtttgagcttgtctgtgtgacttcttttctgctccttacttccatccatcattgcagagagcacagaagaaggaatatatatagtgccctgtgcttgcttaggccttagcaaatatcaattcatcaccaacttggctctaaaagagaccattcattggcatgttagaacattacaatttacccagtgttccctggtgttgaaggagtcacatgaccggatctcaaaacaaaaaagaattccatgatatgttcttggagttattaataaaaataactgctggttgacaggaaaggcatatggcaaatttaagatgcatggccacagtattttatttaaaaaaaaaattctttcctacaccaggggtgagagtgtgtgtgtgtgtgtgtgtgtgtgtgtgtgtgtgttttacgcaccagaaaaaccttcaactctgacaagccattgacgaggtgtttcagtcttcactagcttcctatttcattgctctgccattgagcccttgtaatactacgatgaataaagtaatcaaagcaattggctgcctgagatcttttttaatgcactgcttcggacgcagtacatatgctgtgcaaataaatacagaattagtgttcctgttggaagcatttggtgagaatgagtgatttgtcttgcttatgaaaggtgcatacatttccgctcatagctgtttatcagccagcctctttctgcttatggattctgaggtggaattcatcatttgtcagcacctgagcagatgtgctggagatgaccagattgatttgtgaggatgagcagagcagccgcaccagtgctaggagggcggcccctacaaattgtgttatcttttgagacttgtctactagctcttttctatacttcaggaagagaaggaaagctacctttttctgcttctcacttctgtatttg

SEQ ID NO: 37554 - DNA, 1090 bp, Homo sapiens
gacttccatttccagagagccataggtactaaccaatccctttttacatttgagaggtgctatttctgcatgggtcaggcaaccccatgggtgctgaaggatctggacagcataggaggcctgggaaggtggctgctcattcctcatggccagagccagaactcagggcagcaatgcctgatcccaggacaaggcccaggccactgccaggactcttacagggacatccctacgcagaggcatcctacatcagaggactggcccttctcccttccctcttaccactgtggaagcctgggacccaacaggcttgaaatgagagctgaagagattgaatttgatgactgtgagatagagaaagatgtgggtgctcggtatggatgagcacacaattcgatggtccaggcccatctgttcaaaagaaccccagtttactcttagggactggatacttctctcttagtctgttcgaggggactaacaagctgctacttattaacaatatgagtatggtaaactatgagcatccacttccttacctgtaaaatgaggatagttcttgccttgcttatcttaaagactttgtggggatcaaatgaaataatgtctgctttgtgttaaaggattacagcatgtaattctttcctgattaattaccagacaaattggtgaggtgcctatatatttaaaagcctcagtgtttttgaccactattaattgttaatccgaaagaaaaataaagcattctggaaaaactatcatgtaaatcaattacaatttgggctttctttttttcttactctgaaatgtgtcaggaccactattttaggaagcaacattcttggcatactttgaatgaatttttacttctctagagctagattgcatagaaaagaaatatccagcctgcaaagtaaagcattctggaaaaactattgggtaaatcaattacacaattgtaattgcaaaaatgtgtatgtgtaagtgtatatgttttcttactaagtgtgagaattgtgtcattttacttaattcagacactggagggtttggggatcttaatctcgtctagagcaaatcctctcgaaga

SEQ ID NO: 37555 - DNA, 1064 bp, Homo sapiens
caggaggctgaagcaggagaattgcttgaacccaggaggtggaggttgcagtgggccaagatagcgccattgcactccagcctgggtgatagagcaagactccatctcaagaaaaaaaagtgtacttttttcctggtatttaatgactaagaggtgcttgtcacatggctcttaacacaagtggtaccaggtagcatagcagagtttattttgaattttataaattgcattttatggctatttcttactaatgaccctgtaaagaccaaaatcatggctttaaattgttaattcttagaaggcatttcagcaggaaaggcaggtttcagttgtcttgtgcactgaaattgtccaggtatgcttaatttgctcatcaggcctgtaaagaggtagagtttggggaacctaggatagtgaacagggattatatcccttatacagcatctgtctgctgtacctgttcttaatagacatagttaattaatggataaagtctcatgtctcatagacagcagtagttgcctgttggttgaaaaaagagcattgtctttagaacctgatgtaaaggtggcgctcacattacagaactatagggcttagttctggatccttagagcttggtccatgcagccattcctggctctgcctcacctttgggattctgatctcagggagcctcactccatgcattgtctaagcaagtcgctgttacgatggatgagggcctgtccctgcagtacgatatggagggtagttggggatgggagcaaggagaggagcccaagtctaatccatcccctttttgagagataaagaatctgataaccacaacgttaagccacttgtccttgctacacagctaggtagtagcatatgtgaaactagaacggatatttaagagcttgacttaacgtttgtggccagctaaagtatgagcacagttcacagcggcacgggggagatgactcaagtagttcaatggaaagaaggacaagtgggtaatattaaaggtgaataacaaggtattttttacttagattttaacacagccaaattcacctgct

SEQ ID NO: 37556 - DNA, 1050 bp, Homo sapiens
aaatttcttgatggaggagtctgtcttctgcacagtaggtactcaacacagtttgatattcacaatggtgagtttactacatattaggaacttttttaaaaaatgatgctcagcttcttttataggatccttcattactttatgtctaattctagttttttttaatgggccatgggaccaagctagaacataccaattatactatattcaaactttgattctcaagtcaaaatctgttacagaaatactgttgctgtgggtgcaagcaacctaataaatactttcaacttcatttcacaaaaagtgacctagaatgctgatttagaaaaaatataagcttaaaaatgacgctatctgcttgtatgtgagagagagagagatggagagagagacagacgatgggcggaggggaggaaagagctaggtagaatgataaatgaaaatctaaaaaggcgggcttcacttcactggtattaatttggtaaattatccataatttattagagcttgtaaacattgtggcaaaattttttgccctgtcagtaatgaattgctacatcattaattttgtcaaaggatcaagaaacaacattgctgagctcaaagaaactcctagatgaatgaatatagttgggttgaagtgctggtgtggttagttgaattcagcagttgaatccacatgaccgtttctttcctcatggtcagcctgacctcaactgccaagggtggcagggtgcgtcccatcccccagtggggaggaggctgtgtagtcaacactgcattcggttccttacgtttccctgtgacactgtcctggcctgtatatatttatatattcacttacttcaggcatgtctaaagtggtaaatgaaaaaatacattaaaaaaaagtcagttggaataaaaattataaactagaaatgtattagatgagaatattttatggagaacttaatgtccactatctgtttaagcattaaatttggcatttagtctcctgttagctgtggggaaagggaaacctggttattcatatagttgtaattttct

SEQ ID NO: 37557 - DNA, 1044 bp, Homo sapiens
tctgtacatatgacaaaaggatattccaaaacaatgtgtttagtcactgaatgaagcagcagctaaagtaaaattatgcagcgtcatgtaaaattaactttttctcctccatcttcttcctaacagtggaaaatagattgactcagctcttatttttctgttttcactcagctattttgtgatttatagaactttaatcatttaaccatataagttaaaaataatttatgcccccttaacacgtaaatatgaatattataaaggaaaaagttttcttgcaggcttttgtgtttaatatatatacctagcattatttggctgttataaaacaggaaaatacatatttctagatggacataaaacatatgtatatatattagataaacagcaaactttgttgtgcaaatgatgaaaacataatgtaggagcatagtaatgtgattgaattaaatttatacacacaaacattatttcccagactaacattaaaaataaaagttgaactatgaaaatattagcaagaactactcaagtatttattccgagatgcttcaaatctggatttgatataatgtaatttatgtaaacataaacagagatgaaatatgagaagccctaatattaatataaaacaaaatgaaaacttggcatttaggtcacatagcatagctatgcgtactattttcctaactctatcttgataaaattgaaagttacccataaaaatgctactctgtggtctttcagcgcatattttttttgttcctggtgtggtttgaatttcatattgtgtttgtttttcttcattctcttcatcctcaccctgaaaccacagaaggtttttcagtggaaaggagagtattgtatcacacttcctggttggtgccaattagttccagcgtggactttctttatggctttattttggaatgatatcatattattggtcttcacgtttgctagaatagttccagttttccatcttttagcacaaatccctgaaaaggtcacatacaacttacttactggccaagcacacacgct

SEQ ID NO: 37558 - DNA, 1034 bp, Homo sapiens
aagaaaaccaattgatagttatcatacttatccccatacttgaaataaaatagtagtgagcctaagattctgtttttcttacagattattttgcacatatgtgcatgtgagtataaatatagatgtgcattttggtgctttagggtgtaatagaacagctaaaatcaccccaagtcttatgaggctcctgctagccaagtggtaaagaataaaaatccttactttttggttatgaaacctttagcctcttgtggacacagggccaaacagattgcaaatgtcttgacagctctattcacagcagaagcttattcccaaaactggtgcagattgattttgttcgttctaaaactgttccgttctccccctcttataaataaaaatagacccacacactcattcccagaccttttgataggtaagggttgaactctctaaaccatagcatggaaacccacgtaatcatgttattccctgggatagacatccatagtgcaagctaaaagaagtggtgaataaaagccgctgttgtattctgtactatccacataggatattttggcaaaacaggtctaacactgaataaatatttcttgaacaaataaataaaagaatgactacaaactctcattttacctggacagtcttctgcttgcataaggagcatgaagaaacaaaacctaaaaattacggccaacaggattaagtaaagaagcactgagatatctagctttggaaaattcttttaaattctgaaatgagagcatttgtccttggggcctatattccactggcacttcttaccccctggtttcatatgtaaaccagaaaatgaaaaccagacccactgacccaaaggagatgaagcatgtttcttttgcccattatatttctctgctcacgcctagatgccttgccttctctgtcctctgtgtttgaagttgagagctgggaacagacatgagattgaggtcccagggagaagccaagttcagcctgagctggtgaactcactgagactaagggcagataat

SEQ ID NO: 37559 - DNA, 1030 bp, Homo sapiens
tttataaacagccattgtgttttcctctcacatgagtctgctccaacatgctggataagcagtggtaattgataaagtcatgtatacagcctttatttccatgggtaaatttatggtcaggaaaatatctgaattagtcttgtctaagacaattgaaagaaatgtcggcatagttcctgatgatggatttttttcatgtaattcttttgcatttggcaagattctaaattgattttatgaataggacggcagattaacctttctgtaacaggctggaaaaatgatcacttggaaacatggtgccccctaatagcattctttgtagcaatcagagataatctgcttgtgtgcagtcatgttattagctcatttccttaagccgtttcctaaacttgttatgtgattgccgtgatggtcccagttactggattggggatagttcctctactggatgtaacttttctcacttaaaaagagtatgataatgatgatggaaatggttgtttctgtgagaacactgtaggaaaagcagaaaactagaaaacatccatttacaacaacccattttgtaccctgccgatgcatttggagaactagacatttagcttaaacaagttctggacagttatcattaatggcatccttgggtgagtgtttaatacaaccatttaagttactgtttgcctggcatttcctcctttaggaaatgaggcagtttgcagaaaagaaattaaataaatcctgcctttcctttttattgcctttgagatttccatgaaaacttttatttcttgggacctctaagtatatttgctattggcaaatgctgatgttctcttaactaaatgattttggaaactgctagaaataggtcatgttaaataggtggaatcctagatgctgtcttttttctttataatctctttctccctgataccttgaatttttaccaaatcttttcattctgtggcccaattctcatagtggaatgtaaactcctcaagggtaaggactatgtgctgtgctactt

SEQ ID NO: 37560 - DNA, 1094 bp, Homo sapiens
ctttcctccattaaaaaaattaaaattttgtcttatgactgtgttggtgtaaatacaaatgtgatcaaggctggattttatttattttaaaagaaattaaaacactgctggggtcttaggcactgggcctaccatgtccagcgtagaagccagccccatatcatcgcaggctcccttttaatttcagacagcagtgtcatttccttttgcgaatcatgttgccatcatgtcctttttactgcaaaaagaattctgcttggcaaatgtacatgggtatgagtgtgtgtgtttggggagaacaaaagtctgtcaccatcagtattaattggacagatgctctgaacagtggatgcttataagggtgcctcttgcctgataagtctgaggtaggccatttatcatttattttttctggtattcttttacatatattacaatttttagaacactcagattcaaactgaaagttatgtatttaaaaggtctagaaatttctcactttttttcctctactgattagaactgggaactggttttggcctcgtgtggccccctcttgggactctctgggttggtgtccagggcagttactccttgcccgaaaccacccctgaaatccacaacccaaaactgattatcatcaacatttctcaatttccaaaatgaaatttgtagttacctcagacttcatggattttggcctggtatacatgcataaccagttggattgactcatagctagtttaattacgtggtgctttgcttagattgcagacttctctaggagaggcacacttttgcatcttctcagcacctaagcatttaataaattcttgttgattgaatggaggaatgactggctggcaaagaaccagtcagttatgtcaaaggtgccaatttgattgtcttgagacacaatccattaaaaactcagctgtttggcgagagagtagaggcctcaccaaaagttgagaattcgagagaaatcttttataatcttatcaggacccaggctatgttctttgatcagttaaggaaaaaaatgccaactgtcaggcataacctaagatttcaggaagtcttccacagcaatg

SEQ ID NO: 37561 - DNA, 1012 bp, Homo sapiens
gttggtttgattaacttcttgccaacccatatttttgtatgagttattacatcagccaagggagagagtcattgggagtttttagcttcatctctgcacaggttaaattatgtagccttcttcccaatttttctgggttagttactttcttttgtgcacgttggtttgcagcctggtgcctggcaccatagagcctgtagttgttgctttagcatgccgtgggtccacttgtcttcgcatctcctgctacctggattgctttcctagatataagggagtagtgaccccagaagacaggaacagtcatcgtatattaaaactataggtggcaggccaggcgcagtggcttacgcctgtaatcccagcactttgggaggccgaggcgggcggatcacgaggttaggagatcgagaccatcctggctaacatggtgaaaccccatctctactaaaaatacaaaaaaattagctgggcgtggtggtgggcacctgtagtcccagctattcaggaggctgaggcaggagaatggcatgaacccgggaggcggagcttgcagtgagccaagatcgcgccactgtactccagcctgggcaacagcgcaagactccatctcaaaaacaacaacaacaaaaactataggtggcaaaaacaaggagaaaactgatgtcattgtcttagagcatgataactgttacatatacagtttcaagtgtaaatgcttgatttttcataactttaaaaactgtacgtatttcttgccacttttcctctcctttttttcccagcatacaagtaggtcaagaagtcttctgagagtcctgaaataactttcaggtttctttggaggccaagaggcttccacttttactacttctctaggataagaaggaggagacaaggacaggagggggagaaggggaagagaaatggcatgattcgttaagcatgttatcgagaatttttatatgtcatgaatgttaatcatttaagtgggttttggatgctattagga

SEQ ID NO: 37562 - DNA, 1089 bp, Homo sapiens
gcgttgggaccagcctgcttggggccatcattaatgccattgtggataaagggtgaaggctgtggccacatgcagctctgctgacactttgtgaaaggtgagcccagccatgaagtcgtgggtgtgtcttgcccagtaggaagataaagcacagccatgaagttatagttgacttggtgcctccatctcctgctttaaggggcacctctcttgggagctcaggaccttgctgctggtggcctcccggcaccatgacatgcaggggacaaagggaatattttgcaaagaacatattcagctgagataggcaggcagaaagatctgtctacatgggacataacatttgaaagtgtctgcatgaacaagaaggaaaactagagtttgagcagtgaatttttacgatgaatgaggcttaacattttaagttgtgtatgagactgtggaccacagcatgggaatctgtcttcattttgttgcatcgatggctacatcaagtctcctaacacggttgctcaaaaggaggtacaatgtgaatcacagaatggcggagccatttggggactgaactgaaaagcaagcattctgagcagcaaacaagacacctagaggccggcatctgtcatttagcttttgaagcctttgcttcaggggaagttacacatttctgtatgataagtacaactcatgcttcagaattaattgcagcagcagtgatgtaacattgccagccctcttcagagaataactcagtctgtgttcgttttgacgttgctgaacgttgttttcctcatatggtgctgaattttaaaaatttccatgaaatttgcaagcagatggagagtagatcgcttggactaccaggctctgacagcttatctgcattttattgtgaaggtggcagctttggaaggttatgagagaagtgttagggggaggaggaaatgctgaaggatgtaataggtttgtctggtccaggtctttttatagatgtgggtcatgcaccgtaagcaaggtgaggccctttgtgacactgaagatttatttgttttttgctttcctccctcctatggtcatacactccctccttcc

SEQ ID NO: 37563 - DNA, 1049 bp, Homo sapiens
tttttttgttttaaacagagacagcgtcttgctattttgtccaggatggtctcctgtgcctgggcttctagcagtcttccccacctccgcttcgtgagtagctgttatagtaggtacacaccactgtgcccagcttgaagtgcatgatttttgaatctgagttttttataggtccacttactttaagtagatgccctcctatcaggcaaaaaattaaactgtattgtgtttccacttctatttgaatttcactctagccgcaacagagcacttcagtccaaatcctgcattgcccatctcaagttctcccactagaaggtagaaaagaagaatagtacttatattattaatagttattaattcttcctatttccttttgaacaagtggaaactcttcaggcaaacttgcctctcaatacgcattttcttttcttcctattttacttactttcccgcttcattgtcatgtctgaaattgcagataatggtggcggggaaagctgttgtgagcattgggtggtggtgctggtggtgactctttacctgcttctctgattagaaagcaaacttccccaaaacaggcagaaatctattctatcaactttgatatctctccaggtttttaaaacagtgaccagcatctggttggtgctgaatgaatgttcctagaattaatggttaagtgagtaggaaatactgttccagttccattttctcctgtatttggagactctgtggttctctctctctctctttctctctctctctctctctctgtgtgtgtgtgtgtgtgtgtgtgtgtgtatgtgcacatgtaagtatgtgtaatgtttagtttttttatgggtttaaatttatggtaaggtaggataagagtagcggtatctgctgaattagggttaatattttctgtgttaaagctgaagatatgcagtgggcaaaagcctttagatttggttcttggtgatccttccataaaagtacattaagggtgggtcagagtttcctccacaaaactgctaatgtgctctctgcccttagacataaca

SEQ ID NO: 37564 - DNA, 1853 bp, Homo sapiens
ttaagaaatattcactaaagagtacatatcctgaaataattaactcttggaatacattgaataagggtcttttgcagtgttatcttatgttgcatttgccaaatatagtgaaaaacaatttgctctcttgaaaaggaagcaatactgaaaatacagaacccattattaagtcagaaaaaaatgtattttttaaccatctcttttagctgacttggtacttctctcattgggagactgtatgtatagacttaggcaaaagagaaatgaatcttaactttctgtgtataacgttcataaatatgtaaatgcacaatcagtttgaaataagtaagttagagtatttggtaatttacggtacaaatattgacagattgctgctgaattggtggtgaaagtaaatgaaacgtggccagcacaattaggagttgcccaaatgggaatcttgtttttgttttttagaaaatgagaaatgccaaatgttaacaaagattttgtcaatattctttattgttggagatttgtgcaacttcatttataaatgaaaatcagatgaaggttgacagagctggagttgttagagggcttggaaggaagtgtctgaataaggcactctgtatctcctatctgagaagctcactgaggtttgctactgtcagcctacagtgcttctgcagagatctgtagccatttagtgccctcgggctgatttcttttggagatctatttacaaatgggaaattggaggagtcacagttttgtagccagaggtagaaacaaaggtcttagctctgtgtactgtctcttagagaaacgagtaagctgttctttctgtaattcacaattagtagaatatgattgtgtgtgggggcctaaggattgtgatgctactgaaagacagaagaaagtccagctgataggctaggcgtggtggctcatgcctgtaatcccagcactttgggaggctgaggtgggcggatcacaaggccaggagttcaagaccagcctgaccaacatagtgaaaccccgtctctgctaaaaaatatataaaaattagccgggtatggtagcatgcctgtagtcccagctacttgagaggctgaggcaggagaatcgcgtgaactcaggaggcagaggttgcagtgagctgagatcagaccactgcactccagcctgggcaacagagagagactctgtcttaaaaaaaaaaaaagaaagtccagctgatgtagaattcagaaaggagcatgatttagattagaatttaccttcttgcattttaatttgctttgattttttaaatattttatttggcaaggcttgcatggatgacatgcaaggtcaagtggaggtatgctatgtaatatattcagttacattttggtttctcaacagtttctctcaatgctgttggttacttcactcatgagacacatatttataagagtacacaactggccgggtgcggtggctcacacctgtaatcccagcactttgggaggccgaggtgggtggatcacgaggtcaggagatagacaccatcctggctaacacagcgaaaccccgtctctactaaaaatataaaaaagaaattagccaggcgtggtgtcaggtgcctgtagtcccagctactcgggaggctgaggcaggagaatggcatgaacccgggaggcagagcttgcagtgagctgagatcgcaccactgcactccagcctgggcgacagtgcaagactccgtctcaaaataaaaaaaaaaaagagtacacaactggcataggcacattgggaatgtgaagaggaatgattatgggtatatcccttaagaaggagttaggatggttttctaagcaaaaata

SEQ ID NO: 37565 - DNA, 1062 bp, Homo sapiens
ctgtgtactattctgtttgctaggatgatgacttgtgaatttcaaatggtggttctgcatttactaaagttattaacaaccatttgtacacagcaccacattttaattggactaggacttctatttcactccagtacctaggtgcagccagtgcttcattaaataacactgataatcagttcataagatcttacttcagtgagtgatcatctgtcatgacagacttgaaaacaggtttgtaatgcatgaatttatcagttgtcataagcaagcaaaggaattggctttcaatgtgtctgtagctatagtaatgaggagatttgttgagcctatacttaatcttctatattgtaatttaagaaaaccaacttaactatgttcaactaaattgtacatttcattaaaatttgaaaatcatagtaacaagacagggatttctgagttataatcaataagactaatttaatttaggggtagctgaggagaaagatgaaaatcaagtactgtagtttgaattatggaaagtgtcatattttaatttcacaattggttctggtgtgtttggggatttagaataattttataccttaacattcaatctttattttccagtgaataagctaattttagatgattgctaaacctgtttctgcttgctgttatgcaatattagctttggaataatctggtaattcttacttaacaccaattaataaggaattagagtaataattttagatgtgaataaattgcttcaaattataacatgttttgtagtttatataaattgttattagtgatgggaaaataatcaacaaggcatgctgcctgctggtgattttttttttatttttctttgttctgctttgtacatatatattgggagaaattggtgattgaattcaataatcattctttcttacttattggtggtagctgcatataagaatgcatagacaatctcaaaaacctcacctgtgaaattagagtatataccagctggccacctaatgtcaaaacagccaatgaaattttctcagttgagtcaaaccaatggctatt

SEQ ID NO: 37566 - DNA, 1045 bp, Homo sapiens
tagcggggattacaggtgtgtgcctccatgcccggctaatgttgtgcttttagtagaagcggggtatcaccatgttggccaggctgttctcaaactccttacctcaaatgatccacccttctcagcctcccaaagtgctgggattacaggcatgagccaccatgcctagccacatctcataatgttttaagaaagtttacagatttgtgttgggctgtattcaaagccatcctgggccacatgtggcctgtgggccataggttggacaactttagttatgagcatttttagatttgcagcaaaattgaacagaaggtacagagatttcccatatactccctgctgccacaggtgcacagcttctcccattatcaacatccctcaccacagtggtacgtttgttacaattgatgaacctacactgacatatcattgtcacccaaagtctacagtttacattaggtttccctcttggtggtgtacattgtatgggtttggataaatgtatgatgacatgtattccactattatagtatcatacagagtagcttgattgcccccaaaatgcaatgtgtgtgtgtgtgcctgtttgtattccattaacatatatatggaaaggacagggcttaatgtattttttaaatacagtttcatatttttctccttgggtaattgctttaaatgtagaatatttagaatcatttagtaatcatttattaatattttaaataactaactttaaattgggtttgatgaattttttgtgtgtgtagactgacacttaaaatgttagttttattaaactaataggtaatacatgcacgtagtaatttttaaacaatataatggaagttcaaaggtagagattaaaaacattctatgcctttgaacattctttccttcctttcactagagacaaataaatgacactttaggaaaatcacttaggatgccgaagaaactacagtttcagataaaatagagctcttaccatttattttctgtatttgcagaaaatacaatgattatatgagatagtttgtcc

SEQ ID NO: 37567 - DNA, 1049 bp, Homo sapiens
tgaaccctctcactgtgaggctgtctgttacctaaggctcaaaatctatcataattaccatttctcttaaacacccatcattaaggagtgcacaaaatgcttgccttaaaaggatagtttcatggagattgcttcttgggtatgtgtcagcacaaaatgaaatccctggggttaagaaaaaagaagcacttacacattgaaaagtggtgaaaaaatctacaaattcaaatactgccaactgaaaagcagttaatgggttgcatgttggtgcaaccagaggcagccagctctgtgtcctgctgaaccgctgggggaagatttccttcattcgtggtggtttgacattgaaaaccaggaacccgttatgtgagaagtagcttgttttgcctagacaagaatatacatttaactttgggctaaaaattataaggagttggctcaaagcaaaaaataaaataaaagcagttatacattaaagtaaaaacccggcatcatgatttattgactttggccgtatcaatttgctaaatcatatggatgcgatttaagaagaatgttattttaagaagctttgctccgctttaatttgacatgactaaacctgaagccttctggaaaccacagttcaaaatggtttttccccctagagttttcatcaatttgcatttagaaatgtaatattagctctcatgtagactaagaattaattttggaatatttctagataatggaagtctcattccagaagtgaagttgactatcatttgacgtaagttaaatgcgtttcttttgaatttcgtatattttaaggtcactttttgatttgtcaacatccttactggtatctagttttattcctttccctttcactcttgtatatgctattggggttgttctaccttttttaaacattagaaatcttgcattataccttggaaattatctccatgaagatcaatagacttgagacagttatctgaacttctcccatttgaaatactgtcattatttttggtgtgggtatacgcccttaaggactcaggttaaaa

SEQ ID NO: 37568 - DNA, 1030 bp, Homo sapiens
cctttttttttctcttaacattgatataatgagtattcttctcatacttctggaagcaggctgaatgatactgaaaactatccttgtcaagggctgcatatattatcatcgagattagccatcctgttcctgggcactttagttcaatgggaaaccaccttcccccaaagtttccgttacccagtgtgtctgggaaatgcagattaaaaaatggcgttaagtctcagcctctcagtatctttgatatattaataaccactgacagaccaagatggagaaatctagttatatgaggcatatcccaaacctcctattttcaaatactgacctactgttccttattgttagacacctatattgttttcagtttttcataagtgacacataaataacttaaacaatttttttggcttaaagcttttcttatattttagtatatctctagggtgcagtattaggattatgggatcaaactattaacatggtataattcttagtaatattgtcggtttatagtttcattacactcttactggcactgggttttttttaagaaacaaaaaatgtgttttaatagacatttgtttgataatgaaatggaggcttatttgtttactgtttacaaaggcactaataattggtaacgcttgctcttattaacctatgccattagaaaaaaaatactactaccagctaccacactgctgagttgagccctgtgctgggcacttaatacatttatagtctgcacaatagccttaagataaacaaataaaaattacatagcacttcccatgtgtcagtctcttttcaagcactgtgcatatgtaaagtcatgtaatttgcctaatgaccctatgaggtaggtactattactgccatcttcattttgcagttaaggataccaaggcattgagagattattggatgaaagttacacctttagtaagtgacagaattggaattatgaaccgtggaagttggttccagagtctgtgctcttaagcacttcactgagcttctgctgcta

SEQ ID NO: 37569 - DNA, 1099 bp, Homo sapiens
ggatttaagaagtcatcccctgtattgtctccagcacaaaaaccttccgcctgcatctttcagcttgtatcgccacttctaaaggatccatgggcaaactgctgaatttttattaatcagcttaacttaatgagatgaaaagacttttcccaaagaatggagaagggagagacagatactgagagctactctaattcttttccatgaaaaaaacattttcctccctgattttctagggaagacatgttcagttgtttccaggtaattcatccgaaaagtctttctaattttcacacacagactttctctagccatgtgctgcctttattattattattattattattattattaaagaaaatagacagctataaagaagaattaatgagagttgaggggggaaatacctttgggaaagaaggcaggaaagcttaagctgataaaacatgactcttttttgatgggggctctctttggataacttgcccttgtctaaattcttctctcttctggtccttcctgtccccactcccccattcactccccctctcgtcaagcttacttcataaatggtaccagctggagatcttttagtggcattcagggattacttcccttcggggttttaataagccctgatgcttgaaacacagtgaaggtgcttctggagacaatcacctttcaggctgggaccatgggacccttttgggggcccagatggttgtgtctggagagcaccccaggatgtgctgcagatggcagatcactgaagcagggtgtccacgggcctgaatgatcaggaagcaatcaatagagggatgggtttctgtgcagtcaatagagggtgcttcctatgatttctcaacccacttgactcacaacccacaaatcctcctgtaaatggttggatttgaatctatgaccagccagaattgctaccactaaagtccatacagtccagtgcttatcagaacccctatgatgggacccccacccctgcacaatgggggcactagcatggcaagattctgatttcatttgttagatctacttaggagttatttaaaggactaagtcagccggtgcaggggcatccgtg

SEQ ID NO: 37570 - DNA, 1032 bp, Homo sapiens
gaggttaggcttgttctcatccaagtagattgatttgtgagcagcagccattaccgacagtaaaatgtgtgtttgctggtgtttctgcatttagtaatttgttggacatgaactgaatgtttttcatttccttgttatctaataaaagctgttcaacttaacttaatccaagttgaacttttgtggaatctattttattcctctccattattttataattctgtaatcttaaattttttgattatcagaatgagcattaaagtaggtctgttttactaataattatttccagttaccaatatagctattttcattgaaagatattcataaaataagagctcattataattgcaatgccagttatggggctatgattttgaactatgtttctcttttataaatattgagttactgttaatttattgtagacagttatacccacgatgcattgtgagatgctgaagaaagtgtatatagtagctacatatttacaccaagaagtttgcttgtctggctcttaaatttccagaattgaatatgatagaaataggttgatattttgttaagatgcaaaataaatcattttacttaaatacatacatatactgcattttacataatcttatcaactatatttcattttcttgtgttttatattgtcagggtgataacatcacagagatgctatttttgaaaaaattttgcattataggggctttatgcatttcataattgtctttgatatgttatttaaaatatgcttaatagttgcctacaatgtactgacagtcatattcaaaagtctcaatttcagtggaatatatataataaaatactatttctggagaaacttagagaactgacccaaatgtctgtacttttctcatacaggaaaatcccatacaatgaagctttttaaataagctttaaaaaaatttatttgtggtcaaggacattctatattaagaaccactttcagtgatagtacccactgatagtaagtagaagtatccccctcaccatgtaaatatt

SEQ ID NO: 37571 - DNA, 1087 bp, Homo sapiens
gtggagtgtgaatttaaggttgtgatttttgtttttgactttttaaagactttatttatttagagcagctttaggttcacagcaatattgagaggatggtacagagatatctcatatacttcctactcccacacatacacgaggctgcatttttagtaggggaaggaggaccattatattgcattgttctttgtaacagatggattaacagggtcttaatatgtattagaattgttctgcactgttgtatatcttagccactgtttaattgctttgtaaatataacagaatactggtaaatgttgaagatcttcaaattaggcttcatttgtaagtggttaagtggtgagatgataaaaatcagagtaattttaatatttccagatgaaacttagggtgctctattatatctgaattgtttccctgacatgtggattaagcaattgttttcaaagcttttttttttttttgccaaaaaaccattgttcacaaaaatcattagcgaaagtctaatgtgtaaaacggaaaaacaaatgccaaaccaccaagcaaacatcaagttgtagttggagagattgggcggtcggctgtgctctgttcccaggcttcttgagaggcctgcgaggaccccctatggctctttgaatcatgttttcaaaaccttcctagttagagtacaggctttggcatttacttaggggcgaatagaaacaatgctgtggaagagattcatttttgctttataggccacagaagtacttatgtgcccctctaggaattgacttgaatagctcccatttattgagcacttactgtgtctgagcacagtcctttatagactaaatcatcatttttaaaaatcctgacaaaagctcttgtgagggaagtattataattcttgttttgctgctgagaaaactgatttttacatactttatactagccaaaggtcccttggccagtaaatggcccttaccactcagctgggctatgtggagtgatacagtttgtctaacagaacttgatgaaatgttgaagggtgaccttggggcagaatttccgaggaggtgtagtggaggagaatggt

SEQ ID NO: 37572 - DNA, 1039 bp, Homo sapiens
aattgtatcattttgtaatatatgttgttcctgagagatgatttgtacatttacattgggttttatttaaaggaatttacattttaggttttatcttgtgatttctaaaagagtaataatgtgtaaagactgactcttgagaggcaagtcttccaggaccttcttcccgggaaagggattttgaatctcctttgtaaaattggccaggtttatttttaatgtcctcccttctcctctcagtttgtctctgctatattgtttcttctttgacttctaaaaccctgatattctactttggacttcatagttataatgagatatctccatctcaaaggagaaattaatgaataccgacatcctcttggagaatgcttgtatttccaatgaggagcttgttgaaacaaatcaattcctgtctgggcctgctccttacgggcagctgggctgtccctgggatccttggatttttctgaattctgctgccagaagagcagggtttaacctcttgacgctctgcttgagaactcttgctattgactatcttaaacttagtacatattatacacacattgatgttagaggtataaatagatcataacaacatgtagctgagaaaggaaacaggatttgtcaaggaacacatattttaatgcattgaaacctgagtaatagattactgccaaagggctgctttcctatagcattgtcaggtggttattcaaagccaattttacttcctatgtttatagttatttagatggatagcaaatatgcctgttacttgttaaaaaatttccatcatatacttacataatcattttgtaatgttgttttactcctgaaggtacaaacctcatttatgccaggaaaaagtaattcataagggaaattatcaatgatccttatgcgctgtacccagaaatttagtgatgttggtgggcagaacttggccactagtaataaaaatactgggtctaacataagccataccaaaattatttgaaagaacactgtgaactctgcataacagatttctctt

SEQ ID NO: 37573 - DNA, 1754 bp, Homo sapiens
agcatccctgtcatcatgaagcattcggttagtaatttctaggtcactgtttctcacactgtaaggtgaacacagacctggagatttcgttgaaatgcagattttaatttagtgggtctgggctacatagggccctgacagtctgcatttctaacaagctcccagatgacattgatgctgctggcccatgaaccgtggtttgcacagcaaggttctagataaaattaagtgggagagagatgacttctggctcttcttcaaggactcttggttgtatttgcgctgaacttttcatagagttctgcagtttctaaaatggctccgtatttatgtgaaggaaaattatttgccatttaagaagcccagaatgcctaatgttcctttctaaccactttccttcaaaactcagacaaataaaacagatttttacattgaagtttatgcttcattgaaaatacaccactaacaaaggtaatgggacagggatttcattataagatttggtctctgtagacaaattccactggaataaaaatactaccttggtccaaaaagtttaaggaggatcctgtcataaatgtctaaagatattaagcaaaccctcccaagatgtattttatgtggcaatgccagaattacaccgcagaaacagatttttaacactttccaacttaaatccgtatggttaaattaaccccaaatgttctttttacattaacataaaagatgactaacagtttttctactttcaatgtctgggtttcttgtgggtggctttcaggagcctgtaatttcaatggagttataaaagacttgggacaaaatgcgttctttctgtaaagttctatgattctagtagtcttagtgagaaacttttgctcctgtagagtctaggtaatataagatctgcaaatatgcttctgctttcctcacagcgtatgtattatttgctttttcaaagcaaatctttgtattaacaagtaaggaatggaactagttaaattcagaagattactctgcgttttttgttttttgtttttactgatcttcactctgtgtatataaatacaatattactaatctaaatgaactttcaagtctttgaaagcatcagttaagtagactgacttaattgaaatgtacctctatggaatgattatttttaaaagagataaaacggtttgtactttaagtcaggtgtatttttatgaaaggaaacagatgaacaggacagtgaccacttaagtataattttattttaaaaagaaatttttaccaacaatttttgatagttaattttaaaacagaagcaaatatttttctttttaaatcctcaatggctttaattagaacattgggtactatttcataataactatgaatattattaagaatagtaaatcaagacagtactgttttctttgtaagtttatgtttatgttcactgtggtgtaaacgagggttctcaaacagtgaatttgggggtgacaagcacttagcgtttccagttttatgattctcatagatcctgaaatgctagaaccttctgtgactctgtgtgaacttaagtggctcctaaaaaagaactatgctatatgcttcaaagattgttaaatttaggaataggaatggatttgttgaaaatagagttgatatacctaagatttgtgttttagatgaagtagaagatgctcagtagttcttaatactgtttttcacctccatttttaaaaaaagaaaataagcacattaaa

SEQ ID NO: 37574 - DNA, 1142 bp, Homo sapiens
aacaatgaaaactaattacacactttgacatcaccatagtcaactatactcttgggaagacaacatgacagaggtggtgtgtgttgagggggtgggtatatgtatacacgatattccataagaatatgtacacctaaggtcagacatacctattggtttaccttcatcctctgttctctgaaggaaaaaaaatgtagaaaggactattaatttagttaattaaaatgaaaaaatgcagttctttgttaggaagggtctccctattttagcgttcttcctttgtaatatgaactgagagaaccagcaatatctgtgagtctgaatatctcgttattttgaatattattttggcatggtcttgttatcaatacatatattaacatatctgactattatcattacgtcttttgcaaattattttttttttacttagctctagatttttcattgacatctggttatttgagagctaatcacttcatttattatgtaaatctctctattgctatttttctcttttgatggcttttagccattttattgtctctgggcctgtagacctatggaagatttgagaaagaaaaggaaactaaaaaaaaaaaaaaaaaaaggaaaacccaaaaaactcaaacttttagcagcttggatagaagatttggtaagggaagaccttaaagctattgaataacatgaagttttggaatcaattttggatttcagtcatccacgccatccctgttctctggtaccacatagaatcagaacttggtcctatataatgttttccattactattttcattcctagggtgagcactcttagctgtatctaaaaccaaagccaaatagatgaattcagcaattacatgttgacttgaacttatttttccaaagttttcacactgaagaaattctatattcctatattgaatatctaaaagttatcattgataaactattgagtgatatttgcagaacactgggagacatacagtggattcagggataagataacatttgcacctgtaaggaacttaagaccattgtgcagatataataattttatacatataattatattacagagtataaaatagtaccataaatgtgcacatgtagatttatttgacagatatttatgtc

SEQ ID NO: 37575 - DNA, 1047 bp, Homo sapiens
gttcctatgatttttacttttaaaaagtcaagtacagttgatttgattgtaataggatattgctgcaagttttatgattggattcttaggagatataagatataaatattctttctattatagcttatcaagtgacctgattttcatgactgatgatcacgattctggtgtgaactaaaagtgggagttttggcatatgctctggacagtcatatatgttagcaaatatgtatatgccttggacaatcatgttgttagtacacattgattagacctgttttaaaaatcgctttgctattaatgatttaaaataaccacgcagtataatatatggattaccatgttggaaacacatgaatacctacttagagattagaaaaaatatgattaagtgcttatttcctgatttagaaaagcttgttttttggctttcagttaaatcagcgtgttttttttcccccctagaagcagccatcttgttttaagaccgattttatttctttcgtgaaattggttcggaaatgaatatggacgatagaaaaggactaaaccactttatgatcattttggcagggctctctacatttaaagcgctatcttatttgcgaacttactaaaatgctatcttcttatatttagttgacagaaaaggatgttttaacttagtaataatatgcttaaacccaggcatattatatattaatgttaaatgttgggctgtaccatgtttccatacatatttttttctcgaagcttatactttatggctaacttcaaagtgatatattaatagcccctattgtcacctccaccctcaaatcctgatttcatttttctgactatgctaagtagttctttttatttgttggttgccttttttttttttttttaattactcaagtctacccggaatctttctcccgcaaaaggtactgataagagtataggtacctctaaatatgaagcagttggggttaagatgcgttatattaagtcagagcctttttgtctctgaaatataggctcttcctatcacattagaacaaa

SEQ ID NO: 37576 - DNA, 1087 bp, Homo sapiens
gccaaataagtattttaaaaataaaaactaacagttttccacaaacaatagtaagaaaatatttcagaaaatttccacgggtttagtaaattttataaattcactgttgtgcaattccttttcctgtatgttatttcataaagtaagctagccatgctttgtgtctttatatagaacctatctgttaaaattttgctaaactagtaagacttcaatcttttgaaaaaagaatagaggactttaattgcaacttaaataattttttttatttttccctcagaatataatatgttcagtgggcacgttaaactgatgataatgtacactgtgtctaaacgaagtaaatctactttagcttatactaacagattcaatttgaaattatgtttaggtaaaatcagaattaaatgtatcttgatcacagggattaagtacagtatcttactgtgtaacttgtgtcacttgtgtatctggtaggagtttatcttctacatggagtttcattactgcctctccattgataaatgagcatctatagatgtagtttcacgggaaaaaatattaaatttatttgctgtcagaatagttttactgttacaatctatgtacccaggtattcacttctgagaagtggatactgagttttcaaatgctgataacttttagttggtagtatttattggataggggaccaaactgatttttttatgtgttgaattggcacaaatttgtgaaatagccactcagaactatcagtttgaatagaaatatatgataacatttgcctaaatagatcttctatatttccaaaatttgaaaacttgtataagttttacctaaaagtgtaaataatcaaatcatccttttaatattattctgaattctaaactggaatgtcaccaagtaactttgagtaatgaaaatccacatcaagaagaatataactatttgtccttaatttctttaagaatgtaaaaagcttttaaataaagttaaaaagacttccagtaataaaagtttatttacattctcctttagtagctatgcttataaagagagtcataatactaagaacatgcctcttcat

SEQ ID NO: 37577 - DNA, 1059 bp, Homo sapiens
cgggcggagccccatccccccgcccacgtccacgttcacgcgtgcggcctcgcgctctgctgaggctgctgccactgggtcgccgccgctgtcggctttccacgcaagtcattaacgagggggcgtgcccgaggagattttttttcccataaagcattttttctctcgctctctttttttccccctcttttgcaaaactgacttttacaaaaccctttccacttcttgccagtcgtttcaattcctcctgggctgctcgtgctgctgctgctgcactcaagtttatttattttcccgcctgggtaggggttttaggattcggtttgtggttttcacctctgttgctgctgtgcctaaggagggaaagaggagcagctgcgggaggatcgggaaggttttctgatgtagtcatcggggaggtgccactcgctcgtgcgctttttttttttcctcttttcccatttcaaactgattgatgcatctctacaagttgctaggcttggacccgctggagtcgcagggacacttctgagagctcaccccgggctcttggcaccgcgtgtgggggctcagtctccctctcggaaggcgatcggagactgacatcggcccatccaggagttggagggatccatttgaaagtgattgtttcccctcccgctctccagccgaacagttgggttggcgtcgtcttgcaggtttaggaatcccagctctgccaggccggctggtcttaacctctgctcttcattcactgtggtgcacccacacccagccaaggaaagcacgcgcgagaaatccccgaggctcggccagcccccggggtgccctcttccgctaccgccgcgttccgactctgctgggggacctgccggaagacgcgaagagccaaacttttctttgaggttttcgaggcaagaccgcttcgaaagccggcgcagctgccgcttaaccagttccaggacaccgacaaggctgggttgcggctccggatccccacccttctcggcgcaccgcccggtaccgcagcacttacgactcctctgagatttctggggg

SEQ ID NO: 37578 - DNA, 1025 bp, Homo sapiens
tgtcctttttggagtggtcatcacagaaccatttgcctttgtatatacagatgggggaagagatggaacaggtgatgctcctacaggctttctgtctttgattcctcccacagagatctaacacattatggggtcctctggatacatcagcagatatttcttggaatcattgtttcataggtatctgactccaactccaatttttgccttttacaccaaattaatattgtcaataaatcagcattttagatttagagtaaacctgaagcttttagaaactctcaataccagaataaattacatatattatgtgtgtgcttaagtatttttattttactattgcacacacatatatcctatcctggctaaacactgtttttataataatttactatgtgttcccactaagtagtagtaaaggtaattttagagcatttaggttaatttatcagatttaataatgccaaacaaatatggctcttttaagtaatgagaccagagtaggaaagaagcatcaggacaaatctgaaaccacagaataattagatttaggctttcaaaagcacttggctccatatcctccatcccacccacaaggaaataaaaggacaaggcatttaaaaatgaattattctctgaagactttccctactgtgtctgtttagtcttcacagttttcaatattgacagtgagtttcttttcaccaccaatatggcaagttcctttgagataaagagagatttcacctttcattgccttgtgttatttcccctctactgaactatgtaaagaaaggtaaatggtaaaatggcagtgcaagaaatggagagctttggactattcactcctgcacaagaagattgttttcttttttatggtgtcagttgatatttggaaaaaaaaaatctgctttagcaaagaattctttttccagagaggtgatgaggaaatatgtataacttctgttttaagggcatgttttctacaaatggctgcttacacttagagacactgataattgtgt

SEQ ID NO: 37579 - DNA, 1022 bp, Homo sapiens
gcccttagccatttgagagtgaacagtcagaatctccacaggccaagtgccagtagttcagtaatagaactttcagccacgacggtcacggaaggaagcctacgaattctgtcaccttcttttctaacagctgaaataatttagctatattctgccacatgagctctattggaggaagggggatgcataagatgctgaattaggttcgaattgaattatttagtcctcttgatgctgaaaggtccttcttatcttttgaaatgtgagtgctaacttgaagacagtgaagagtttctctttctatatctctaacgtgggatcaggattatatccgtccttagtcaccaagtcttgtgttaatggaactaaaactctctggggaagcatcctaaacctatttaacgttcccaagcactaaagtttgcattagaacttttacatgagctaaggtgtctataaaaatacatgcttgcagccaggtccctagtggcttcacatccgaggaaactgtggagcatccgtcattctacccgagggttggaataactcactgttgcagatacttccattatgtaactcagccgagggtattctgcacttgtcacagcagaggtcagccatgattctgtagagtagtgcaatgattcaagtgacttttaactattgttgcccaagatgcaatgatagagaatcatggagtttttaagatgagtggttgatttcctttttactccattaaatgccatggcttttcaatgttgcatcatcatctagttctgtatcttaacccttcagcaccctggtacacaccttgctaacaaacctgtaactctgaaatgtaatcgcagaaaaaagtgtgtggggttttttttttttcacttgatttaaccataattttgtttgagacattgtttagaatcatatcttaggtgaaatatcctgaattactagttaagttttgctgtttgtatggcagatgtttaataaagcactttcttcccccataaattagatattagaag

SEQ ID NO: 37580 - DNA, 1077 bp, Homo sapiens
gttgcttctgcctgaacatatagctgtagctttaagaaaagaaaaagaatagatctgttgaggtgtattgtcttttatagactcagctactgcactgtgtttcatcaactacagattctgattttttgggctgcttcattgtctcatttttccatgactgtatttttccatttttcaaatttactgtcctcaactttcaccttcttttagaataacagctttgtgctttttattaggtttcacagaactaatttaaatgcttattgatttaatactacttatttaatttatttaatgttatttatttttatttcataacatcattaaatgaggccagattacttgaatttctaagcataaatctcatgtaattttccaaaataagtattttaaatatactgaataatttataaaagccttcagaaatttgagttgatttggctttggttatattgatacacatacacacacacacaaactcttataaaacatttttttttcttaaaagtaagggaaagtttgtcctctctcaaataagtcctactagaattaatgaagactgtatcctggctttttggttcttttggttcacctgatagagtttaaatatcctgtaggaaagagttcatttagccatgcttgcctctcttaatgggagctaagtcatatgcaagattattccaaatttttcaaacagcatgtgttttaaataaatcaggttaaataggaaatagttgacttgtaaaacattgaatcatttctgtattttatatgtatttataaatgtgaaaatatttttctaatatgtaaaaattaagaaatagcagaatggtgtaggagatacagtgttaaaatgctctaatacctttttagttctttttctgctttaaaaatctttttattgatgtaaatatagagaaaattgcacacctatcataagtacgcagttcagtgaatcttcacaaactgaatacactctgtaaccagaattcagatcaagaaacatttctattattgccacgatgcccccatgaccctttccagtcattaccctaccccgagggtaaccagtatcat

SEQ ID NO: 37581 - DNA, 1050 bp, Homo sapiens
aatgtattggatgttttctgtgggcattattcatttaattttattaatattccactttagataggtacttttttttttttttttttttttttgagacggagtttcgctcttgttacccagactggaatgcaatggtgcgatcttggctgacgcaacctccgcctcccaggttcaagcgattctcctgcttcagcctccctagtagctgggattacaggcatgtgccaccacgcccggctaattttgtatttttagtagagacagggtttctccatgttggtcaggctggtcttgaactctcaacatcaggtgatccgcctgccttggcctcccaaagtgctgggattacaggcatgagccaccacacccagccagctaggtactattattattcaagttgtagacatggaaactgagacctggatagcttcaggtttacataatttgtgcgtaacactatagtatgcattcagtattaagtcagtgtcttgcataatcactcagaggtcagagaagtgttgtatttattattagcaacacttttttttccagtaggatttttccagatgtcagagccttaaaaatataactaaatccagacagccatatttgttaatctgcatatgaaaaaacaatgtcataaagcgctaccccatgagatctaattatattcttctagaacttaataggtttaatttacttattcactataactttgccatgctgataccaaatgtaagttgcatgccatgattaagtgttctgtagctgaaagggggagattgttattgatattcagtatgtattaatatattcaacaaatattttcttaaaatgatttcaaaagtgtatatatttcttcatgagttaaattttttctgaatcctcttttaaaattattataactaacttatgaaagaagtagtattacctattttcaatagatgaggaagctgaggcctgacaggttttagttaatttgcaaaacaaaaactaaaatttccccattgcagatgacttctcaaatttctctgcttttcatataagaat

SEQ ID NO: 37582 - DNA, 1026 bp, Homo sapiens
ctgtgtcactcaggcctgtggaggaagtggtatttctcttgggccgcacagcacttcatatggtgtactgaacgggatggatgaataaagcgcttatctccattagtgtctccacagtgaatattaccattgtgaaccttgtgtcagggggcagttgtaaaatgacccaggtttctttctgagttgtcacattcttttttcactttagcactcctgtgggccctagaaatacactctagagatatttttttgtttccattttaaagtagtaaaataatctttaattaaagaggactggaaacactcaaatactgacactgttgtttgggggcatacaggttgctgacaacccacaggctcactcagtaccactccacatccttctgtgtggtttccacagacccgtggactgctctcctgaggctgtctttggctgccctgtattcttgatcgcagtactgatctgggactttttaacataaccatgtggcttgacaaaacttttgaattgctctgggcaaaaggtcttccaagtcaaggaggtcactttgtccatgattatgattggagatgtcattttagttgggctgccatatgtcagacatgataaaaaaatttcattctgtcaaacataatattctgtcaaaaaatattgagtcagcacccaccgtgtgctgggccatgtactacatacagatgtttagtttctgcattcctaaagggataatgctggtaggatccagaggacaggctagcctgcttattaaaaaaaatgcatcttgttttccagacaagaatagcagggagtggcctggtgacattattcatcgttttggtgtaacccacacctcaccccagccttgttgaccttctgatactattggaagattaaaaggttataccttccctacctctccttgggataccaacccttttaagctgttagttaacccaaattaggatctgggatacatcatcaaagtaaatacactcatgaaacaaaagaaaccccaacaagcattctgg

SEQ ID NO: 37583 - DNA, 1111 bp, Homo sapiens
cagaaagaatcagcaaatgacatctgctctgcctccttttccttaaaggacaccctctgttggcaaagatgcaaacccgtagtacttaagttttaataacatttcagtttgtaggccacctcttgtgatgtgtctcattaaaacataaataacaaaacactgcttttctaattttgtagccttccattacttctcagtgtgacaaaatgggcatcggtttgctattgtttaagtagcaagagcttaaattaatctcagccacactaatcagatattggctttctagagaataacatttggtagtgagaacttaatgagtgtccggagataattgttgttaactggtggagttggtgatattttgcatgtcactcctagtctttgcccctgtggtatattaagaacgtgctttgagcaaatgctctcgcatgttaattgcaagtcaacctttaaaaaagaatttttcttgcggtaaacatctcttctatgagcacatctttagaagtttacatgaaaaattgacttaggtgtatatttggtattgtgttgtcaataggattgaatagaagagcatttacaaaaaaagtatactgtaaaatacaaagtggatttaacatatcaccttgataccatctgtcatgttccagaaataatcttatatttgtcatttatgtatagctgtttaacttgaagattaaaaaaaaactatttcatgccatttctgcaaggttaagatgtcctattacttagaaaaagtaactataaatataagactcataaatgaaattgtattcaaatgtattaaggggaagcatactattaatagatacttgattacttcttggccttttgactgagatcaagtgtattaatagattctcgaattgactcatcttgtaaaagtttacttgtaaatttacctcttttgtgcatagaaatcttttatattgtgcattttctgaaagcagagtaaacctataaattatacccattcgtttactgcactgggattggattattcttcagtaaaacctgatttggagctttagaaaaatcaatcagatatcattattctttctgtaagataccaaattgtgttttggtgacctct

SEQ ID NO: 37584 - DNA, 1103 bp, Homo sapiens
atcgaatacagctaaatataagtaaacagctaaaataaatttgggctccttagtaattgtgcaatatatggagtattatttcttttctttttccccattacagtgttctctccacaaacttaaattactaactcaactaatgcttccctgagtatatatccacattcgctaacttgcttatactgttaccttttataatttgtcacctttttcagagtgcgatatgtcattgaattgctcttacttttcccagagccccaaatgttgccaaatggcctaatagtattgtgaatctaatgaccctgtctgtgcttacctttcaataaaagatctccaaaaaatgaatttatgctctaactttatttttttctataaaattctgtcattaccaggatggaattcatgatgccctcacgacctatagaagcacaaaactgaccaactgattccaggcacatttacctgccatctctttcaaacacctgccattgctccccttccttattccactaatgacttttgaaaataataaactatttctcctgaactctcaatctttctttcacagaatgccagaatgttatgcctttatttagttgggtacttgaaaggagtgctgtttgtgtagagcagaagtttttaatacagttactctcttttgctaaatggtttgttgattatgcagacagaacagtaactgtattaattaatagtagatcatttcaaaatacgccaaagagatgcactgttcattttggtttatcctttaaaataacgcaaatctgagtactggattgggaatgttggttgtttctgctggctgtcagacatgatgttgcctgcagaggtacccactgtctgaaacaaatagtgaaatgtgccttctcctttctccgtgtttacttactgtcttgcttttgcaactttctgcaaggagaaaatgggtaatacttcctccctgtggtctctatcagtcttccacactggtttcattagctttccaccactctccctatgaacagagatgtgtttctcttcagagggaatagactggtgactaatccatgcagagcaacctggacttttgtgattatggtatttca

SEQ ID NO: 37585 - DNA, 1028 bp, Homo sapiens
taactaaatggtcaagggagcttaatttgtacaaaacaatgactgaaaagagcacacactactatgagctatagattgcgttttgtgcctgtgttccagtaaagtaaccatttaaagtttaagagctcgagactttttaactgtgcagcactcagagagcacactatgtggaggtgcagattttgatttttaatccatagactttatgctattattttagaacatcaagtgatcaagaaactacaaaagtgaatacagacgtctaaaattaaggcttataatagtacatgcagatgtgttcaagctccaacatcctgaatctgtggttttctaagtatttaatgactttgatttttaaaaatcacactgtttctttgtacattatcatacatttacattacatcttgaaataaatttaagcattagaataaaacatagacaccccgctgagttaaagattttaaatcttattctattgtacttacccttagacctacccacttaattctgaggtctgcgtataatctttgccgatataaatgcaataaaatgactaaatcagaagatgttaaaaactgtcagtgtagaattgtgaacttgaataggtagaaaaggaaattcttctaaggcagtaaacactgtatgataaaatactttttcattggtgacccttagggaatatctagtagtgtaaattaccttttcagcttttcaagagcagtttcttattagaaattcaaaggaaatcttctttagtagtaatcgttttaatgctccacatcagtgaagtcaactatggttcctcataaagttttgtttttcattggtaatttactgacaaaatgcagtgaggggtggtgcaggactgagttttcttatagaactcaagggggcagtagttccaggggaacataaccgtctgcaacaaactactctttttttttttttaagtagattaaaatttttagtgggaacattataataacagtaggttatggcacataaaatacagaaaatggcatttttta

SEQ ID NO: 37586 - DNA, 1049 bp, Homo sapiens
aacttctgggccacagctgagtctagtccacaaagctgttttgtttggcatatacagtatttaaaaattttgaattagttgccagcactttaaaaattggtatagttcacataaatattctgaattcaggcttttggaaaagttgtggacccaagaatactaggcccgcattttcttacgtcaacattctttccaggatgatgaatggactgttctctttggccccctttccatttatccactcttcccaccaaactgaattatccttccttaaaattgagatgcagagaattttagatatttcatatttaaatcatatggttctttttaaattgagtctggtaaaatatattaaaaaataatagttcattagtctacctaaattagttatttactatttcaggcactggcatgttagtcaacaggtggaagttatagacggagacagaatgcagcttaaaataagttaaaaccttgattttcattgtctgccttccaaaatagagaatgcactctttgttagtgttcaaacagagtgctgtaaaggagtttcctgaattataaggagggttggactagtttattaaagtccctcaaactccacacctataatttgaagttgcttattttaaaatgaattcattggcaatgtttagtgtttggttcatgattcctttgttttcaatattaagaaaaaatcttaatactattctctctgtctctttttttatttttgtatagaaaaagccctcttttgtttttttaggtatattgaggtgaaagttgtagagtgacagattactccaccacccctttcagtgagactgacagcaccttggctcatgtaaaactcaacgtggctttatataaagatttttctaactcccctgatcttctctggatgtttattctgtttcttctttcaaatttccgttgattcaataaaaaacggtgatatttagaaataaagttcagagaggatttgagcaggtgttggtgatataaaatatttgctgagtgcccattgtgttttatttccaagaattgtt

SEQ ID NO: 37587 - DNA, 1026 bp, Homo sapiens
gtgtgagaagttataagtgacccaaagtatgcaatattaaggtaaatgataagttgatatttaaagtcctaccttagatgtatactagatattgttatttttaattttatttcaattggctgaagcttttgaattcataggtggttaaaattggttgagagagcagttttacagttggacatttctttgtttcagaaagtagtgctttattatataaatcaaagttataaatttttgcacctcatttcaaaaatacttttatcatctttaataatttcatattccatattatttaatatcaaggaaaactttagagagatctttctgattaccatttcttactgataactgatatactccctgtagcatagtcattaacctagaattttagctcattcacttccagcttataacattgagtataattacagaagtcaggaagtaaaacttactaatttcaaattgaaatacttggtggaccaaatgctgttgcctcttggaactgtttatagaacaatgtaaaactaagtaaaacaaatgtgatctgattcagtgtttggggagttcttgacctggatttcaaatatgaatccttacttgccctttaaaatgtttgactcttctaagatttttctcacctggaaagtgttcattccttcactatccatgacaggtgactgggagcactttggtaataaccatgaaaaatgaaatcaagtacaatgctgaagattgtggaagaaatactatttttttcaaatctgcatagttatttattttaggaccagagtctgtgactcctgtttcactagtatggatgacccaactgatttatttttagattattaatattagacttgtggctttctttgcagactttggagcatgggttgggggagaattatgtatacattttggaattttttatcataaaaacgacttaaaattagaaggagagaaagctgctgctgaatgcctaggttatttagtttcttcctaggtgacttagagtgttctaggtctatg

SEQ ID NO: 37588 - DNA, 1163 bp, Homo sapiens
tttttaaagaaaagcgcattggtcatctttggaacttaataaggcagcagtttattactctaaaaatgagtaaacaaaatgagaatcacatatttatcctttttttcttataggaattacaaaaaagtaaacacataattcataagggaaagttcttctgaataggattctagtgacaaatgaaaagaggaatgatagaattagaaaattataattttgcagttatcttgaaataatggaccgaggcaatgatcatcatcaatgaaagcaaaagcgattatatgtggattgatattcccatgtaggaatatcataatggagggaagaagttgatagcatttaactcactgatcaatcttagcatgaagaaaagtgagacagcagaccttaagtactcttgaggtgatgcagtagagagtacacagcatcatttatatagtattcttgctactaaatatacaaaaattagccaggcagggtggggagtgactgtaatcccatctactcggaaggctgaggcacaagaattgcttgaaacccgggaccgggaggcagaagttgcagtgagctgagatcatgccactcactgcactttagcctgggtgacagagcgagactctgtctaaaaaacaaaacaaaacaaaaagcctgaatctaatctgcctctgtatttacctatttacaggaaatagtaggattaaagcatcatgttaaataataccacaaaaagacaatcagctaaatctagatttgtctaacgcaaatgacccagtttctctaaggaaaaaacattgtagaaaagaaagagagacatttttatagaaaacactcaagacaaaacaactaaatgtgatgtggagattttgcttgaatcctgacagtaacaaaacaacattaaaatatatatccttgagattattgagaaaacttgaatgtgaagtggtcattgaatgataacaaagtattattgttagttttgtcaagaatgatagtggtatgcttgttaaatttttatcagtaagagacacatactttatttactggtaaaatgacacagtattagggatttggtttaaaatattacaaagggactaaaaacaagaaaaagataaaagtgcataggccaataaaggaaacaaaaatcgtgaaaatattgggccagc

SEQ ID NO: 37589 - DNA, 1056 bp, Homo sapiens
gtggttttccgggtcataggacttttcagtgctaagactgaaactgtccgaggcaaatcagaatggttggttattctaggggagagggagggaagagttattttgagaggggaagagtgacaaactaatatgtgagtaagtgtgtaatgtgatcagtagtgataagtgttatgaagaaaatcaaagtgtggtgagacacagagagggactaggagagttattaaggagccatgcaattagttttgatcacctaaggaatgaagtaagacggaaaagagaaatgagctgaggactgagatgaggtagactcaaccaagtgaccaagagccaaaagtaaggaaggaggaaagccatgatagttgatacaagaagcaaatgaattgtttccagaagaatcatcagttgtgtcagatactgctgaaatgctgggataattgagattgaccatttaattgataggatagtgacaatgaatgagagggacaaaaccttgattactatgagatcaagagagagtggaaaatgtgtgtattagcttgctagggctgttagaaccaagtaccacaaactgagtggcttaaacaatagaaatttatggtgtcacagttctagagcctggaagtccaagatcaaagtgttggcagggccatgtttcttctaaagtgctaggaaaggatctgttccaggcctcttgcctaacttctggcactctttttggcaatctggtgtgccttggcttgtgcagcataactccagtcttcacatggcattctccctgtgtgtgcatctctgctccgccagttatattgaattgggagcccacttcactccagtacaacttcatcctaaattaactatttacttcactattggaaatagctgccccatttccaaataagatcacattctgaggtagtgagggttaagatttcaaaatatgaatcttaaggagacataattcaacccataaaaatgtagtatatccatacaatggaatatttttcagccttgaaaagtaaggaaattccaacacatattacaacatggatgaacctt

SEQ ID NO: 37590 - DNA, 1067 bp, Homo sapiens
agctctttagtttaattaagccccacctatttatctttgtttttgttgcatttgcttttgggttcttggtcatgaggtctttgcctaagccagtgtctacaagggtttttccgatgttatcttctagaatttttatagtttcaggtcttagatttaagtccttgatccatcttgattcgatttttgtataaggtgagagatgaggatccagtttcattctcctacaagtggcttgccaattatcccagcaccatttgttgaacagggtgtccttttctcactttatgtttttgttggctttgtctaagatcagttggctgtaagtatttgagtttatttctgggttctctattctgttccattggcctatatgcgtatttttataccagtaccatgctgttttggtgactgtggccttacagtatagtttgaacttgtaatgtgatgcccccagatttgttttttgtttttgttttttgcttagtcttgctttggctatgcgtgctctttttttggttgcatatgaattttaggattgttttttctagttttgtgaagaatgatggtggtattttaatgggaattaaatggaagcacatcccatgctcatagatgagtagaattaattttgtgaaaatgaccatactgctaaaagcaatctacagattttgcatttttaacaagctccaaagtgacgtcagtgctgctggaatgagaactacactttgaatggaaggcattagaatttgttcattagaatctcctgcggagcttttaaaataaaattgctgcagagctgtacccaacaaattaaattagaaatcttctttggtgattcttgtgtgcaactcggttaagagccttaacaaaatggcattctttctaccatagggagtcagtaacaaactttcacctatgtctcccttacagccatcccatagtttagattataactgaaaacccccaaattatgatcaggatctcttgtgataaccaggagaagaaactataatgctttaaatacactctttttgaatattctcttatgcatttcaaccctttagtcc

SEQ ID NO: 37591 - DNA, 1075 bp, Homo sapiens
tctctttttccttaggtattccaataattcataagttcagttgcttcacattgtcccaaatgtcttgaaggcttagattattcttttttaatttttttctttgtttttatttgactggattatttcaaaagagttgtcttcaagttctaaaattctttcttctgtttggactagtctttttttaaaattttttgaatatattttgtatttccttcattgaattccttagtccagaatttgcttttttcccccaaagatatttatctcgttggtaaatttttcattaatattcttaattatttttctgtgttctttgtatttgttttcagattcctcttgcatcttgttgaggttctttaaaataaatacttaacattctttatctgggttttgagaatttctttttggttaagatctattggtagagaattattgtgcttctttaggggtgtcatattactttttttttttttcctgaagatgtgactatgatgttggttgagtagggccctttggttttgtttctgggtgcatgcagcactgaagtctgtgtgtgattgtgaatattattattttagctaaatagcattactggtatccgtggtttcctcagtttgttagggtgctgttgttttttggaggctgtgatgaagttgtgctggggtctgggatgctgggtggcctggtcttcaagttttagtggtgatggtggtggactaagcatgccttttgttcccagggctttgaacactggcaactgtgttagtgattccaggcatgctgattcttgggcctctaggtgtctttcttgaatgttggttgtaatagcagtttactggccaggtgaagcagctcacgagtctctgagttggctgacatggcattgttgatggcagtaacagtgttgagatgcttttctgggttccaaatgctgtgtgcttgtgttggcagtggttgaaatgtgcaggctggcttccaggccagcaggtggtgcttacaggtaagagccagaagcagcagggtgtttatgtccaaccttagtctctcaagaggagtgcttcaatgtaccaggtgg

SEQ ID NO: 37592 - DNA, 1060 bp, Homo sapiens
atacctgatacattcaacccacttgatcatggtatattttttggatgttcagttggatttggtttgctagtatgttgaggatttttgtgtctgtgttaaacaaagatattagtcagtagttttcttgttatgttgtgtctttcatttttggtatcaggatgatactggattcatatagtgagtttgggagaattccatcctcctcaattttttgaaacagttttaggaggattgtagttagttctttgtacctttgggataatttggctgtgaatccatctggtcctgagtctttcttttttggggagttttttattattaatattactgactcagtctttttattactgactcattattagtttgttcaggttttctattttttcctgatgcaaccttgggaggctatatgtttccaagcatttatccatttcctctgggttttctagtttgtgagcatataagtgtatgatgatcttttgtatttctatggttataagttgtaatttctcctttttcatttctgatgttgtgtcttctttcttctttgaatagtctgtgtagctatttatcaattttgtttgtctttttgaaaaaccaactttttgttttgttgatcctttgtattttttaaagtctctgttacatttagttctgctctgatcgttgttattttgtttcttctgctaatttggggtttattttattcttgcttttatggtttctggagatgtattgttatactggcaatttgtaatctttcttcttttttgatctaggcatttaatgcaataaacctccctctcagtactacttttcctgtatcccacaggttttgttatattgtatttctgttttcatttatttcaaaaaattttaatttccatcttaatttcttcattgacccagtgttcattcaggagtatgttgtgtaatttccatgtatttgtaaaatttccagagtccctcttggtattgatttgacctttggtattgattttctagttttattctactgtggcctgagaagatacttgatattattttgatttttaaaaat

SEQ ID NO: 37593 - DNA, 1030 bp, Homo sapiens
ttgttgaagattagattgttgtaggtgtgtgtcattatttctgggctctctatgctgttccatttgtctgtgtgtcttttttctaccagtataatgctgttttggttaccatagccttgtagtataaagtcagggaacatggtgcctccagacgtgttctttttgcttaggattgctgtggctattcaggctcttttttggttccacaccaattttaaaatagtttttttctaattctgtgaataatgtcgttggtagtttgataggaatagcattgaatctctaaattgcttttggcagtatggccattttaacaatattggttcttcctaactatgagcatggaatgtttttctgtgtcatctctgatttctttgagcagtgttttgtaattcttactgtagagatccttcacctctctggttagctgtattccttggtattttattcttttttgtggctactgtgaattggattgcattcttgatttggctctcagcttggatgttgtttgtatataggaatgatactgatttttgtacattgattttgtgtcctgaaactttgctcaagttgtttgtcagttcaaggagcttttgggcagatgctacagggttttctagatatagaattatatagtctgcaacagggatagttttgacttcatctttttctatttggttgtctttcattcctttttcttgcctaattgcttgtctatgacttccagtactatgttgaatatgagtagtgagagaggacatcctgttcttgttctggttttccaggagaatgcttccagcttttgcccattcagtatgatgttggctgtgggtttgtcatagatgggtcttattattttgaagtatgtttcttcaatgtctagtttgttgagggtttttaacatgaagggatgttgaattatattgaaagccttttctgcatgtattgagataatcatgtgttttttgttttcagttgcatttataagaggaatcacatttattgacatgcatgtcgagccactttt

SEQ ID NO: 37594 - DNA, 1070 bp, Homo sapiens
gaggctgagctattcctttaacaccaaatattagaacaaagaatggatgtaacttcctaattcaaggaacgtcttaacattttagaaaaacatttttgaattaaatttacatattcatcatagaaaagttgaaaagtggagaaaaagaaaattaataataacacattatcaagcatgtactatgaaccaggtacttcgtgtgtgttatatcatttaatttacaaaacaacataatcatacaggtattgttatctgtattttgcacgagaaagctgtcgctaagagctttcatttacccatgatgtcattactagtaagtagaggtgttccagtttgcttaacttcagagtccacacttccctctttttgttggttttctgtatttgaacttggtataaatggcatcaatagtgaacattctgcagttttcattttcttcccaacattttttgagatgtcatcagcattgcttcatgtagttttacttcattcaagtaattaaaagtgtttttaaaagtagtaagtgtacatagtttaaaaagtcaaagttatgtttaaagtgaagagtagatacctctctctccatttttagtcttctccacagagacagctgttttcaacttttttgttattgtattttctctttcatttacctttgtattacccccacacaaatttctcactgccatttcctgacttttaaattttaattacataatgcctttctactatgaaagaaaataatttagtatttttcctcccttccatcattttctgtttttttctcttcccatccttccaatatatttatataacactatcattactgtgtgaacatttgcaatagagctacataatgtactatgttcggttttccctcctttttgtaacttgtggttgtttacaagcatacctcattttattgtgctttgctttattatgcttctgagatattgtatgttttacaaattgaagatttgtggcaaccttacatcgggccagtctgttggtcccatttttttcaatagcatgtgctaatttcatgtctctgtgtcatattttggtaactc

SEQ ID NO: 37595 - DNA, 1032 bp, Homo sapiens
aacaaagtcactgattttttatatgaaaatgaagacttgtagtgtcagctgtattacattgtttcaaatcatgaatcatatcctgattccccttgactcctcttgctttttccttatccacttaatgtcatcacttcttcctagtgttctaatccagaaacttgagattcagccttgattcttccctatctcttgtctttctcctaaaaatttagtgtctaagctttggaaataactttattctttcttttctcctcacaactctcttatttcagtcttcctcatctattccagagagcttattgtgtaatgttgactaattgaattactaatgttattgtctccaatctcttccctgttccaccctattcttactagcactgaaaggtttttttttttttttttggttttgtttaattttcctactagaacacttggctggtcattttaaagattctttaatggctatctactgtgtgctacacagtcgaatctaaattccttagaatgtcactcgctagaactttatagtcttgttccagttgaccttaagccttacttttttcctttctctttccctttcctaccttttgagacctgaggcacaggccaaatttgtgaagtgttactttaagaattaatcatgctggtttgagctctattagcaattggattgtattactggaagatctcttattactagaaggtttgttgattgtgtgtgtgtgttgatagttgtgaactctttgaaaacagtaactgatttgtttgtttgatctgtcaatttcaagtcttaaggatagtgcttggcaggcaggagtctgtataataatatagtaaaaagtatggactctggagcagaccgtctgggttcaattcttagctcctctactttgtctccttgaacaatttacttaattccctagcccttcagtaaaatggggattataacagtatttatgttataagaatactatgaggattaagtgtgttaatatacatgtaatgtgcttagaatatatgagaattaaa

SEQ ID NO: 37596 - DNA, 1093 bp, Homo sapiens
atatatctagtctttgtaaatataatttaaagactttttgattatgccatttcaatattggccaacaatgtgaagaccatgattgtttttaagagcgtatttcagttgctagatgcctttttttcttttatcacagttcaagagaaaatatattcagaagaatgtgaaaatatgttagcatttaaggctccatgattgcttattaaatattggtagtattaaaatgttttaaatatgatctttcttgcagatttgagtttaaattttgtttaattttgaagtaatagaaaatagaaatgttgcaaaaatagcacaaagaactcctatttaccttttacccagatttaataatgtttaacattttgccaccaaatataatatctcccatcatcttcaatttttatcatgaaagtctacatttttctgtatggtaactaaagattcatattagtaagaattttatttttagatttgttttatcaggttctttctttttgccatgtaaaccttatatagtaaaataaatagaatactgtattaattgttcaaaaatgttttttagatatgctttgggactagaactgatgtgcattaaatgactacaacgtacagatattttccttctttcatatatgtggtactccttgtcactcaggctgttgaatgaaacagtaatccatatcttaataatgggttgaagaataatagacaatagaatatcataatatataaatgtaaataattgaaagaaaaatctttaaacctggtaccagcctgtgataattcttcttttgccactatccaactcttactgaaatgttaatgagaatagtttaatatagctactaagggcatattttacagttgttggcttgctgtaaatgaatgacagaactaggtctgtctgttttaattcttccctcaccaacacagtggtggacttcttacatggcagaaggtagagatgaaattaaatggccttaagtgtctgctttttgaagacagcttgggctgttgttttaaaattgaagtctgctcctagaggatgtttatccaatccaggtgtccaaggttggatgtaactataagtggt

SEQ ID NO: 37597 - DNA, 1091 bp, Homo sapiens
ttatttaacttcggatatttggcataaagtttggttcgcagataggcattaaacgtgctttttctttaaacaaatttgcgtgatttttccaattaaaatcagcattatctataaattgttacaaagcgaatttgttttaagaaaaccctgttcgaagataacctacttaaatatgataatatgctgaaaatgaagtttttagaggcttacagaattactttggttattttcttaattgtaaaaatgagggtttttgttcttaacaaatctagcaattacgtatttagtaactgatatctaattggagcaaacattgtgggaagtagaaaacagagttgagccttccctcagatttaaatgtttaaataaaatgtaaaattctcaaaacatttaaagtcctaacttgtaaaaatttcatttaaaacattttcatgttaaatagacttgtaaaagggattgaattattatagtccaatttttttagttctcttttctagacagaagagaccaaaaaaaaatttttttttggatgctttccaagagctgtatgtatttgcttgagaagttacaatcacttgattcaagtctgagttttattggacaggcttgtctggtgggttaaaatcccctcatgctctcccagatgattactggcttgtttttcttcccttaaaaatagtaagaatttatttttttatagctataccagacctagtgacataggccactttgggtctgtatgctgctggcttaaagaaagaatgaaatatgaaaagacaaaaacaaagaagggcgtaaaagaaaaggtaaggaaaggaacaaagctaaaggtaaaagaaaaggaaaacatgataattttagagtggtgaaataatttctagctagcaaggagagagaagtttgtaatgctaaatgttctaaaggaggacctcatcatcttagaaaatgttttttgaggtaagagaatagatttgtttaaaatttcaaaattgagtaatttttcatgatgtgtaagtaatattcgaggcaagtagtcatttcgggaccctagtaaacagtttcacctcatattttgataagtttatttttca

SEQ ID NO: 37598 - DNA, 1022 bp, Homo sapiens
gtttacctctaatatctggcaaagtcaatatttattattatttgtagaaagcgttgtggttcaaaaatgtaattattttcaaaaatacaaaccaggaagtcttgctcccatcaatcaccatcttctccactgctctctatgtataattagtgtttatgaaaatatgaaaaaaattcttatattattcttttcttatacaaagagtagctagtatttacacaaagaacaggatgatatttacataaaagttagattagtatgtacatcacacttttttcccccgcacttaacaggtctttcataattggttcataagattgttccctttttttctcctctgaaagtgttgtctagaattgggaggtagcttaattctttcaatcagtagccagttgattgctagacacttaggatatgccactgttttgcaattaaataaattatgtcatttataaatatactgtacaaatttaggtgtatttgtaggagacagtctcaggatgggattgctgagtcagagtgtacaggcccctgtgattttcgtagatattgccagattgccttccttagagattatgccattttgcattcctatatgcagtggattgagagtgcttgtttcccacactcttgccagtggtgtgttgttaagctattcaattttttgccattttgacagtcaagaagtggtatctgagttggttttaatttgcgtttctcttattatgaatctgtttgggaatggtatgtttaaaaaccgtttgggtttctttttctgtaactgtgtccttggctcatttttctactgagttgctaatctttttcttctaccttcctaggcactttttataaattaaagatattagttcttcatatgtgattggagttataattttttttcttgtttgtcatttagttttaggctttgcctacatagcatttttgacatgcagaagttttttcttgtttttttttttaaatttatttacatttaccacttttttgttttttggcttctgagt

SEQ ID NO: 37599 - DNA, 1030 bp, Homo sapiens
cttcttacatgttataagagttctatatttttgatataagttcttgtgtcagatgtatgcattgtgattactttttctacgtgtgtatcttttcgttttaatagagtcttttgaagagagcaaggtttttactttgatgaagctcaatttattaatggtaagggcttttgggtcttgtctaaaatcttctgatagtatcagttgtttttctctgttattgtttgtttatcatgttccacccttaaagtgtaaactcagtggaaatggggagattatcttccttgttcctttctatgtcctctgtctagaagagtgttgggcacatggtagttgctcaaaagtaatttttgaatgagtagagtcttttggttttgtaggctagaaaatgttagctattgcttatgtcttgttcacttctatcccctgtatttcacctgtcattattactgtcttgtttccttaggttgattccttgcttttctgtttctacttctgactctaatcctaacgcttttatgtttttctgaactgcaatagcatctccttaggcttgtcagatgccacgacttctaggtgtacctatgatccaattccagacaaatagggtatttactgtttttcaataacattgctttcctgcttaagaactgatttaagctctattatagatggtgaggtgggacctgctatgttaatatttctttttccctttcttcttatttttcacagtttctacctttgtttatactttttcctgaaaaagtatccctttttctcttgctaaaataaatcccacttatttttcaagttttccatttattcttaagatcaaatttttgcccaacttacctagctgaatatttcacagatactatatttttgtgcccttagaattgtttcctccttgagataagaattcatgcattctacttacttggtaaagttttgaatacaaagataatacttcttggttgatcactcttttcttccttgactgaatttgatggcggtacgtggcaagtttgtgcct

SEQ ID NO: 37600 - DNA, 1028 bp, Homo sapiens
cattgtatatattcctctgaattcactcataaactaagatgtttctaaaggttgacttttgttggtcatatctacagtccaggagtgctctttccaaaatactatttttatcatttaagaaatatgtagtggctcatttcaaagatttcttcagttactagtctctgtcttattacttttttttttttttactttttgtacttgtccttttatcactcttcttctttcttccagaatgtgttcattactaccttcaagctcagctgaatattatttttcgcaaatactctttgagaattacctcacattttttactttcctgtattctgtcagcttcctgtatttagttagttcttactaatccattgataatttgttgtaggtttgagagttttagttcggtaatgtctcccagtgtaactccttggaataagaatgagatcgtttgcatacacgttaaagaaacctgtatattcttcagtgttttgattaaatggatagttgttagaacttcttaaaaataaaatttttttcagtgtatgaattgtaaattttctgaaaggaactgccagtgaagatgaaccattgatatacttaagtccttttgctttagttctgggaaaattcttttttttttttttttgagatggagtctcactctgtcacccaggctggagtgcagtggcacgatcttggctcatggcaacctttgcctcccaggttcaagcaattgtcctgcctcagcctcccaagtagctgggactacaggcgtgcaccaccacgcccagctaatttttgtatttttagtagagacagggtttcaccatgttggccaggatggtctcgatctcttgaccttgtgatccacctgcctcggcctcccagagttctgggaggcgtgagccaccttgcctggccaaaaattctctttgagataaggaagaaagagtttcttttaaaatcacattttaaatgagacaagtcagtaactttaaacataaccatttatactttaatatgtacataaa

SEQ ID NO: 37601 - DNA, 1979 bp, Homo sapiens
tacccagcagatttacctgcttaattatattagtttagcaatattaaaattagttcactaactctggggattcatcagctgatgataggagatggccaaatgcaaacgggatctcaggaggaagctagcttagtattaaaaactccgataaggatatcccagtgtggataatgcagaatttgttatggttaaaaataggaaattccaaatagtatttaagtattctttaaaaatatatttttttctggatcaaattttagaatgcttcttttggatttaaaatttatggttagtagattatttttagtgtaattccttggctagtgcttttttccccacatacatagtctgtagtttaagtccttttttttttttaataaaaatctaatttttatttgctttcttttttgactacctgttaaaatcagatatttgaagcaaaacaaattatctctaagatacaagtgtggaagtgcagtcttgggctttgtgctcaagtgttggcaacgggagatagtgggttgagataaagacttgagtcattaggcttagcaaatagaaattttataaggttagatggcagtggcatgctagtagtacattaagcctgtcatctatgaggatattttcctgaactacctttctagccagtcaacaagtgaaatgtattatttggatctaggaagaagttttggcttatgtttttatccacagtaatgaggttctagggttttaggatatccaagacttattcccagttatttcagtgactaaacttaaaggaaggagaattggagaattagctttttttctttctttcttttttaaataaagatttgcctttctaaatatagtttacaaactgtagttgaatctggcttctgggtaataggatgcactttttccatcattttattgtagtcattatcacaaagatacattattgtaaatgtcctatggcacttgggcctttgtcaggtaaccctgtcttcaggcaaagatatacaggtgatgttcctatctaaacctgtgtgctgagtactgttcctattagtgctgcagattttgcttactcatattaggtaggttgtcttcttttgctgtctttctttaaattatttacaaaggtttgaacataaagttacctgacaggcagtagaaggatgtattcatcatgtgagttttggggtggattctttttgttgttgttgttgttgactatatcatccagattttaatagccaagaaatttaaaagccagataagtccatactgtttcgatacttttttttcccaacccttcttctcttgcatcttagttgtagccacatctaggttgcagactatatcagtatagtatttttctttagtggctgccatatttcattatttttggtttctaaagtatgatggtagaagtactcaagttacttcaggagagtttggggataaaaaatttgtagtgtctgttaccagatctttattggctatttttgattggagcataaaatctagatggttatcattcactttaataaaacatataaataaatatattgagactctgtaatacaaagaaaagtggttgtaaatccgagtccttcttactgaactatagttgggtgattttcttttattttcatttttactgtatatctttgagaatataaagaagaaggcatatatttatattcattactgtttaaatgtccaagtgaacgccgagaggttataaaattatttgcatcatgttctagcttttcattgtaactcctctgagaacatgataaaacttctatatctttttagtaggttaatatttattctaagtatttgaagataattttgtagcttgctatttcatacattttaaattgttgcaggacactaatatatacacatatactcattctattaatatactgataaatctctgtttatcatatataattgtaggcagtttcatcagatctagtata

SEQ ID NO: 37602 - DNA, 1050 bp, Homo sapiens
acaggtgggtgtcaaagtcaaaattctaacccagatctgttaagattcccaaacttctcttctctagccctttggattgcatggatacattacctgtaatgctaatccacacacgtttgaaccaagtagcaacttccaaaagacattatctcccttgaaaacacttatggaccagtgctgtgagacatcaaaggaagaagttaattattagcatgagtagaaaatcattttttaggatgataattgatttcaggagaagctgcaagtaccagcagaagtgtatttaaaaatttttctaggaaaattcctgaaattatcaaagaggaaagctagtatttagtgttaatcttaatcctatttgaatatgaatataattaataatagaattgcagtattttatacaaaatttctctgtattacagacatagtgttttacatttttgtgatattttgattcagaagctagtaccatttgatttttgtccagaagatttaatggcaattttaatgaattcatgaactgataactctgtactctgttccttaacacttgtttcagatgttcattcagttccattaacatttgaacagttactatgtgccaggcactgtgagaggtgtcgaagaattaaacaagagttatactgccaaagagagaagatcctggtctcatgatagtgctatagaaacaccaattgcaaaaatagttattcttatgtgagggataagaaaggaatctgaaaatcctataaatagtaagtgacatttgaactaagttttgaattacatgtagtgatgtgatgaatatgcaagcagacatattttagggtaaggtaattgcactaatggaaaagagcgttaacaaagataaaacatcagaaaaatatggggaatgcttaataagtggtgagtgttacagtgccactaggttgataggctaggtagtagggaagtattcatatttggtctggaaaagaaagaaaggaccaggttgttaaatttttttcagtgtcatgctgtgaaatttgaaagtctctaggtaataagaac

SEQ ID NO: 37603 - DNA, 1034 bp, Homo sapiens
ctgcctcagcctcctgagtagctaggattacaggtgcaagccaccatgcccagctaatttttttttgtatttttagtagagatggcgtttcaccatgttggtcaggctggtctcgaactcctgacctcatgatccgcccacctcggcctcccaaagtgctgggattacaggtgtgagccaccgtgcccggccttagatgtagaattttcccaaaagagaattctttgagttctgtttcagttatttttgagtgagacaggtgtcatgtacctacataggtatagtttgcatttgctgtaaaactcttgtgtcgactatacacatagatttgaggagtatagctgtagtgagggtctagcatattgtatgtgtctgtttcttctagtgataggttttatatcacttttgtatagtgcatgccacaaagctatttttaagtcatatttagtttgagcatatagtcattatctagaaacctcagttaagtatatttcctgtgcttctttaatttccctgtaccagattctgcttctctactttttggacagagaacctctttgggtggctttttattccattgtaaaacgatgaggtcggatagattacctgccatttgttatataggccagtgttttaaactactggaattttatgagttattctaaaaatagcttctgtgctatgccctatgtcagagtatttttgatgtagatctgtatgcgttatgtgtgtgtttggcctattttttacattttctactctgaataattaggctgtaaactattatagattactcaattctcaagaaaatagtaatactatgaatagatttcagaaagttatagggaaatgattatagggaaatggaaagttgatttcctgaaagttaattgtgactgtttacttttcagtctcttagttgatattttactagttttataattctgtgacttctcttagagtcctttgactgctgctgtaacaatcttgttttaaatttcatcctttggaggcttacatgaatgatgtaggat

SEQ ID NO: 37604 - DNA, 1057 bp, Homo sapiens
gtatctttaagttgtctagtacgaagtctgacttacaggagatatgtaaaacatagtagtttttatggcatcacaactgtatttgttacctaacttttggttttcactttacatccaaggtaaattaaaggatggtgatctcaatttagaagttttctgtttctcaagcagtaggatatttgttgacttttatttttcttgttgagtaaacataaagaaatagttttattggcaatcaaacaatttttagccaatggtttcccaaagaaagcaactgtttatgtttttaaggtttttgttatgttcacattagtttttttctagtattttggtacattaaaaatatgttatatacgtaaatgctaagggcatcagttttgtatttttttttatttaacattttcatttcattggaaatttgaggtaattttgctaagtcttaaaggctaattcactacagttcttcccatttaagtttattacaaaaggaaatttagaataatttgaactctttattggataattgagatattgataactaacctcctataggaagtttgtatttttaaaatttatgaaataaagagaaatatttaaatacttgcgaagccatagctttaagtaattaggatgtttttactttgacacctattcttagtaatgtaacaacaaatattttaagttagcaactaatacaggtacgtacagagaacactgtcagaaagaatgccaaaagaatttcaactatgctttgacaaatactgataatcagtcaaattattttgctaattctcttaataaactgaatattctcaaaaagagtattatagcttaattgcagagtctaaaaataatcatagcatagttttcatataaactttgctgacttaaaatatcaagctattttggtagtatttgagtatacatacatcttttcatattatatcttggcctttagatggcagcattgtctttgtatatttctgtgacatagcttttatgtccttgatgtaactataaggatgtaatgcctctataagtttctgctgatggtttc

SEQ ID NO: 37605 - DNA, 2080 bp, Homo sapiens
aaatcataatagcttctcctgtgaggcactgttccccacatctgactttacctcacatgctggtaatttctgcatatgccatccacatggttctcatctttgtgtggttatccacgtggcctgtatgaaaagtcatttctttatagataaagccaccaaagctacttttcaatgtcaaaacaccatgtagtcagtttaaattattttcccagcctgcggcgctgtgatttacgtgtcttaacctgaggttctaccaacttgtccatgcacattgatgtctaagacttcaccaaaaaccacacttattccttctgttgatatgtagattctcttcttttatttctccgtttttctagcttgtgtactaactgttgaggtctcatggggcctcctattcactgctcaggatgttatcaaattgataagtatgacgaagaaatagtgatgaaggagcaagatgtcagctttagcactcagaaaatctaaggtggagaaggttgcttacaaacaatgctaaatgggattgttaacctgactctggagtttggctaactgactagtcattgactaggctgaccagcagagtggccccaaatagagaaataaagattgcttgctccctgtatgcagtttattcacaaggggaagaagtatacatatgagctgaaaatatccagtttattaaatacagaataatcagtggagagaccgggaatcagactagttgggcttcctacagaatgagaaaacattttcccctggcatgtttgtttgtattttttaaaaaacttacccacttttgactgtttattgctgattccttgtatcaaagataaggatttagctcacttatacttccttccctgtgtcttatcctctcatccttccaacataattctattataatttttgttaaataagtattcagtatttacattctataattatgtacctatcttttttctctaaagcattttgttttcattggaattaataaatgtctttttatttctttacctagtttttatactcttaacactaatgaagaccaaagctttcctccagttgcattagtatgtctatatgtgaatacttaattacatttactgccctacagcagatttgcctgggatagtctagtctggacttctcatatacaagtgtgatggcattagtggtcaccttagtatcttacgaccgttatccttaagattttctttctcttgctgttgggttagatcttctgttacccagatgtcatgttttctttcccttggtgtattctcgtgttttatagagcacagattccagtaccttcctgataaagtgtatatgggaggtaaatcttttgataacttgtatgtctgaaaacatctctaattctgctttcacacttaattcataatctgaatcccgagtacagaattctgggttagaaataatttatcttcagaatttgatggcattggactgttgctttcttttagttttgttaagaagtttgatgcattttcatcctaatcctttctatgaagtttatctaagtctgtagaatctctttaaactcctgtttctgaaactttttgatgatttgcattgccatgtgtctatttttgtcatttatgctggacaagtggataagccttttcagtctggaagttgatatcctttcattctggaaaatgggatagaaatgtttctttgaattcctccgttttcactgtataaacgttcacaaatccccatattttcagcattgtgctttggttctcagctatctgtggtataccccagtccaaaaaccctacgttttgctctccccagagaaatacatttttttgccattgtaggaaaaagggcaaggtcaggctgtgcagtaatggggaggtgatctgaggatttaactaatttttaaacagactttcaagaattctagtatttttagccccaacctcagcctcactgccagacatatatgtgagcctgttgagagttcttcaatagacttctttgcttttcccactgttggctttggatttagtttcctcaacatttgttatagaaatatatatgcctcttt

SEQ ID NO: 37606 - DNA, 1497 bp, Homo sapiens
aatattttaaagttttctggctgggtgcggtggcttatgtctgaaattccagcactttgggaggctgaggcaggtggcttacctgaggtcaggagttcgagaccagcctggccaacatggcaaaaccccgtctctactaaaaatacaaaaattagccaggtgtggtggcgcacggctgtaattccagctattcaggaggcacaagaattgcttgaacctgggaggcggaggttgcagtgagccaagatcatgccactgcgctccagactaggggcagtgtgagattgtctcaaaaataaataaataaataaataaataaataaataaataaataaataaagtttttcatcccttatattattgatactatttacttcacatatataagcatatatatgtgtgtgtatatgatgaaatacatcattattattttgaagaaattgttatctgctagcttaattaagaataaggaaaataaatgtttttattttaccttcattattctttctctgatgcattctttctttgtattgatccaagtttttgacctgtgtcattttccttgtttctgaaaaacttcttttatcgtttcttgcaaggcaggtctagtggcaacaaattccctcattttttgttagacaaagtctttatttctccttcacttttgaaagataatttcacaggctatagaatactaggttgttggttttttttcactcgaaactttaaatatttcactctactttcttcttgattgcgtggtttctaaggaaaagttagatataatttttatttttgcccctctgtaggtaaggtgtttttatcctgtggcttctttctagatttcttacttttttttttctttttttttttaacctttgattttttgcagtttgaaaatgatatgcctaggtgtagttttttctttgtttgtttgtttgcagttttccttcatggtattctctgaacttcttgggtctgtagtttggtatctgatcttaatttgggtaaattattagtcaggagtgcttcaaatgtttctctgttcctgtctctctctcttttcttggtattcacttttcacttatgttataccttttgtagttgttctgtggttcttagatattctgttcattttttttcagtcttttttctcctgattttcagttttggaactttctattatattctcaaactcagactttttccttaaccatgtcccatctactaatgtatctttttatagtgcctattggtgcttgcgtgttgcctacttttcccattaaagctcttaacatattaattgtagttttaaaaaatttccggcctggtaattccaacattcctgctgtatctgactgtggttctgatgcttttttcagtctcctgaaattgtcttttccttgttggtatgccttttaatttttcattgaaaggtggacacgatgcacaggttgaatgtccctaattcaaagttccaaaatccagtatgttcca

SEQ ID NO: 37607 - DNA, 1020 bp, Homo sapiens
gtatcaaagtaaatctgcaaattccttctaaatttcatgtgcaaataattatatataaatatatttaaaaatgctatatatagtatatgccatagtttagaaagaatattaacctttctaaactaaatttaggtttgcagaaagtattaaacatttttaagctgaatgttgagacagtgcatccattttctttagttgaatatgtttgtattaattgtaaagccaagcttatcagttgactctctccagaataaataatcatctgtgtggcatacgttattggctttgtctgtaatactgccactaagtgattataattaagctgtcctgtttgcatcaaatgtaaagactgtgttcacaaccgtagtaaaatttggtttcattggaaatgaaacaaattctaaagtatgctttttcactagtccctttgattttgctatatcataacctcttggttcatatgctgagaaatttttcagaaagtccatttttgtttaaaattagaacttttcagaatgccaaatgaaggctaaaattttggccagaacattacaaaagttttaaatcgtagacgtaactccccctgaaataaagttaggtagtaaaatccttaatgaaaccagtggatgtgcttaacgtaaggttagtaaagcatacaaagaatctagtgtgctcagggcttggtacaatgagctgaattagatggccttatgaaactctttctaacctcttacccaacctgtttctccttggttaaaattatacttgaaggcccagaacactcatggcacatttgtttaatattgcttatagttagtttaaggtaattttgcttctacagtattttggaaggtctgaaaacttgcacagggtcatctttgtaattatataaccccaaactaagatgcacaatgtctccttcaggtgatcacacacagtggacgagtatgtgcaaacatggacataatagttcacttacaaatgtgatttgatgttaacactagagaatgatgactgtag

SEQ ID NO: 37608 - DNA, 1037 bp, Homo sapiens
atatttaccatccagttcactaggaattcccaagtcactttcccaaattatctacttaggaatacaactccctttcttccctataaaccagtgctttttttctccttcccttttcccattcctttccttccttccgtctttccttttcctttctttgctgttcctctatttctatttgccactttgttcttctcaaaattccacttaaaatctctgaaatccagtttagaaatgttcactgttcttttataaaatatctctgtatgagataacccatagtgcctgtcaggtagtaagtgcccagtaaatattttacaaatcatatcagatgaaagctattattagaaattagaggtgtttttattttattaacaacaaaatcacaaataaaaacttatggtgcaagttacaaagaccagctagcagtcttcagtaaacagcacgtgctaatgtgtattatttgaggagtattgtctgcatagagataatgtgtgtctcaagtctcatgagacttcctggtattctggattgaggtataatgctggattctgaattagttttaaaatactgctttccttgctctctcccttctcccagaacaaaatttgggaaataatattttaggtgatttttcttaatctgtttatctggcattttgttaatacagcctagatggctgtgctgtacaatataccaacctctagtgtttttataagagttgaagtaggtaatccatgatgaatttaatatagtgtttggcacatagtaaacatataggaaaagtaatggtaaacttattactaatgaaagttagaattcagtagaaaatgactttttcagtgtctgtacatgatggtggtagtagtggaagtaggtgttattaaaattattggggaagcagaaaatgcagagccaccaactcttaaaattttcgagcatggctgagtctgtgaggtccattccctcatttcatttctactcccatacattagaccttcaacccttgttgtcttaactactattgtagtgacctactt

SEQ ID NO: 37609 - DNA, 1051 bp, Homo sapiens
ctcattgtttaagtgaggtggggggtgcatatacacatgtacttcaaaaaagtatagctaaagtttatttaagggatttaacctccctccctgcgggcgaatacccagttgtcccagtacattttgttgatgagtccttttttgtttttgttttttgagacacagtctcgctttgttgcccaggctggagtgcagtggtgtgatctcagctcactgcaacctctgcctcctgagttcaagcgattctcatgcctcagcttcctgagtagatggaattaggcatgcacccagctaattttttgtagttttagtagagacagcgtttcactatgttgtccaggctggtctcaaactcctggcctcaagtgatctgcctgactcggactcccaaagtgctgggattataggggtgagccactgcacctagcctaatgagtccttttttttcttcctgttttgaaatgcttcctttatctcctccttattttcttgatctgtaccattgatttgtgtgtctctgttcctgtttagttagtttctagtaggagtagactgacagtaaacaaataagaaaatgttaaacaaaaataaattttatagtttaaataagcagagttatgtggtagtcagtaactggagagctatttaaactgaatgttcaagacaggcctccctgagatggtgacttatgaatctgacatgaacatcaagaagaaagtagcaaagtaaaaattcagtgcaagaacattttaggtagaggaagtggccccaaggtagaaatgatctccatgtgtttcaaaagtaggaagaacagtaggagcatagtagctggggaagagtgatgagagatgctgttggagaagtgggctgagcagaaagcatgtgttatgtagggatttgaaggccaggttgaggaattcagatttaaactgtgaagggaaagtactcaagagcattgtttcaaaattcaagtagtcagggttggatttttcttacgtttctcctacagaaggagaaaacagcatagataatttgtaaatcaaataaatat

SEQ ID NO: 37610 - DNA, 1023 bp, Homo sapiens
ttccattgatacatttgtctgcctattccctaacaagcctcttattatcataagtttttaaggtttgtcttctgaaagagttacctctttgtaccttgttctttttagtgataactttggttattcttggccatttacactcctatttacattttagaatcaccttgtcaattttcccccaaaaaaatgcctgctgggattttattaggattacatttaacccatagattatttaaggagaattgaaattcataaaactgaatcttccaagccaatgagtatgggatttttcttcacgtagttatgtcttctaaaatttctgtgagtaatattctgcatctttcattgggtttctttctagggatttgatgtttatagttgctcttgtaaacgatatcctttcaaggtaatattagtaataaatttagttttcttgctatgtgttggaatgtgataatacatttttatattgactttgtatctgtcaaccatctaaaagttatcactatagaactttacttgtaggtactttcttccttttttttcatatataatcatgttatctgtgaataatgagatttttctttcctttccaattcttaaactttttattttctctcatttttaattcactgacaagcacactcacttggtaggtgtttgagtatatgtattcagctcagatgacatggacttcttaatggaaactgtggaagccaggaaacaataggggtacatctttatagtgctccaaaaaagaaaaaaaaaaggtgtctaatgtagaatactattctcatttgaatatccttcaaaaacaaagacaattttagacagacagaagcagagagggaagttgtcaccagcagactcataacaaacattaaaatatgttatttaggctaaaggaacatcagacagatggaggcatggaaatggaataagtagacattttcagaaagggatattgaagattattgggtgtttgaaacagtcttgataatgtttggtggggcttacatgtag

SEQ ID NO: 37611 - DNA, 1035 bp, Homo sapiens
agaaaataaatttatttttcacaattctagagcctggatgttccaaatcaaggtgccagtgggtttagtgtttggtgagggctgctgtctgcttccaatatggcacctgttgcttgtctttacacagcagaaaatgaaagagcgaaaagggctaagtagtttcccccagccttttataaggtactagtccattcatgagggcagagccctatgacttcatcacttttcaaaagaccccaccttttaataccaccgcaatgtggattaagaattttggaagatggcacaaacattcaaaccatagcactgacaatatcactaaattttcttatatgtctcaattttttcttttatatttcttttcactttctttagtagacttttagttttactttttacagattcctagtttcattggtatcggttattttcctctttctcccccacccccacccccacccctgccttttttttttttttctttttttggtcttgcgatggttagaactttacatgttaggccgggtgcggtgctcatccccgtaatcctagcactttgggaggtcgaggcaggtggatcacgaggtcaggagttcaagactagcctgaccaacatggtgaaaccccgtctctactaaaaatacaaaatttagcgggacgtggtggcgcatgcctgtaatcccagctattcaggaggctgaggcaggagaattgcttgaacctggaaggcagaggttgcagtgagccgagatcacgccactgcactctagcctgggccacagagtgagactctgtctcaaaaaaaaaaaaaaaaaaaaaagaactttacatgttaagtagaagtaatgattggtattttaagaagaaaatgatgctgacatttcaccattcagtataattttgccgtaccttttggactgattagttttataaggcttagtaaattattttccatttttggtttcttgagagttcttttaaactttaatgaatgttgaatttcattgaatgctttttctccatccactgaagtgt

SEQ ID NO: 37612 - DNA, 1035 bp, Homo sapiens
tccagacagctttgcagattggcaatttgtgaacctgtctcaagatctataaaacatattgcagcagaacttcaaagcacactttgccacatgggtgggagacctttgtttccttttttttttttctgctttttaagtctgtaaaccataataagggcacatcaaaaccctgttgctttctaatgtaacacaacaatgacatattaagtagtatgaaaagcattagctttctttttggataccattttttaaataaacattttttttcttagacttgccattctctccgctgagagaatagtcttccaaagttgcaaattcttgttcaaaagccagaaggaaaagaagccattctgaacatactttagctgaagaacatttctgcccctgtgaggacagcgttctgactacctagatcacaggatttttgcctttagcagaatactttttgttgataaacctttataatctaaattgattgtttccatgtctgtaagattcccttagctatatctaaaaaggactaggaagaaacccgaggaactggttcctactgcaggaacagactgtggtcattgtcctgtcacttcatttccctggattccattatcttccactgtgctaacatcacagaactggtaagagaatcaggtaaaataaaattacttttaaatcacagatgctatcatacaggtgtaggaatcttctaaacttggacctacctcttgtttggggtgataccatacttatatttctttttatcgcaatgagatggcaatagcagaataccaatagataaagcatttcatattcccttaattctctgtgtggtgcaaatgataaacaatagctaaattgcctccagttctctgcctaaaggtaggactcttcatccatctgtcctgagctccggtaccaaggtctctcagttggcagttggggaatagatgacaaaagcttttttccaaagttttacatccaagtcaatgtggggaacccccacattaaaaagggtaaattctgattctttttatc

SEQ ID NO: 37613 - DNA, 1029 bp, Homo sapiens
gtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctaga

SEQ ID NO: 37614 - DNA, 1061 bp, Homo sapiens
gttgaatctaagattttctaatttgactagattaatttgttttacctccttctaccccaagttaaagaatacaagatgagagagcagatttatggtgggggagataatataagtttggcttgagttataaaatgattaaatagcttcacatgcttttttaaaaaaaaggtactgatagagctgaagctagtttcttatttcatctcctttctttcatctccagaagtaactgctgtcctgaagttatgtgtgttgttcctgtttcatactttgaccatatatttatatatccataaacaatgaaaagcattatttggtgtgttttttatattcatgtgtatgtctttgtatgtacatattttatttagtaatttgcctttttttattaaatattatgttctcaggatttagccatgttgtcatatgtaaatccattattttccctctatgtgaatataccacaatgtttttatctatgtttgtagattcacctattgatagatttttaggctgttgtcaatttttctctataaagtacaatgcgatagtaaacctcttggtatatatctctttgtgcacacgtgtaattttctttgggtcttagggatgtatatcttccaaccttactagacattaccaacttgctctctaaagtagcagtttcaggattctcatccccctccattcactacttacgagtttttaatctctgtcagtctgagaggtattaatcagattgttcttgttagtatttacttgattactagtgaagttgaaatcttttgtatatttcttgacatttcaggtcagtcttaccatgtcctttgcacatcttttctttggattttctttttctcattggtttataggagttattcatatatcctgtataataattctctgtttatatgtgttatactaccttctcccagtgtgtggctagttttaaaaaatgacttattttttcttgtgtggtatgcatgtttttaattttaattgatcttttgtattatttgtgtttttctgtgttttacatattcaagaaatccccctgtactctg

SEQ ID NO: 37615 - DNA, 1124 bp, Homo sapiens
cttccatctgtgagaagcctgccctgaccactcatattagaagagttcactttctcctctcaattttcctagcaccttttccccagtactttttttacaatatgggtcagatagggcttttgtttagatgcccttatcacttcttatgtattgtaacactcttgagggcaggagatgctttattgaaattaggatccttgtatatggtgtagcagggaatatgaactcgggggttatgctgtcctcccacttactgtgtgaccttaggtcaatcactttgcttctctgagcctccgtccttttgtctatgaaaggagacaggagtttcaccagtctgtggggatcttgtgatgactgagatactgcatggaaacagttcaaacagagcctgaacatcttaagtgttcaataaatgttagcaattattagtagcattactgataaaacagtgcttaacacggtggttgatatatggtagatacccagcaaacgtttgacataggggatgtggtaccggattttatagtagattgtgttagaccagactgaattgtggcaaagctgactataacagatgggtttgggctttgtaatgatcaaattatggaatttcagagaaacttatatgtagctagatatctcattaattacagaggaaaagctgataaaatttcatttatatatggttgaagagccccagtacacatgcattatcagtattaatgatgaaatattgcatcttacaaaaccttcacgtgacaggctcaaaaggtaaacactgaggggtaatgattaatgtccacaatgcatattgtttctatacagacaggtagctgttgttgtttgggttctcaatggcactgtgaaataactacagacaggttgtatttgttgtcttatgagcaaggtatatgaacagactgtaaaagggaagtctctaatgaaaagatgcttttgctcttgagagatcagaaattgtttttagacatggccttgagaaagttgaaagacatgtaattgaccccaaatacctctaggacatttgtcaattctgaaagctatcacctactcattatttctgcagctaaaaatcttctctttctagctttctgaccttgtatctc

SEQ ID NO: 37616 - DNA, 1060 bp, Homo sapiens
aagcccaggagtttgagaccaggttggacaacacggtgagacccccgtctctacaaaataaaagtaattagccagcatggtggtgtgagcctgtagtcctagctactctgtaggctgaggtgggagcatcacttgaatccaggagttagaggttgcagtaagctccactgcactccaggctgggtgacagagtgagaccctgtctctaaagaaagaaaggcaagcttagatttgacatgtgattagtaaattatatgtcaaaaaggagacttacagttcttctgttaatttcagtgatgaagacattaagttaattatgatttagcctttgtaagactctgacttgccttttttttttttttttgctgaggattatgaggaccttgataaatcattatttcctaaaaatctttgttcaacgaaccaagaagagcttgatcctagactgcctttcatccattacatgcattgggaaagcaggttttgacagtgtcatagaaacagacacagattcccagagaacagctataaaggaaaccagcctccaggttgacagtggatcaatccccttatggcacagattttctttgtgaatgggggtgaaaaaactagaggctcctcatatgtttttgggttaaaaatctttgttttttttttccaacttaaaaatgctgagggttttgtgtgtgtgtgtgtgagctagagggagaaaaataagtgacatgacatttaaataccatattaatatttgggtcagttgtgtttaagagtaaacatacgactaaccgctttctaggaaggcttaatcttccttttaaatattgttctcaaaagatgagcaatatttatgtattgaaacaacattttcttgaagtatgaaaattgaggtactgaaaacaggtatgtattcaagaagatgtgccttgctttaccaaaaaaatgtgcttttgaaaagttttgctgtgaactgattcatgttttgaaatgcttcccatctggtgtcatagaaaagttgaaaaggaggcaaggattttttttctccccaggggaggggtggtga

SEQ ID NO: 37617 - DNA, 1040 bp, Homo sapiens
aagagctttgatatatttttctttccctcctaacaaacaaacagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaataccaggatagctttataaagcagttagttagttagttactcactctagtgataaatcgggaaatttacacacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatt

SEQ ID NO: 37618 - DNA, 1058 bp, Homo sapiens
taggactgtacactctgtgacgttttgaatgaagcgcaggcaggcttctctgctatcctccaggcagtgtaatagtcaaggaaaagagcaacagtattggatcactccttagacactaaccagctggtgaaagagttcattggccagtctcctccttagaatggtttgcaccaagtggagaggccatgtcgctgaaggggaaaggggagccctcatacccacagtcactgtaaacatccagtagacaggaagatggcttcgggcagtggctggatggaagtagattggagatacccaggtctggaatgaagtcatcttccacaaagtcttccttcactgagaccacgaattctgggtgatcattctctaaaaggctgagaggtgcttccttgattttcactaccgcattagcttggctctctgtctcagactacgggcttggcatatatgtagtcaaaattaattagttcattaatagcttcaagcttggctgataatgtccccactgacagagaaagggaggctggttaggaattgggtccttctgagtagacctctgggagctgctccaggctggcagaccctggggaaggacatttgaagaacactagtgggtctaagttgtccagaatgcccaacaggatatcatactgggaaggtagttgatgtttacttccaaccccaccacaactaacttctaccctcatctgcctagttagggatgtcaagcatcaaatagatggaattatcttggctttcgcctcctcttcagtaaccagagcatccatccccaagtgctgtcttcactcatggttctcaactacgagtccatgcattttctcttgtaaaaactgattttctagcaaaagtttttggttctgttctaaatctaccacttgctgtttcaggtcactcatttgagcttgctttctgtctctggcagtttgagctgctaatcctgtttttcctcctcagtgccttctccttggggctccccacccccacagcactcaccatctcctggctggctcctctctgggctggcaccatgagcagca

SEQ ID NO: 37619 - DNA, 1153 bp, Homo sapiens
ggagtgcttggacctttaacagaaggtcttagtctaccattgtgtgtgtgcagaaggctgatttgagtttttgcatgattgcacattcatgcacgtagcattactatccatgtgtagcgagactactagatgctagtctgagtctttacctttccatcatctactgtcatgctttcccaagtctgaagatcctgttttccaagatctgtgctcagtaaacaagctttggagtctttaaatgtaaggaataggaaaggtgaagagaggcctggcttaaaatcataacatggagattatggcagtgaatcccattggattgaatggtctgatatggaaagcaggctgtgtagttccactagtccaaaaattctattttttgagacacagtctcgctctgtcacccaggctggagtgaagtggcatgatgtcgactcactgcaacctccgccttccagattcaagcgattctcctgcctcagcttcccaagtagcttggattacagacgcctgccaccacacctggctaatttttgtatttttagtagaaatggggttttgccatgttggccaggctggcctcaaactcctgacctcaagtgatccacccacctcagcctcctaaagtgctgggattacaggtgtgagccactatacctggcctggtccattctttttttttttttttttttttttaagaacaaaactagtttatttggattggggactctgaacagttctgtctctattacccgacttcctcctcccacgacttcggcacctagaggaactttggctccggctgcggtggctcctgcggctctggctccggcggccctggtcccagctgcggtgcctatttcttcctctgcttggtgaattgtgcctctcccgactctttgatgtgcgtttgtgagatttcttccccctatgactactcttttttctctcggattccccatttcttttgtaggtgtggtctggactagggtttctccttccccgctgcctgctgtagtagtggtcgtggtggcccatcttctccctcctctcggagttcttgccaaaggaggagccagtctgatctgaagacaagtagatgtctctattagcttcccagaattcattgttgggatttctgaacacatgaagaaag

SEQ ID NO: 37620 - DNA, 1072 bp, Homo sapiens
ttgtcatgcgattatacataatgctgcaattaatatctttgtatcctctgtttaccttcatttaaatcattttctagatttactttactttttttgagacggagtcttgctctgtcgcccaggctggagtgcagtggcgtgacctctgctcactgtaacctctttcccaggttcaagtgattctcctgtctcagcctcccgagtagctgggactacaggtgcacaaccacgcccggctaatttttgtatttttagtagagacggggtttcaccatgttggccaggctggtctcaactcctgaccttgtgatccacccacctcagcctcccgaagtgctgcaattacaggcgtgagccaccaggcctggctagatttatttttagaacaaggttgagtaaactctggcaagattaggtcctgacctgaattgtcacctgtgctatttcacccattgacagagaatataacatttttcttttcttttttcttttttttgagatggagtttcgctatttcactcaggctggagtggagtgaagtggcgtgatctctgctcactgcaacctgtacttcccgcattcaagcaattctcctgcctcagcctcccaagtagctgggattacaggtgcccaccaccacgctaggcaaattttgtatttttagtagagatggggtttcaccatgttggccaggctggtctcaaactcctgacctcaggtgatcctcttggacacctcagcctcccagagtgctaggattacaggcgtaagccactgtgcctcgcaacatttttcttcttaatgttcgtaggaggctaaaaagacagggaaatctttcctttaacacgttcttttaagcttttatttgtgcatgctgagcaatgtagcctgtaactattctgtggctacactgcaaaagctttcttctgacattaactctcagttccgtaactgcatgttaagcatacccctacctgggaaatatctcttctgggggaaaatcacatggtgacagcattagaagcacagacggaatagaatggcctgttgtaattcgtaatttaaggagtca

SEQ ID NO: 37621 - DNA, 1033 bp, Homo sapiens
gggtataattaaaattgatgggtaactctaatctccttttagccttattagccatataaaccctctgacagctacttaaacaaagaaactagagtcttcttatctctctcttttcttcttaatcttttatctccctataataataagttattactgtactataattaatacctgttaagggagtatttactgagactttcttagtgctttacatatattaactactttaatcttcacaacaacacaatgaggcttatccatactagataggtgaacaaactaaggctcagagagattggataacttgcccagggtcatatatctagtaagtagtagagctagaatacagagctacaaactaagggtggtgaaatgctgcaaagccagaaaagcactgagaagaaatgaagggaaagccctggccattccatagttcagtgtaatcagtaacttatgatagtttgtattatttaagtagaaagttaaaatgagtcaatttcatgtgatgggctgtgtggctctcttttctccttgtgtgtctctttgtgggtgtgtgtgttgaaggccttttaatgctctaaaacaaaacagattatatctgaccattgttagagaaatttgtaaaaaaaaaaaaaaaatcattagctgggctgggcatggtggctcacgcctgtaatcccagcactttgggaggccgaggtgggcggatcacgaggtcaggagatcgagacaatcctggctaacaaggtgaaaccccgtctctactaaaaaatacaaaaaattagctggcgtggtcgtgggcgctgtcgtggtcgtgggcgctgtcgtgggcacctgtagtcccagctacttgggaggttgaggcaggagaatggcatgaacccgggaggcagagcttgcagtaagccgagatcgcgccactgcactccagcctgggcaacagaatgtgactctgtcttaaaaaaaaaaattattagctgttttctcaaagagaaattaaatgaatatagctgatgttcactttagtgtttat

SEQ ID NO: 37622 - DNA, 1028 bp, Homo sapiens
cacattagaaataaaatataaagcagatggaccagaagatgattcctttctgttctttaccaataggacatcttaaagctttttatccatatatatggataaaattaaaatatatatgggtataaatggatatatagatatattttaatgaactgcttttttttccacactgtcagtctctggtaaatagttgatattggtacaactggtttgaataataaagccaatgctgtgaagacatactattacttaattttatgtcatttggctagtttgaattgtagcaactgagttacttatgaaccatgcacagaacacatagtatgtacctatgtgtcttaggtgtgagtagccaaaagcatgtgtatatggagctgattattacctcttgagcaaacagcttaacttttataaaattcagttttctcatatgtaaaaggtggggatagggttggggggagttgggataatatatgtcaaacgtttaggacaaatcaggcattctgtaagtgctcaattaaggggagttagtttcattaacatataaagaggaaaattgacttaatcatagtcatagttctttaactttgtgtcattaagcttttcattgatttaaggaaaaaccttcctaagagtattttctttcatttattttttcactttcattttttgttccttgtcttattatttttttcctgtacttaaatcagcttaagacatcattattcaaagaataaaacacagtaaagttttgttcttccaagttaaaaatatgtgatatggctagtggttttcttctgtactggtacaatggtgtatatgttcctaagcattgagtataagttggactaacaattttttaatattaaatcttatgcataagaaatgtgaacttggtcctaaaagcaagaactcaaaacagaaatataaaaaggttgtacagttcacatataaaaaagcatttgatctattttgcatggtaagaacaaaatagatctgaattaagaacttgtaaaagtggatgtttt

SEQ ID NO: 37623 - DNA, 1044 bp, Homo sapiens
caagcctgcacttatatgtttgttctggaagcgaccatcacattagctcagtatgcagtgttgccagaaccttcagaatcctgcttccaatggcaaaagatccgaaggctctgggcgtggcacacctttcattctggcttttatgtctgatatttagggtaaagaaggttggcatgttctgagtagtttactgagcatattgactaatgtccctttcgaggggtgtcctctacccatttccccacatttgagagtgaaaacatctaccccctagtccaacttacccaggagagtgcaccaggcctgtggtttattacctcagaagggtgacttcgggggttgtgagaatctgaactaacctcaggtgagtccatctcacggtgggctgggaaggctggacctggtggccatgggctggtggagttactctccagcagaagtgcggggacaagagtcatgcgtgggctcaccttgaaagggagggaggcagtatagctctgaaccagacagcttggctgcaatctgtggctccacagcttacccagtagccataagcagggggatttccttctgtgtgcctcagtttcccatctgtcaatggagatagttgcaatacctaacccaggttgggaagatgaaatgagccacgtcatgtgaacacttagcacagtgccacgtgctcagtaaaggctactggctgtcattgttactggctcctggtcccaggatggcactgtcctattttggattcacttcgtattctccactcatcgctctcatttgagttcttaggatacttttagaagttgtctgatgagcagtcacctgtgaaggatgctgtttctattgatttcatttgggccctgagaagtaggcaagagctggaggttgatgctgctgcaggcattcgccgcatgcctggcccagctacagggcaacagaggtgccgtgggtgtgattaaacatgtggttggtgccatggaaaccaaaatgggaattggaaggggcttggccagaagaggccttccatggataggtgacttt

SEQ ID NO: 37624 - DNA, 1065 bp, Homo sapiens
ccatttcatagatattcatatgtatgtatataaaaatattgaaaatagaccagaaaaatataaaccaacatcataatggtaatatgttgtattggcctcaaagggaccttaaacttctctataatgttctaatttatgtttttaatgaatgtattcatatcattgtataatttttaatatgcagaagtatatacatagaaatagaacactgatatgctaaaatattaacaggttaaatctgggcagtggaagtatgcgattgctttttttcttctttgtcctctttaattttcaaattaagcaaaaacaaaaaagtatggattatggagaatgatctgtatctcacagcttttaatggtttgatattcacatataagctgagtcttcttttttgtcctttatggaactttgttcatttcttatttgttccatttcttcatgggaatttcttttcaggataaggaagaggatgccaatattagctgagtttaaattcataaaagttctgtaaaaccaagtcctgtctcaacaccgctcctctcagctctccccagctgtcatctagctgcatgggagggagctgagaggagccaggtctggcttcagtgtgctccttccacatgggaggctcaggtggctcttcttttgtatggctggtatattagtcagtatgaggctagatttttctgcaataacaggttcactccccaaatctcagtggcatggcacgttgtttcttgcctgcaccatatattcagtgcaggttaggggacaggtgcacgtctctgatccatacattcactcagaaactcagactgttggccatccaccacctaagagcccactcaaaggctcccaccacagcatttaaatgcttctgcgccctgcctgttgaccagaactaggcagatggctttacctaaccataaaggggcttaggaacatgtggatattcaacagtacaagtttctgatgcagctgatttacatgctttgactatgataccagccgggcttggccgtgaatcagagttgcagagaaacaggcagtttcactcatccatct

SEQ ID NO: 37625 - DNA, 1028 bp, Homo sapiens
tgtttcatgaaatttgtttcttgcatccttgtaggcagtaagttgccaaatgaatgttctaactgggttgcagtcaaaatgttacaaaactactggtcttgcctacctggatatttggaaagagatcgaggttgagggaagaggctttgaagttatctgagctaaggtgatccctgtggttgaagggtgtggagtcaaaagagggaggagcagcatatcttaggacagacatgtttacatgtatgggagagatggaagaagaaccaggagaaagaagagttgcatatagtcagttttcttgagttttataatgagtttttcttggaagttaaaattttgttggggagagggattttaatcaaatattacatatttgggtttaattaaaatcctataagtgctacaacattatggaacacagtactatgagagtgtatccaaagaaatttgattcagtctagggttacaagaaggcttcctctaggaaggcgtttgacctcagagctggaggatcagtaggaattaagcaggtcaaggaagagaatagcatccagtgagggagaggaatgcatttaaggaggtgactgaagatcctcatggatggaggacacagaggtgtgagagggggactggagaggtaggcaggaactaggccatgcagagtcttacaggccatgacagagaccatgtttggcctttacccaaagatccacaagaagctactgaaagattttttaatagtgggggaagagaatgagataatcagatttgcattttgaatcaatcactgtagtgtggagaaagaatccatagatgaagaatgagttggggaggctagcttggaaactattgcagaactctagatgggcaaaattgttgctcagattagggtggtggcagctgagatttaataaagatgtaaaattggcaagatttgctgaaggattggaaaccgattgaaggtggggggtgtgtatgccccataagagtttgtttgtacaacagatggataacagggccattcgcca

SEQ ID NO: 37626 - DNA, 1033 bp, Homo sapiens
taaccacataattttcgtttcccttgaaaataaatattactacaagttaggattttttagtggaaaataataacttatttttaatagctactattgtcttacaatatttgtataggaaatttttacaaaatatataaaatattcttctgtttagatttttaatttttaaagatcacatcagttgaaggtaataacctttccttttctgtagtctttaagcagcaaagttaggtgtttgtaagggcttgttttacctatactacaattttgtcctctttaactttcccacatagaatgtaggaatagctggagattaatttttcacggattccttcctgggtctgataccagctgaatggtcttctatttctcaaaatgtttaaagttttaaagaatgaatacctgtctatcccccatgctaattgtgctaattctgctttcttctcttaacagaataaccctctgagatctttcttctcaacagtttcgtgggtatttgcaaggatctcagaagtgctatgatattctgttgcaaagcaggggacttggtagttatgaacaagaccctggggttagacagacctgggctttcattctggctctgttacttactagcttgacaagttacttaacctctaagtctcaattcctacctctttaaattggagataacagcactacccatctcataaagctatgtgaagaatagttgagaaaaatgcatgttatatgctgagtatagcaatctagcacatagcaagcagttgtgttagccagtaaaaattacgatgggacatattttcaggggagcatatgtttacagatgggatgggattgtgggtcatctttaaagctgattgtcagtctcagacacctctcccccttgggagccatttcctaaccatttatttgaagaaggggaggtgtggctttaagtgggtcctagggaccagtatgacagctttcacagtgagtacctgggcctgctttgtgatctggcactgttccctatatcagccatccttgggtaggg

SEQ ID NO: 37627 - DNA, 1049 bp, Homo sapiens
acttctcctgttactaacagccagtgtacttgcccctaacagcatttgagaagacaaatgttccctgtgctaggctgcaaatggattaaagcagtgttgatcctcatctgtcagaaccattaacatgagtaaaacacttgccctacttaaagcagatggagggggctgggggagggtgttctgtggtactgttcataagattaatggtgctatatggacagcagagagcactggctttatattctgaacattacatggatttacagggatgtcagttattcctgaaagcacagcctgtgttcttaaagggtctctgtaaggtattgaatgagacatggaagagtgtggtatgggggatggtacatgagatagtagcattttaacagtaaattatgacttctggatcatttttgctcttcttttgtttaagctctgctgaatttaagtcttaacagttacctggcttcttagagtatgtgtaaatattataagattttttttgataagataaatgagagagatagaaatgggactgtaatcacaagagaccacagctctgtgtttgcaggaagactttagatcccctttgccttctggtagaaggcaggagggtaggataggaggaaaagaaaatagaacatgttaattaagagtgggtatttttgaggattttattattctttgacagtggaagtggaatggtaaaattgttgaggttaacgcaacagtgatagaagacagtagtgtgagaaataatatttacatgagtgctgaattaaatttaattatagaaaggaatccggttgttggcagaagtttagctatctctgcaagggccagacttgggggtgaggaggaaatgtggttgagtggccacttgtcataggcagagtgggttgggattctattatttctctggctaacccttcccaatatatccctcataaataaatcttctgccctggcaatcccccatctacccttgtttgctctttctcttgttttctagtacctcaactactggaaacaggccagaatcctttgctgca

SEQ ID NO: 37628 - DNA, 1031 bp, Homo sapiens
gctattgggtgtttataccttcccgccatctggattgtcagttcctcattggatgcgcatgcattgagtgcccctgtgtgccaggccttgtgcgaggcaccggaagtagataaatatagaagttcaccaacaggtatgaagactggcatgtaaatgcaaaactcactgtgacatatgttgtatgtgaaaggaagtatcaagtgcattaatatttccctgtgagtatcttcatgtagcttttgaaggcttgctcttttttttttctttgagatagaggatggctctgttgtcaggctagagtgcagtggtacgatattggctcagtgcaacctccgcctcccaggttcaagctattctcctacctcagcctcctgaaagtcttgccttttgaagttaggagaatatcttaatcttttactcccatacctaacagaatgcctggtgcatagtagatacccaatatgtgtgttttgagtgagtcacttaccatcttgttagtgtggtctgaggaaaaagggtatgtgcccacttaaccacattagaacactgggtctggcttgactgtagtgatggaagaacagataccaagctgcagaggccatccggtaaatactaactgaatgaagagaatctgtataatgtgtgtaaatgcagttcagtcccttctctactataaaaacccccttaaaagcatttcattggtgggggtgaaatcacccttaaatagaaacaaaattgacaggtaaggaacaactctggtgaagaagagagttgtggctttaccttacacacaggatgcttccagctaaacccaccgagctgacagagggagcatgacacctctcctccatgttagcacatcagggcctggctcagctgtgggaaggaacaagtgatgctgatgagcagataatgcacctgatagggaatggggtccttggagagcaacatatctgcgtggcaactgttaaaacccccctgggcctcagaatttacagtgagctgcagtcacaggtaaggagactcactca

SEQ ID NO: 37629 - DNA, 1035 bp, Homo sapiens
ggtgggtgggtgccatggtgaaggaaggggcatgtggcactagccccagcacactggaatgagatctaagctcaaaaagtgacataaacatcatcttctagttctgtagtggggggaaaacaaaaaatggtcatatttgacaaatgactgaatctgtcttgcatacgtcataaagaaatctaggcatccagcaggtaggtgtgcatggtggtaacctaacttatccagggcttgtacagtacttagcacatgcagacattcttgagaattttctgttgaatcagttaaagtccaacattgtcccatagaagagagaaaaacaacaacttgacactacacctaaatcaaggtgttaaagcctttggccttcatggggagtggtggcccactgggggctgctctttctcatcgctgttctataatcaattgcgtcattttaactgtcctagaaaaaagaaactgttgcatcctgctgtcttaaaaatcaagtcgcccatcctcagccccatgacctggcttccttctgttctctgatgtacggagatgtggcgaggaaacctctgcctgcatcactgtgaggtcagagagccccatgattatcatcttcagttcccttgcactcctgtttctcccctttgctcagctgagggcttccacctgtctaaaggaacatggcccagcaggaaggcttctaggtgcctgccctctggattcggtagggccatgcctaggatgggcctccagggccagtttccccacaatgaccaacgatgttcctggttaggctgtggccagaaggagagatgttaaaaagtgaggggacctcctcttattcctatgaagagatagaagaagagaatgacagaaggaaagcccaggctcacaaacccaagaagaagaagaagggtcagaaaaatgtggagtactggtgcggaggcagatgggggagaccagcctttcccacttctaacattggatgggaagagaccaggagcaaaggcaggtaagcagcctcctaccttctgctcggtgatg

SEQ ID NO: 37630 - DNA, 1033 bp, Homo sapiens
gttgtgagacagagtaatctggtctgggccgtgctgaaagctcttattgataagggattagtctcggtggagacaacgtgctgtcacatgggcatcagtgcgattgagaggaatgagatccgaggccggtgggggagggacagcgctgagtcactgagttcattaaaaggctactgaacaggcgtgcggcaggcgagaccaaccccggactgtgcctccaccacacccatccccacacctcttgggcaaggaggaccagagcacatgtcaaggtaggagcacaagcggggcaactggcccagctcacagtgcctgtctacctcttgcaggttcaggcccctgggtagtttcccggtggggcaagagggagccctggctgaaatgcaggaacccttgtattccccaagtccagcccctggtcctgagtattggcttctctctacaaatgggaaggggagtggtcaccaaaagatttcctggcttggtggctcagaagttctgaaagggaaaattgtatgcgctttactggtagccagcagtgaaatattattttgccggattgggtgcaatttaaagtcacatctaaacttggcagtgagcaggcattgttgatgaaaaacagggttgagaatatgtcaagtcactcttctaacacggacgccataaagttcaaaagtctgaagcttctatacccctagaaaaagtttttttttttttttttaaataaagggcaaactttcatctgcattggggctgaggggaaagtagaaggtatatgggggagctggggaatgggaacagaagtcataaagtctgataaactgtctcatctctgcaagcagaggctaattatgtgttgtttgacttaagttttttcccagtcttaaacatctaacataccatgtgtgtataagcgtgtgtgtttttgtgtcccctgcaaatacactgtcggcgtatctgaatgactgctaataaatgaacatgtccaaaagaatgacagtgatgatcctgtaggctaactatgtacgtattg

SEQ ID NO: 37631 - DNA, 1048 bp, Homo sapiens
agagttcataatttaacaaggaacctgccactgcttttagtagcttgtgttctatttgtcatctgcatatctggggcctgtgaagaagtatagtattatgcacaaggctgggtggagcactgagtttccttgaggaaatgggcaggaagaagagtcctgttttaactctagttgttttctatatataatatctgcactcaacagatattctctgtttttctgtatttttaaagggaaattggaaactatgggtagagatagagacctcttttgagggatttgggtttagtaaaaagcccgtctaggggggcttccctggcatgctgaagcataggaagatgctgcagtgtgctcctctactgtgatctgatgcagagttgccacttctagtcacactccacaaaggaagaatgtggtaaggctgattgcattttcttattgaagtgttgctctcagagctttccttggcttgctaggatcatgacccttgattttattaaaatttatatatttttatataagatttaagacttatagtaatgtgaagaatccatctcatatatgctaaatattgaaagtgaccatggagcatttaaaggtaattttcagtatcatgatggtgtattatataataaataggtttcttgatatattttaatgtcttttatcatcaaagtaatgattaggccatttcattttcacaaactatcagttcatgaaaataagcaccaccaaatttagttagtcaacaaatattgagcacctgtgattcttttatttgctagtcagaatagagctttaagtttaaactctgtgttaatgacaagtggctcagaacattcccttccactgtttgcggtagagagtggtaggacttactcttttgcatatacactgtatctccctgttctttttcctccattgtctccccatcctatgagttcttttccatttaagagcagagaatgatcagatgaacagagttgcttctgacagagtcatcctagaccatctgttagactgacaaaatttcatagttgttaggatt

SEQ ID NO: 37632 - DNA, 2079 bp, Homo sapiens
tttgtcagttgccccttgatgaaacccccacttctggattcctgtaggattttttgctaatcatattatcacttatgttttcaagtatacgccctaccttcctccatatgtgtaaactactccagggcaggggtcatgtcttaagacgttacctttccagtgtccagcaccttcctttgtcataaaccatttgaggacaaaggtgaaagagcagactctgaaatggaccgaacagtggactgagtgaagaaagcctctggaagtcgcagagagccttgccaagactccggatctctcctagcttcagtttttgcctcctgcttaaatataaagggggctggtctgtgacctcagaatctatttctcaggtcctaaacctaatgttatgtgaatgactccagtgattggatttggaaacactgcattgcaagcctctccccttccctgttgtgatgattaaacaaggagagtagagtgctttacagaagtaacacataacttcaggaagacaataaaaagttcacaagataaagtaggattttttcctaaccacaatcacagaaagtgatgagacagttttcaagaaaaaagctgacagctggagacaaaagacagtatctccgcctgggattcatttacttggctctcagcctctgtatccaaaataggattcgctgctgctttccattcctccagcattcaccaaagtagtcacttggctttcctgttttcctaaaaattaagccattccttctctcctacacaacccctcgccctagagccgtggctgaaattcctcccttaagtttcacaatgtaacgtcacttcccctctttctgtggggtaggcttttcccctttacttccctcttcctctaaatcaagatgagacttcacgagaaattgctttaaaaaagatgaacttttcagcttatcaatttaaaaagtaaatatttcagtgggtagggatctcattgtattgaacctctgattagagattattccacaagcaagtggaaacatgttttaactgcctccagaaccctaaaatgtctagaatgtgacttgttttggagtcctgaaattctggctacaggctcttgtccttccatggtttatcaaattctctgctagtaagccatcttttataactaaatctaaatgtctctcttttctaccaagagtttattcttttttgttccccatcttcccctcgggaaatatttttggcagggaccttatctcaaaagcctttataacaagatctttttctgaaacctctgaagtaatactgttctccttggcctcagtgtcatgagaagcccagacttccatacactttctgatcccattagatgttgattacattgttggcccctactcctggtgacttttttcctttcaaagtggcagttgctgtgattgaatgggttttaaattgtcacagtatgagttctttatggctaggattcctttggattttccatcatttgtggggaagggatgaaaaacggagaaaataaaagtatgaggctttgtcagacatttattactgaaactgagaagctgaaactgagaagccttatattctctaggaaggttacagggtggtagcacagtttcaaaattaatcaccaggagttttgtttctcacagtggattccaaacctgctattatcctggtggcatacctcttcttggccttatgtccttggttgcttcaaggacataaggcttggttgtggcaaggactaaattctactttgcttacctttttccctgaccagttaggttgtttatggcttgtggagatatttaaaatatttcattgggttaaaaaaaaacagatgacttggagaacacaagagagaggacataagatatttctttggtttgtccctcaaggttgggttgaaccttagtgggaaaaaagtattacttttttttttttttttttgagatggagtttctctcgttgcctaggctggaatgcagtggtgcgatcttggcttactgcaacttctgcctccctggttcaagccgttctcctgcctcggcctcctggtgaatagctgggatt

SEQ ID NO: 37633 - DNA, 1055 bp, Homo sapiens
acagtcttcctcactgtggtaatggggtaagtatgagaagctttgaagggttgtaccttctccacgaggccacagcccctatccctcagtccagatctatatgtgaacttactgctgccctcctgaatcatttagttacctgccaggccccttagtcccgtgtttgtcaccctggctatagagatcacactgcaagagatttccaactatcagaaaagctgtctgtatcttaaagtttatcatagtacacattatggtggtattccttttccaagcacaaatgaatgggagaaatggaaacatgaattctaacagttgaaatcaaatgtaggcaataccaacttaaaaaaacgcagacagtgctaattaaagttatggaagaaaataccttttggcttggccagattgatgtaaatatttcttacaatacagttagtacatatggcatttgcaaaggtggtggtgtgagaagtagaatttgcctgaggtttgtaagccagaagactgggtgactttattttcctgtgaacagttacgatgtgtggaaaagtgaggccaaatagaacacttttgattgtattgttaaaataggaccttaagaaacccctctggataaattctctacctcttaagtcagtaaggaaaaggtataaatcctttgtgtgacctgttacagagaaccttgtcaggcaagacagtttattggaatgatgtaccctaaatttacctgttgcaggggctgtgtttttctaaggctatcctagggagttccctttgtgtaggtcgaccttggactgaccccaagatttccagtcatcagaatgtaggaagtagagggagtggaattacacatgcttggaactcagccccttagaaaaagccacatgcgttttccagcattggccgtctttgtcttcagttttgagtccctgaatatttgatctgaattccccacaccacttacacaaacagttccatgcactcctcaggaagcgtgtgacataattttgtgattgatgttaggattccaataacaagaacacaggatcacagaa

SEQ ID NO: 37634 - DNA, 1027 bp, Homo sapiens
cattctttcctggagataaggttttatcagtgatgcacactttgtgaattactgtaaagattttatcagtgatgcacactttgtgaattactgtagaagttttatcagtgatgcacactttgtgaattactgtacgagttgcaattggttaactggaagaaggttacagaagcactggtgagagcattgctttgaagcagcaatgatggctggaggtttgagaggatttggaatatcccccatagcaacgaaggccacgtgtttcatttatagctaccttttttatttgcaagaagttttttaaagcctctgatactttattgaggttttggctaatggtcaaaaggaggaagtggtagaatattcctgccagtgttttgaagttgttaagcagtttggtcatttgctgaccagcatataccatgagggcaatgggaagggaactgaagaagccctaaacctaagccctaggctcttccacctcccacttggttgtggagctttggaccccttggacttccatggctgggtcatctccatggactctcttatggtggtggtttccattcccatggctttgactgccacctctaagctgttgcctccaacctaggttggtctgaatatccaacaggtaaaaggagaatcacaggtcttgtgcaatacaaaatcttcttgtagtcagtattcttcctcctcctccctcctgccctctcaaaacaaagctcatactgccccttcttcctgtgatgacgtttctccatctggtgacaccaactcatcttctagactcaacatgtcaccttctctggaaggcctttctcaactcctggtgagtgccaagtaccccatgaagtctggcaacactcctcacccctctgacttacgacttagaattctataatacagtgtgttcacctatgtctctgtctcagcacctttgctggtgagagtggctggtggctggagaaatgctttcgtatcagaacataccctacattgttgcagtgtgcttgacagaatacat

SEQ ID NO: 37635 - DNA, 1378 bp, Homo sapiens
ttcaggagtggcaaggcagcaatgactgggagcagagtgagcagggggagagtggaaggagatgaggtccaagaaaacagttctggccagatcacctagggcttcataagccctggaagagtatctggatctccctggagagtttccaacgcaggcctgaatttgttttactttcttattcttttcatattttgtgggggtggggggcggggtaggcagggggagatgtagggaagaggaggaattagcaaagaaaaggcctggaaagttgtgttctgaaagccagttaaagaaggtattttcagaagagggcagagtgatccatcgtcagatgcctctcctttggcttcccgcctttgaagcctgtgtatattcccaaactttcaaactgtatcattttctgtagtcaaaagtaattattatgtaccataaaaatacactgtaattatttttttgacatcttcagtgtatgtgaattcattttcccctaaaaaggaatggtttaaaaaaatgagtggcatggacactggccaagaatgatttgaaaattgctttcccttgattgatggttcagtattgatggatgctgatgttgtataatataggtgggttttgaattagaaaaattgaaaactgccttccactgtcacatggacccatttccttcaactatttagaatcagactttatttttatgaactttaatatcaatttattgatttataacaaatataactgcaaggagactggaatgctgacacttatttcctattgaaaaactacttggcagtcagattatgaccagaaaattgcctggcaaacatggaatcagacaaaggaagtgcttctattgggtggtgctattaagcatatatttgacttaagcgatatcttgtcctaaccatttgcatgactgataaagaaactgaggcctgaagaaggcttgctagtggcaaaaggggaaatgtagtactgagattttatttttctaattcccagggatatttttttctcttctgcctcaacttcctctatttctatattacaggatatttacattaaggtatgtgttttggaatattctgtaattattttaaaaggagaaagtttaattcttcagtaaatcatatctagatacaacattattacagatcacactatcaaaatacagttgacccttaaaccatgctggcatagaaacaccaacctgccacccctgcagtagaattccattttgcaggctggagtacagtaatgcagtctgcagcctctacccactgggctcaagtgatcgtcccacctcagcctcccaagtagctgggactagaggcacatgccaagacatccggctactttttgtattttctgtagagatggg

SEQ ID NO: 37636 - DNA, 1018 bp, Homo sapiens
tcttggttccatcactgagccatttatgggggcaaaagtagcataagtagtccgtgtttcttgagtatggctgaagagaggaaagaggaagaaaaggaaaacagtgtaaaagcagccggaaggcagataatggtgatgtcagactaccaatggtgaagggaaaaatgcagggatggagcccctgcgggggtgtgtgtgtgtgagggaacacctggtgatgggaaagaggggggattaaatggggttgggggaaacctaggaggtctgccgtcgggctggtgaatgctattgggccctgcctggtgctcttaagtgtcatgctgctgctgtgctgttcctgctccggtttgaaatagcattttgaggtgctggctgaatgaagtagagcatttgctaatccttaacggctgttgcccctgtgatgtagaagactcaagaaatgctgagagtgagaacttaaaaatgggaggtgagggaggaggcatgaggatttaagtgacttttgccaattttataattaacggtctcaaatctgaactagaacccagggccctgctccatcactaaccctgtttcaggagaagcctttggtgatcttctaaggtcattgaaaaccccaaaactgaaggcatttcttttgcagagactctttgccaggcccttcacgatgtttctatgcagcagagtgctgtccagtaacctttgtttaaatgaatcgcagacttaggagaagggggggctagaaccctgagtgaaggaagagatgtgaattgactttagtcctattggcacgtccttgagcacattgggtgagcagagaatgtgacactcaggtgccacataaaattacccattttttttgcctagttgtatccactccctaagtaatccctataaagcttgtaggcaaatgaaagagttgagagtgctttgtagtccctgcattggctggaaaactatttgagcagtatatgacataatattgttcctaaggaaataagttccttcctcagctata

SEQ ID NO: 37637 - DNA, 1026 bp, Homo sapiens
tatgttggctgtatgcagcagaacttagtattaagttgaactatttaaaattgtcaacgtcttctctttttgttctattaaaagcaatttcatatgatttaatctaatacctataacttattgagcacccactagatacataactatatttagtacgtaaagaatattcaatttctaataataaaacaggcagtacctttgggaactgctgttgaagaagagctatggatactgttaggaatttgggggttccctagcaggcatgaagggatgaaaagaattgaggaccagagataaatttgggatttatatttaacatcttctcatctttaccttaaaagcacctcagccaatagtaaggatcacaaactttatttgccaagaacgtgaatactgaatagagtttataatgtatttcatcataaaacagtttcttatttactgatggagagcaaagctcttggcagattaactctacaaatcaagagaatatgagaatcaaaggccagaatccaggataatgagcaaaactcttggaagagcactaagaccagtcctgctggacttttgaactgacttcccaaagtgaaggttatgacccaatggaggctgggtgtggtggctcacaccagtaatcccagcactttgggaggtcgaggcaggtgggtcaactgaggtcaggagttcgagaccagcctggccaacatggtgaaaccctgtctctactaaaaatacaaaaattagctgggcatggtggtgcatgcctgtagtcccagctactcgggaagctgaggcaggagaatcgcttgaacccaggaggcagaggttgcagtaggccgagatcacgccattgcactccagcctgggtgacagaacaagactccatctcagaaaaataaaaataaaaatgaccaagtggggtcaaaggtggagagttcagggttcccctgaaactccttcttggaccatgtcaccatgagcactcagcaatactcagaatatccggctctatactgtgtggagttg

SEQ ID NO: 37638 - DNA, 1013 bp, Homo sapiens
aatgaaaatatttctgtattaggtatatttgaacttcagttctttgtatttaatttttttttagtgcaaactttattattttttagaatattttagaaacatattttatatgtgtgtcttttcagagtatgtcacatgcagaattgtgttgtggacaccttcattcattgaaacaactctcttctcaatcagacacccaagttgcactcttagaaacatcttttatttattttattttatttttttttgagagggagtctcgctctgtcccccaggctggagtgcagtggcgcgatctcggctcactgcaagctccgcctctcgggttcacgccattctcctgcctcagcctcccgagtagctgagactacaggtgctcgccaccatgcccggctaatttttttgtatttttagtaaagacggggtttcatggtgttagccaggatggtctcgatctcctgaccacgtgaaccgcccgcctcggcctcccaaagtgctgggattacaggcttgagccaccacgcccggacagaaacatcttttatacatgtgtctttaaacagtgttttaggctgggctcagtggctcatgcttataatcccatcactttgggaggccagggtaggtgactgcttgagcccggggagttaaaggccacagtgagctgtgattgcaccactgcgctccagcctgggtgacaaagcgagacccagtctctgaaaaagattaacagtgttttacatgcagaacaatatagtgatcacattcatacattcattcttagtgtaaacttgaaattctgtacttatgatgttatattctatttgtggtacattggacattatctcttaattctgtattcactgcagacagaaggaaaaactaaagagcaatacaaagaaaaaatacaatatatatattttttaaacttctaagaaaacatgtacaaggtcactggattcacaaatatttctgaggtattaaatattttagatttcttttgtagatcagta

SEQ ID NO: 37639 - DNA, 1193 bp, Homo sapiens
tacttttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccggtgtgtgatgttccccttgttgtgtccatgtgttctcattgttcaattcccacctatgagtgagaacatgcggtgtttggttttttgtccctgagatagtttgctgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtatttcaccatttttaaagtacacaattcagtggtttttaatatatttactgtgttatgcagtcaccaccattatcaaatttcagactgttcctatcacaacggggtatggtggcttacacccgtaatcccagcactttgggagcttgaggtgggaggattgcttgagtccaggagtttgagaccagcctgggcacataacgagacccatctctaccaagaaaaaaaaaagaaaaaaagaagaagaataagtaaaaaattagctaggtgttgtggcatgcacctatggtcccagctacttgggaggccaaggtgggaggatcccttgagcccaggagttgaaggctgaagtgagctatgatagcgccgctgcactccacactccagcctgagtggcagagcaagactgtgtcaaaaaaaaaaaaaagaaagaaaaaaaagaatattcctatcaccttcaaaagaaacctcatacctattagcagatacgtgttcttggatatatgtatacctaggagtgtcattgctgggtcacatggtaattctgtgtttaacgttcttaggaattgccaaactttttcccaatgaattcatttctgttagttgcatacccttaattgttcagttctcctgcaagtacgcatccctctttggttggttgtgccttttgtgatgttctgggagagacacgaagaggagctctgtgatgcggtgctgcttgatgcagcatggaaactcattgctttttgattggttttgtctgcaacttgt

SEQ ID NO: 37640 - DNA, 1035 bp, Homo sapiens
atgtctgccatgttggttgatacagaaaaagctttattaaaatagctaaaatgacccaaattaacaaaactttcaataagaaaatgtagaactatttatgaaaatttacaactctttattattttttatctttaataaagataaaagaacaaattcaatagtgtgaaatacctgtgatagatttgctatctgtattccaaagagctgtttttataaattttcacatatatttaaaatatttacatctgctttatgagatttctgaagatttttaggtagacaatatactggataagatatattgctaagttgggttttggtttgtcatagttgtccggggtagtgtgacacctccttcccgcttcctgtctctcttcagtaatttctgtaagaaaacctatcagatttaacaaactagagcaatgataatttttagcctgatattaattttaagctccatttagttttcagcttcctctttgatgaaaaatgtggctataataatgaacacctcctgctgaacttgaagagagaccgtgtagagagtagagctggatttaatcttctgcttgctgcagaacgcatccaagtgggttattacacaagcttagactacatcattggagatactggcattacaaaaggaaaacacttctgggccttccgtgtggaaccatattcatacctggtaaaagtgggagttgcttctagcgataaactacaagaatggctccgttctccccgggatgcagttagtccaaggtaggtttttgtattgatctagaacttgataattttttaaaagtaagcctgaaaatagatttggctttgttacatttggagtatacatttcttatttcttagattctagtattttggctgtggcttgattgagaaaaggagccgggtattcttgtaatcacacattgaataaggagagttagcagttactttttaatatcatgaggaaatccattttggatatctcttaattgtgatatagcttcacagttttaaattttgaaagtctttaac

SEQ ID NO: 37641 - DNA, 1058 bp, Homo sapiens
agaaatcattaaatactgtttatatgtcattttattgaggaaaaacactggttttcaaatgtcaatattttaatgttgttttctatttcataattctttcaggcatagacgtgccagagatcaatgaggaacagagcaaagtttataacaatgccttgataaattggcaccatccagaaaaggataaagctgatagctatgttcttgaatatcggaaaatcaatagagatgatgaaatgtcatggaatgagatagaagtgtgtggaacaagtaaaataattcaagacttggaaaacagtagtacctatgctttcagagtaagagcttacaagggttcaatctgtagtccttgcagcagagaattgattcttcatactcctccagctccaggtatggtgaatatcaggaataaaaaaagcatagagttagttgcaagagaccttgataaaataaactagtcagtatctccatgtagacctgcactgaaaccagctcttgtttttaaaagactccagaaaagtagcttctatcccagctgggctttagaaatgaactgagtacttgaatttttaccttgtaggctgagaacaggattgggttttaactgatgtcagatagagaaaaacatggaaggaagaaatttgggtgagcagagctagtaagttgggatttaaatagcataaatgctattttaaaagttttaaatatataattctgtatttttggtttatggaaatctctaaaacataatttttaaaatttattggtctaatatcctaaaatataattttgatttaacctaattctgatttgtctggatttttttatctaactaggcacttctcagataatagggatggaagccatatattagaaccacatgaatagcttttcctcccacgctaaaagctccttatgcccagtcatcgccccctcccttcccaagttaaaaaccactgatactacatatagagcgcctaaagatttttatagaatgtgaatgactttaaaggttcgttgatgttcactatgatgtctccatgaacaagggatattta

SEQ ID NO: 37642 - DNA, 1051 bp, Homo sapiens
taaggacaccagtcatattggagtagggcccattctaatgacctgattttaatttaatttcctctttaaagaccctattttaaaatacagtcacattctgaggtacgtactgggggttaggacttcaacatgtgaatttccagtggcgaggggtggggtctgggggactggggaaggatgcaattcagtccataacacttgcttacgtttgtattttgctactccctagcagggaggtcttccttgcctttttttcttcttctcacctcattcctctccctaagatttctcttctagtgatggtgaacactacaaagatatatttatagtataattactttataggtgcagatttgtagatttgtacattaatacaaggaaatttgtcttgttaaaagtttaaaactctgaaggattactgtgacctccttttcaaatctatacctgaatctgatacttacttactatgaccgtcttattttttcaaatagatatttgtcatcacttaaaatgctgattgtatttcatacactatactgtgtttccaaaatgtatgcttgaatagtatatatacaaatagatatttgcttacttgtgagtcctaggtcctccctccctgtggatcccaaaatggttgctggaaaggtaaggttgagggtgggttatcctgggttataccactgtatagcaaggaaccaataaaacaggtggatgagaatgggatagtagtcacctagcttctggctgatggatcttcccctcattttttgctacatgcatttttttttttttagtaagctatgtttcaaaaaaagaaagaaaaagagtatggggtaggcgacatactatttgttaatctgtaactttttttttaaattttaaaatgtattttgaataactttccagatctcattatggctgcataacattcagttgtataaatgcagcatacacagaaatgcttatacattggggaataaggagaggaaagagacttctgcttcttattcatgtccttctctgtgatttgtcataaatgtgtgtgtgtagc

SEQ ID NO: 37643 - DNA, 1050 bp, Homo sapiens
gaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagttttgtgctatgtgggtcatttatctagacattgctgtggtgaataccagttatgtttgattttattctcaaatcattagttgcctttttttttttttttttttttttgctttctaggaagaaaacaatcttttttatctagaaggaaagatactttgtgttttcatttttagccatttgaagtttttaatttattgcccccagtgtgttagctgctcta

SEQ ID NO: 37644 - DNA, 1048 bp, Homo sapiens
tctgttttgattttggagtgtatgtggggagattcaaataatggtacccaataatggctaccattattctcagtgaccccagactgcctcagaatagacttgtttcatgtttataatgttctatcagtatgaaatccttacattttcctccagctcacgtatacttgcaatggtaaaggagtaaggtttggagcttttattgagtagggattgaatatgtagataactttgaataatctattctcagaatgtgcctagtgtatgcatttagtgatttggcttggtgaataagaagagaaaatcaggtatttgaaaatgcctaattctacttctccatggggaaaaacgcatattttggaagatgtaaaggagaaataaaatttaaagagacctaaaaaacttagttcattggcaacttatttattcatttattattattattatttccctattaaactgaacaatgtttttctttttcagtcctatgacaatggactggcacagggagctggacttgaatctcatggtaagacatcttaaataagtgaacatgtagtttcttttgttcccttagacaacatcttggtgtcttcagtatggagaacctcagaagtttttctcaacccttggtgcagcataattttcttctttgtcactttcctgattctcttttgacaccattttgtctatttgaagcctctttggtcagtaatcattcaggtgttattcaggctgggatgttcatatgatgttttctagtaatctattcaagtgttatctgcatgaaaatatcttgggattgtttcttacactatcattagaaaacaacaggttttctttggcataactctaaaaggctagaccaaatatagaatattaaatatgaatgcacaagttcatgaagaaatgaacatttttattttccttaacaaaattattattagtcatagttgtaaaacattttgctgcttagcttatattcagtgcaaacattaatacagtcttttctttcatgtttttttccactttggcagaactagaataatga

SEQ ID NO: 37645 - DNA, 1055 bp, Homo sapiens
tacttcaaagccaagtggattactggactcagaacgaaggtctagctaatgtggaaatacaaagtacatattttctcttcagctttaaacctttagtttgctcccatgtaaagaagcaatgagttaaagtaaaaacacactaaatgagttaaagtaaaaagacagtagaccctattgtgttattaaccgttaccttgaacaatcacttaacctctgggcttctgttttctgttctgtagaaagggggattgaacatgttgatcacataaaaattgatctgacaggagaagtatgaaaggactgtataggcagtgaggtgggctattaaaaaaaggtacatgatagaaataattatgttttttgtgactcatatggaaattaaatgaggaaattcccataagcacctagaatggacctggcacatggtaagcattcagcattagccagtatgaaaatggagactaaaatagtctgtttctgaaagattgtgtaattaaactgctttagaatctgtgcaaaaataaagtgtactttaaataagcacatgcttttattttctaggatcaaatctaaatcgctgtggtttccgaggctcttcatacctgggtattccgttcaatccatcaaaggttggttctatttggttcagaaggaagtagaagggatgtagggatattttaataaaagagaaaactaagaagttacacagaaaaaaacaggcttccagatttcaatgtggctaaatgttgtctaataatatatatatattataaactgaaatcctttaaaggaaacctatacctactttacttcctcaaagaagtgcactttcttccgggaagaatacatgcagtacataaacacacacaaatttctattaattgttacaaaaaattgtctcagtatcatacatctgtgtgtaaaagttattggtgatttcctgagtaaaggaaaacagagcactgaagtgttttgatacctgctgtgtaagaagccagtaaactttgttgtgtttatagaaagactctacatttagctcacatttcttaggaata

SEQ ID NO: 37646 - DNA, 1034 bp, Homo sapiens
ctcagaaatgtgagcaatccagatccactgagacttttgaaaaaagtcatcttacgagcaaaggccacattgttttgaatagaaaaatcaagaggcagtagaaaaaatgctttgactagtaaacatttctttgagatttttaaacttcaaccatattgcttattttaaagactcaaaatgttagctaccccagaaaaaaaaataacgcctgattgtggcagatacctaaaaaggtccatttttacaaaaatattactctggctttgcattagatcaggatttcttaaccttgatactattgacatttggagctagataattctttgttgtgggggcctgttctgtgcattataggatggcatccctggtttccagcgggtagatgcttataatgtctccttaattatgattatcaaaaatgcctctagccagttgtccactggaggggaaaaatagcccctagttgagaaccacagtaagtcagagtcttttttttcttttgtagagttcagtgatgacgaagtttgacttacctggtttaacaaaaaggttgtgtttattccatagatggtatacccaaggaatattaaagaaataattgagtccatgtttagtctaaagttttagagggaatagctgcatttttgttgttcttgtcattctcctccctccccccagcaataaattgaatgtagggaaattgacttctcgggttttaagaaaaatgtttgaaacataagtcatttgggcttttttccccagaatgctgaaaacatgggattctcaaagtggtccctagaccagcaaaatcagcatcacctgggaccttattagaacttagcgggctccaactccagacctaattagcactgtgagggtaaggcccaacaatctgtgctttaccaagtcctctagtttattctgctaatgaaaaccacctctttaggaaaaagaaacagacacactgcttcttgtgataaaagtaaaccattcagattctagcttattttccttgttcccatctgctctatttc

SEQ ID NO: 37647 - DNA, 1095 bp, Homo sapiens
tttattatgtgtatatgaaagtgttttataatgttttataaatgacgaacatcatatatttaaattgctcttcttcctgttttacaaatgaggatgttgaggatcatagaggataaacatctttccataggttacatggttaataaatggtgtttgagggactcttaggctggctccagccactctgaaagccattgttcttcttactaaccagtgatgttcaccaccaagcctatttgaatatgtgggtgtgatctcactaaggaagacagtgaatcaatttaatgaaaagtctgtgctcttacttttttttttttgagtggctttttaattgatctcaattccttggtttctgctcctttcagatccattttgcccattatgaccaagctatttgagaagcttccatttattttaaattttcaatatatatgaactttttctttaaacaaccattgatatttattgaatgttcaatgttgtcagcagtaccagcatataaatatgaagaatgttaaaaagaattagaactcaaggcaccccactctaccctacagttgagagctttatcaaaacgttgctttgaacctacatagtatcaatttgccaaaggacatgagaaaaggagcctattataaggaatggtctctgggtcagaattggtggcaggtctatatttagaaattctaccaatgaaaaagtgtactgttagaattttgaaaagctataccatatcgtagcttttggagactaaattctccttgcatttacataatacttttgtcttttcccccacttttattgaggtataactgacaaataaaaattatatatatttaatgtctacagtgtgatgtatggatgtacacaaacattgcagaatgattaccacaatcaagctaattaacatatccatcacttcacatagttaccttgtgtgtgcgtgaagggttgagaatatttaagatcaactttcttagaaaagtgagctgagattttcattatgttaagtgaaataagccatacacagaaagacagacaatgcatgatctcatttatatgtggaatcttaaaaaagtcaaactcagaaacaga

SEQ ID NO: 37648 - DNA, 1045 bp, Homo sapiens
tagaaattctggagttaaaaaatgcaagaactcaaatgaaaacatcactagagagactcaacaccagatctgagctggcagaagaaagtatcaacaaacctgaagataggtcaattcacattatccagactgaagaacagaggcaagaaaagaatgaagaaaaatgaacagagtctgagatctgtgagataccgttaggcatactaccatgtgcataatgagagtcccagaaagaaaggaaaggagaaaaaaggaggaaaaccgatatttgaagaataatagaagacgtcccaaatttgatgaaaaacattaacctacatatggatggagctcaatgaactctaagtagaataaactcacagaaattcatatctagacacatcgtaataaacctgccaataaatatggacaaaaagtcttgaaagcaccaagaaagaaacagttcattacatataaggaattcctcaataagattaacagctgttttcacatcagaaaccatggacaccaaaaggcagagggatgacataaaatagaaaaagactgccagccagttgttctttgtacagcaaaattattctgtaagattgaagaagaatttaagacatactgaggcaaacaaaagccaaaataacttagcataattgccctacattaaaaggagtccttcaagctaaaatagaaggacactagacagtaacttgaatccacatgaagaataatgtgaatagagtactgcaaatatataggtaaatatgaaagtcagcataaatgtatttttgtttttaacaaatgtttttcagaaaatagaggaggaaggaacatttttaatgaacatttctcattctgtaaggccattattaccctgataccaaaatcaaacaaaaaacatcacaagaaagaaaaatacagaatagtatctgttataaatacagatgtaaaaatactcaacaaaatactagcaaacatatctaaaaacatgaaaaggattatacaccatgatcaattgcagtttattccagacatgcagtgttggtttaatata

SEQ ID NO: 37649 - DNA, 1029 bp, Homo sapiens
gtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctca

SEQ ID NO: 37650 - DNA, 1065 bp, Homo sapiens
gtttttcaaagcagttgtaccagtttacattcctgtcagcaatgtaagaagagttccagtttctccacaccctctccaacacttgttcttcttcttcttcttttttaatatagccattttaggaagtgtgtagtgatatctcattgtgattttgatttatatttctccaatcgctaatgacgttgagcattttttcatgtacttaattcgtgtggttattggctctctctgtctctattttctttggaggagtttcttcattaacctttgcatgttttataactgggttatctttgtattactgaactgtaagagttgtttatatattcttatgtatgtcttttatcagatatatcatttgcaaatattttctctcattctgtgtttgttttttttttttttaacttttttgatggtggtgtttataccaatttggatttttattttacaaacggatttttaaggaaatttatgtgtcacttatataatgtcttacttaaacaagaaaattgttaggaatagactgcagaatttactgatactatgccatttactatgcaggaacttttccatggatgaaactttgtaatctaattgtaaaacacaaccccttcctgctttggcatatggttaaacttagagtaaagaggaatgatacaattttatttctatatggtgtaaaacagggctgtgacctagccctccttttaaatttatgttcatatgacttgatattgctattagatatattagctatgtggcaagtatctatatagcaaacaagaaaataagaatccttctctattttcttgctactcaaggaccagcagcgtaggtatcacttggatccagcctagatgatctgaatcaaaatctgcattttattatgattctctggtgattttatacatgaaagtttgagaagcacagctttatttgacttatgctaaacacacacacaaagcttgaaatacatgaggaatttacaaacggcagaatctactgtgtttgttaaatattttgcagtccttaggaggacatttttgtttttttataaagagcagt

SEQ ID NO: 37651 - DNA, 1072 bp, Homo sapiens
tatgctactagaactattttttgttgcctacacacattcaatatgcagcatgggttggcgggcaggacacatatgcatttttacatacccacaatcctatccttggaaacctcgcaacttgtagggaatagattttaaacaaagacaaaggaagatgccaggccttgttcccatgtgcagtacagcccccagtcaggcactgaaaagcagaggagcccccttgatcagcaagagatgtgtgagctgttaatgatgagtatgagtgcggaggaagctggtggcatgaaggatgcaagagcatggtgccatgattctaacaagtagaaagttgagccataaactagaaaagcaggaaaatggagtctaggagtgccagctttgaagtcagttaggaggaagaatggctcagacctggatgccttcagtggagttttgttgctccttacacttaaaaatggtggatcaactttgtgttcatttgattatggagggcagagggtgtaatccgtttaatttagctcttttctggggcttagcaactcccagataattttgcctcatttgggaataggctgtatgagtttagttatactattccccttgggttgggtggagaagggagtaagagtatcactagtctactctgctcctttctttcctgactaacttaagttctgccttgaattcaacaagctgtttgctggggttaacgctttccagcacaagtcagggatgttttccgcttcagtccctcatccttcaattttgcagatcctaatgcattggttgtcaaaaccacttcactgcatagaaggtaacaccactagtaacagaaataacttcccttggccctctcatttgcaacagctcattcctaaggcccaatcccagttcctgatggtggatgttgttccagcctggaaagctgaatcacttcctctccagtaacgaataaatagactagatttcactgagtcatctgtctgcccagcaaaggaccctgcaaaaaagagatcaaagtggttttcacagtcttgttgcaaaggaaatctgagttggggcccaagtattc

SEQ ID NO: 37652 - DNA, 1072 bp, Homo sapiens; identical to SEQ ID NO: 37651

SEQ ID NO: 37653 - DNA, 1072 bp, Homo sapiens; identical to SEQ ID NO: 37651

SEQ ID NO: 37654 - DNA, 2363 bp, Homo sapiens
gccttaacagttgtcccagtgaaaatgagcaggggggtttcattgcaaagacaactggcataaatgtatgaatgaatgccagattagtagcatgttagtcaaaagaggaattgagatcaaattgaaagaaaagctgaatatgatagatgaagtctacagaaagtatcacacatactgactgaaaatatttctctgcagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaat

SEQ ID NO: 37655 - DNA, 1048 bp, Homo sapiens
ggaccccatactgaggagaaatttcaggaagtgaaatgaaaattgaaaagggtagggacatgagaaaggaaggaaagagaaagaccagatcaaaatggtggggaacagagcctggaaagctcaaagcaggcctccatcgttttgaatagtatacaaaaaacaacaaggggagctctgtgaagttagaaaaactaccctaattcacctcattctaaaagttgaggaaaactaatttcacataaaaacaataacaggaataacaaggtcaaatcccgtacagtgttacaagaaaaacgagatgcggaaaagaacagcatccctagagacgatgaaatcaagccagaaatatacacctataagacaagtcgaaaattgtaaccttgtatttcaaaatgagctaaaaacaataagatggtataagacatgaaagaaaaacgatcagcattagtaaaactaagaaatgaagctcaggaaaagaattagaaataaaagaaaattatttcagaaatggagactaaagtaggaggaacataaacaacggataatatgttaagaaaaatagaagatgaaaaaaatttaaaaagtgagtcaacctttggacaagagtctgtgaagaaaaccagagcaagggaacagaaaaaatactgtaaaaatgtcatttaaggtaagagatttgaaactacatattgaaaaaacatctgaagtacctgagagtatcaacccagaataatgaacatcaggatgcattctgttaaaattactggacttgaaatcatttggaaatgtaggggacgggaaagagggcatgacttagaaagttaggctgtcgtcaaactttgacagcaaagatgcttaaggaaaaagtgtgaaataaggctttcatatcctgcataactgacttaatcggggcacagactattagcagaaaatgctattccagtgaaccatgaggaatccactagacagagagctttataaccagaataactagagacatcaatttaaagactgctgatttaaaagcagaaagaaaaaaaagctgatttaa

SEQ ID NO: 37656 - DNA, 1031 bp, Homo sapiens
cgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaagtaactgaatttatttccgggcagagaggcgggaggttcagattgcatccgagtaggggtggcggccagtaaagaagcaaaatttagaggagcgcctgtcctagacctgcattttgaccagtcatcagaagaaaagaagtgtactttttgatttttaaggcctttaagttgagtgttaaaataccatctctgtctatcggtgtagggcctgatacttggctgccacacttatttttatactgtatttttttgagttggccagactgcgagctctttgaaggagggagggagctgagtggggcggggggaggggggtctcggtaattccaggtacttaacacaggagctaattatttgagtaatgttttatggtggtaggggtggtcattggcaaagcctggattagaattcatgccttccaacttaactcgcttttgcttttttccccctcccagttggttgtgaattcactccttaaaccaaaaaccaaattcttatgcagaatgaagactgctaagggaaagctaaaggcatagatgttacctttttaagaaacacattttggaacctttgtgagttatttcattgcttgagtcagctatcctcaaccctttattgcttgagaatgtttccctttgtaaaagagattgctaaaattacgtgttctaaagcactctgtttagagttagagttgcctatgggaaaagcagcatataagcatcctcgattcagagaggctgatttcgtccttagacgttttccccgttctgtcttaagatgacagtggtctctggccgggcgcggtggctcactcctgtaatcccagcactttggtaggctgagg

SEQ ID NO: 37657 - DNA, 1007 bp, Homo sapiens
ctagggcttgcaagccttgcagttattttgacagttgtgctctgaaagactgaaaaccgcttctcgtataattcagtgttggattaaaagaggcaacttctgagagtgtctccctggaccttgttatgtgcacatccagctggtatttaatccaggatttgcctcttgctcagtcttgctggcaaaaaaaataaataaataaaaatacagtacagaggctgatgtcactttcatatttcaacaagaaagcaaagggacgcaaactcttcattaagactattcacaaatgtggaggtaaatgaggccattcatgactttgcttaaaatttctgctccataatttggctttggctttgcagattactaaataaataaaatgacatcatgattgctgtgtgccgtgtgttattttggcaatggaaacatgtagagctttacttcaggtttaacctttccttttttacacttgacactcattgctaaggagctagagaccattttactgtattttgcaacaaaaggctcatacattttggactgtaggtctactgctttgtcaactcgtgaatagtatatgaacatttttcaattatttaataatttcaatattttgctatttttttttaggtttgtgactttagagttgattagagaatgttctccagtggtgtatatattgtgtgacttggtcaagaaaggatttggggagtaaattgctgtaagagggtgatacacatacacacattctggcgatttatgtgcttcacgtgtgatgcagaacacagcttgcttctggttggcaaatttggccttgtgcaacggatagtggtacacttcatgtttcagtttccatttctcaagtggactttcaaggactcctaccagtctaagccaagcaatttaattcctttgtagattaaaacataaaataatctcacactggaagcaaacagtgttgaattcaagacatgcaaagcataagtgaaaatctaggctgatttagaaga

SEQ ID NO: 37658 - DNA, 1033 bp, Homo sapiens
ttacatttttaagtagttaaaaaaaatcaaaagaataatttttagtaacatgtcaaaataatataaaatctaaatttcagtgtccgtaactacattgttattggtacatagtaacattcattcatttacatatgatccatggctgctttcacactgcaacagtgaagatgagtaattgcgatagaaactgtatgactgttgaagcctaaaatattaactatctaatactttacagagaaagtttgccaatccctgtcctacagcatggaacttaggaagagcacctgacattctttcttaagatttggacatcaaagtcataaaatcacctgtggcgattgtaaaaatgaagattgctgggttccaatgttatagtctctattgaatagaaatctttggagccttgcagagtatggagtctgcatttttaactaatgccccaggtggtttttctgcacatcatgaaatgagaatctctgttttgtgcagggaaaggacactggactgctggattcctagagctcagtctaggcagactacgtggttcaatatgaaaggtctttcatgcattatttgagatttctggagtattctctctgtattctctttctatgaccccttctcagttacagagctcctacaaagtcttgctgttgaaataggttcttatttgtcatattgtttaaaatggtggtctccaaagtagagtatacacacagtttagttcacaatcctctgggttctaaaagaaaatattagaattattatttttttctgtaacattttggtgtataaattaaatacatataaagagtgtaaaaataaaaaaagtttataacagaagtatagtgttgtccatttacacccattaccacccctattccttttccccaaaggtagtttcttttgccatttacctctatatttctttttttttttttggtagggggtggggaaggagtacatgtaatagtttaatgcattcatatgagttgtagagatcaaatcagtgaaattgggatatccatcacct

SEQ ID NO: 37659 - DNA, 1030 bp, Homo sapiens
cctgattctcaggttttaaaattctgatagaaattctggaacagattctgtgggagcatcttaaacataatgtcaatagtggatcttcccactccttttaagtaggaaatgaatgataaaatctatatcataatatcaagtatggtgctctcaacttgtctgacttgatcaaaagtcaggaatagcaaagagaaacaatggcttttgctatgtgctgaattttaagatgtgtatgctgccttttgaggaaaaggccacatttattgcttaagggctttaaacttaaagccttactgttcattccccaattattcccccttgacaatgtattatggctatctccagctgagtgttgaagatgaagcagctaatgatttgtcgtggtgttagagttcagggagttaacccaagccaaggagaactattaggaaaactcttgtgattagcagaagagaaaccctgaggggcacttgacagttacattagcagttaaaccacacagaggaaacatggatcctggagcaggcagctaacactgatccccactgtgcagaaagggggatcatgtgtatgctgcccagaatccttacatcctgtgaatgatatcaggattgcctttctagatggggagatttcctcattgcatctctagagctcataatgaaaaatgaatgcgttttctcaaaagggccaaacatatatgacaaaccaagaaaaaagtgtttactagtctacggagaccctcgtaaacaggaggtagcaggagagaagagaggcataaaggtagttcagacaaggaagagttctagccttataaagtgctgcacctgtagccatcggtctcgagaatatccatcccctccttgagccatacagattcctttatgaagtactcatggtagaaaatcttaaataaaattattaaagtgatttcttaaaaatatacctggttatatacatccaaaggagcagtgtcctcatcagaataataagattggaaggttgtacacgtattctgcaatattttagt

SEQ ID NO: 37660 - DNA, 1058 bp, Homo sapiens
ttgctctttggcagttatttacgtggctcacaaatatcatcacacttagttatctactgctttataacaaaccacctcaaacttaatgctttaaagcaaccaccatttatttgctcatcattttgatagctgtattgcactcagttggactagtctcaagtatgctgttcctctgctagtcttatgggattgctcttacagctgtagtcatctggagacttgactagagctaggtgatccaagatggcttcatttacatgtcttttacctcagctggaatggctgaaacaggctctctttgcctttttccatgtgacctattgaacgggatggccagactacttgacatggtgcctcaggccctcaagggaatgaaagcagaagcttccagccctcttgtagctgaagtcttggaattcacacgatgtaattcctaccatattctagcagttgatacaagttatgaggggatttgagtttcatacaaggttataaactcgatctcttgacaaaaagattggcatacacacatgggaatggtaggaattcttggcagctatttttgcagacaacctacttcagtttgccttttggggcaacaattcacatctttccatattcaagactcgctaattcctttccatgatcccaaaagactcatattatggcatcagctcaaaatccatgatatctgcatctgtatgaaacctagaagtggataaggttcatcaggtgtggcttctcttgattttgacaccagttctcttttgaaagttataaatcttctcccactgtgactatattttgagaatagtatatattctagagtaaatttaattgttaatgttatcaactgtatcaatgtaagttgtgcttttggtcttaagaagttattctctatcacattattcaccttatcaacaaatgtaaattacctcataatatctagcttatctttcttccataacaacagtactctacaaagtctaccacactaaaaaattatattgtctagcatcttttgcagctgggtatggatgatacataaaagaaagttg

SEQ ID NO: 37661 - DNA, 1047 bp, Homo sapiens
ttgttttggccaatttctcccatttgggatgggaacatttacccaatgcctgtactcccattgtatcttggaagtaactaacttgtttttgattgtactggctcataggcggaaggtacttgtctcagatgaggctttgaacttggacttttgggttaatgtggaaatgagttaagactttgggggactgttatgaaggcgagattggctttgaaatgtgcaaattacatgagatttgcaagggggcagggacggaatgatatagtttgactctgtgtccccacccaaatcttatgtcaaattttaattcccagtgttggaggacggacctgttgggaagtgatcgaataatggggctggtttttctcttgccattctcatgatggtgagggatttcttacgagatctgatggttttaaaagtggcagttttctattgtgctctctctctctcctgctgttgtgtaagaggcgcctgcttccccttcactttctaccgtaattgtaagtttcctgaaggctccccagccatgtggaactctgagtcaattaaacctttttcttttataagttacctagtctcaggtagtatctttatagcagtatgtaaacagactaatacatcctctaagaccagtagtatttgtttttcatttctttattaaaagaaatattgaggttctagaaatatatcagtttcaaataatgctgatagctattagaaagaaataatactttcaaattattaatactcatataagccatgttatttcttaggcgtatgaacttttcaaatactcaaattatatttttttgaaattagcaatgaaggttttaaaaaattatatcttagattatggtatttagaggcatattaacttatgataaaacagaaagcaaaggtatcagttgaatcaaattcttgtgaaattcatgtgacttaacagatattttaaaaatggtacctacacctttagtactgtatttgctttttctgtatgaatttaaacatagtatgagaaacacaaggtagctagcatgttaagta

SEQ ID NO: 37662 - DNA, 1058 bp, Homo sapiens
cccagctgggttgatcttccttatggtctgtttcttccctgcagggagacctggtccctttcttttctttcatcttacttcacttagctagacattattagatcttcccatactttcaagcagaagcttcttttcttaagctcatgtattataatgtaacagcttagagttggacatatctgagttcaagttaatctctgccacttactatatgaccttgaaatagtaacttaatttctctgtgcctcagtcacttcatttgtaaagtgaatataataataacctccttcctagggttgctgtaaagcttaagataacgcggccgggcacggtggctcacacgtgtaatcccagcactttgggaggctgaggcaggcggatcacctgaggtcaggagttcgagaccagcctggccaacatggtgaaaccccgtatctactaaaaatacaaaaattagccaggcgtggtagtgggcacctgtggtcccagctacttgggagactaaggcaggagaatcgcttgagcccaggaggcagaggttgcagtgagcagagatcgcgccactgcactctagcctgggtaacagagcgagactctgtctcaaaaaacaaacaaacaaaaaaacccaaaacaataaaaccttttccaatttagagagcaatcagaattataacgtcttgagtattttccttttgattttttcccctaagaaaagcacacatcatttttgaatgtttgtggggaaaatatgatgtgtcacccagttctgggcctcttcccatctgtaccctgagcccacatgttcatgtactccacagtcaacacacatccgcccccatccgcctcagcctaacaaaatgaagaaatttactcaacgacagggctggcagcaaatcattcccaatgggggtctgggaacagacatttccaggaaacaacatctcatctcctggaaaggagttggagcctcatttcccctttccacaaatgcagtccttttcttacagaggaggaagaggccatgggagcccgagcccctatcctgtggtatatacttc

SEQ ID NO: 37663 - DNA, 1106 bp, Homo sapiens
ttagcgaagttgcttatatgttggattaaactacaattctcaacacattccagaagattgtaatttagaatatgttctctgaccacagtgatatttagctagaaataaaaagataataagaaatgtccccaaatgagtgaatattaagtagtatacttctcgtaacccatggtaaactggagaccacagtaaaattagaaaatactttgaactgaaaaatagtgcacataaaacacatcaaagtgtgggatttagtgaaagctgtgcttagagggaaatgtataaccacagttgtgtttagaaaataagacaataaatctgctctctaaatattcctttcaaaaactcagtagaacaagaagaaagtaaaatgggagcaaggaaataagatgaatagaattaatgaaatgggggaaaatgtacaagaaaaatcaatgaagccaaaagtcatgtctttgaaaggaccccaaccccgccttagcaagtattcaaggacaagaatagacagtaactacccatatcaggaattgaaaaaagagacaagactatagatctcaaagacatttacagagataagaggatagtatgaacaatttcatgtgaatttgaaagaagaacttccaaaactgatacaccaagaaacagaaaatagaaatagtcttatagctattagagaaattgaatctaataaaaaacctgcccacaaagaaggctccagacccatatgtcttcacatttgaattttagtaaacattttaggaagaaataacactaatcttacacaaagattttagaaaatgggaagtgaaaaatgcttactttttttttaatgagactagcataaccttgatcctaaaagcttacaaggacaaaattaattggccagtcttttaaaacattaaagatacaagtttaagatattaaacttgtaagcatcacaacgaagtttatttactaaacaaatgcaagcttggttatttaccacattcaaagattaaaggagaaaaaaatcatatcaatagctgcagaaaaagtcatattcattaacaaactaagactagacaggaaatttgttaatctaataaagagtttttacataaagccta

SEQ ID NO: 37664 - DNA, 1049 bp, Homo sapiens
agtgcatgtagtataatagagaggagtccctgtggaattggggccaaggaaatatgaagagaatggctgttaaaggtaacaagatataaactccatcagaagcagcataaatagtagaaaggtaacaagatataaactccatcagaagcagcataaatagtagttaagaacatggccctggagtcaagagagctaggttgaattttggttctacctctctgactttgggaatttctctgattagtttcttcatttgaacaatgagaaattttcttccacaggttattctgagaattaaatgagtggttttaaagtgtttaatacagtgtttgatacatagtatgtgctcagtaaatggtaagtaacttgctaaaaagagatgagccataaagctgttctgtggtggtggtgcgttcagtcagtggggacctaattggacagtagctttcgatattgatgaacagaacaaatactagagggctttgtgactgacagaattcttaagtgtgcataattgggggatattgttatgcagtgatagacgttctgtagaaaactgtacagaagcaaaaagtatgtaagggctaaatgtacagatgtgcaagagtgtcagtaggtaaacttcccaagtttgagtataaaggaatgtgagtacattgagatgaagaaacatctgtagttacttcattctttcattcattcagcaagtgcttattgagagcctgctatgcaccttgcacaatgggctgctatggatatagcagttgttcacctaggaggactgatacttagaatatagcagggtggtaagaaatgtaaatgaagtcagcaagtattagaaaaacaaagggaccactgggggctatcaccacatttgtcactcaaagctaagggagaaatatctcaaagagaaaatgattcaaataacactactggataggaaatcatttcaagtttttaactggagagtagatggggaagaagtggaaaatagtgcttccattgaagaagctgagcagtgaacagtcattacacattacccaaatcag

SEQ ID NO: 37665 - DNA, 1049 bp, Homo sapiens
tagtttcacagtaaaattgagcagagagaaatgagagttctcctatatactccctgtccccacatacttgcagcctctcttgctgtcaacatgccacaccagagtggtgatactacaatgcatgaacatatcatatcattcatatcagtgtcacccaaggtctatagtttacattaggtttctctcttggtgttggacattctatgggttttgacaaatgtaaatgacttgtagtatccactattgtagtatcatacagaatagtttcaccaccctaaaaatcatctgtgctccacctattcattcctccctcctcccatccccttggcagctattgatcttttttactgtctccatagttttgccttttcctgaatgtcatatagttggaataatatagtatgtagccttttccagattggtttctttcccttagtcataagtgcatgtaagttacttcatgtctttgcatggcttgatagctcatttcttttgagtgcttatagtcaattgtctggatgtatcacagtttattttttcactcagctcctaagggacatcttggttgcttctaacttttggcaattataaataaaggtactgtaaactgctgtaaacatctgtgtgcaggttcttatgtggacagaagttttcagttcatttgggtaaatatccaggattgcagtcattggatcatgtggtaagagtatgtttagttctgtaagaaatatccacactgccttccaaagtggccgtgctatttggcattcccactagcaatgaatgagaatttctgttgctccatattcttaccagaatttggtggtgttagtgttttggattttggccattctactaggtatatcatagtatctcattgttgttttaatttgcaattcctcaatgacataggatgttgagcatgtttgcatatgcttacctaccatgtgtgtatcttctttgaggtgtctgctcaggtcttgggcccatttttaaattgggttgttcattttcttgttgaattttaagagttctttgtatattttgga

SEQ ID NO: 37666 - DNA, 1039 bp, Homo sapiens
gaggtcctgagatgggcctctgttaatgctaattgggagagctgtgcgatgtgtgttaatactcctaatacagagtttcaatgagagcctcaggctttaactcacaaggttagcagtcaaggtctttttaacagcttaattcctacacttcccccacaagtagcttgtaccagggtgagtagcagcagggatttcttcattaatcaatggataaaattcccctcaataagatccaccttaacagatttataaacaagagaactagttgactcagtgcaagattcttagtgcttcttcgttgatgttctttagcttcctattttcagttttttttggtttgtttctcttaactagatcctcagtttttttagagcaagtactctgttttactcattttgtaccccaccatctgataaaatacctgactctgaatatgtcttcagtaaacattgatgaaatggggtttggcagtacaaatgaaaagtgatgtgtagatagaatatttgaatatttcctgatagtgtacagtgttgtccttgagaatagaatgaaggaatccatgtggctatttttctttagctaatttggaaagtattctgtttttttttttttgtttttgtttttgtttttttttgagatggagtcttgctctgttgcccaggctggagtgcagtgctcactgccacctctgcctcccgggttcaagctgttctgcctcagcctcccgagtagctgggactacaggcgcatgccaccacacccggctaattttttgcatttttagtagagacggggtttcaccaggaaagtattcttaactgagttaacagaaaaattaagctgcaggcaaatttgtttttactaatttatttcccagctcttcagatgactgttctctattaagtagtgcaatagtagtacctaaaattcgtgtaatcacattaagtgtttaattccagatgttgttgagatcattcctactcaaagtgtggaccaaggacagcagcattcacatcaccttggatcttgttagaaatgc

SEQ ID NO: 37667 - DNA, 1050 bp, Homo sapiens
aactgattttgggaatccgtgttttcagggtagttaattggagaaagaaatgattctctctctctctttttttccttttttttttttcttgagacggagtttcactcttgttgcccaggctggagtgcagtggcatgatctttgcccactgcaacctccacctcccgggttcaagcaattctcctgcctcagcctcctgagtagctgggattacaggcatgcgccaccacacctcgataatttttgtatttttagtagagacggggtttctccatgttggtcaggctggtctcgaactcctgacctcaggtgatccacccgccttggcctcccaaagtgctgggattacaggcgtgagccaccccgcccggccgaaatgattctcttttaaatcaccagagatgttctaaaattcttctgcttctcctatatctccaaagtcataaagatgatagtatttaaatgtgcaatgtaggaggaggttcaagctaattctttttttttttgagacagggtctcagttcatcgctcaggctggagtgcagttgttgtgatcatggctcactatagccttgatctcctgggctcaggtggtcctcccacctcagcctcccaaatagctgggaccacaggtgcataccaccacaccagctcatttttttttgtattttttgtagacacgaggttttgccatgttgcccatgctagtctcgaacccctgggctcaagcaatccacctgccttggcctcccaaagtgctgggattatagtgaggtatctcactcagcctcaagctaattatttaaaaggcaaatgatcctatgtaatggaaaatgaatctgtggtattgttattctcattctgcagtattacttgccaatcttactactgaaaatagaacttttcttttgaaattctgattaatttgaggtgagattaaacattaatccaggcttactttgtattttcagtaacagcatggagttggtacagtactttacagagtgaaatattatttattgaggtatatcatagtgactttatcaattc

SEQ ID NO: 37668 - DNA, 1063 bp, Homo sapiens
gttgtagaggcttatatttactttctgaattgagccaaggttcttgcacatagtgaggatcattgtcatgatgtggctgtggccagctggtgctcagaagtaatgaggccagggccaaagacttaagccctagtaagccggtcacttctcttctatggccagagacgtaaaaccttttctgttccttaactcggcaagccatttggcaaatgcaatccattagccacaagagaaacaaggttcaaaggaaatggatcaggattaatctatcattgctattggaatataaatcagagcatatgccatgctgatagtggatccaaatcatggttgaccatgtctcatagcacatgaccaccaggtatgaagtgtttcatatggccagtgtcactaacaagccaaccaataattgaaaactaactaccaagaagatctgtagtgctccattggggagtgagtagagtagaagagataaggaagaagcatgctccagggtgcttcagagtggaccagagaacaaagaaaaatgaaggggtgggggaacttttttttctctgtaagttagatcggtcaaagataagggagatgacagttgttgatatcatggtcatttgccagaggagtaagggcaggatgagggtaacaagaagggtctgagactcacaattattcatcagattcctctgaatcaagggagaaaaactgagggccgaaactcaaagggagaaggtgaaatgtattcaaaagtggctgagtggatggggaatattgagggtaattgctgggcaagaagtagttgagaaaaaatagttaaggatagtgacaaactgggaaatgaaagaagaagataaaaataaatgaaaatcagatgacaagtgttgagtataattcttaaaagatagaaaacagctcaagctgtttcaaggtagaaaacaaaggttgttagagaactctgaattctacatattacattaaatatactcttgtgcgatatgtttcgtagttaaataaaaatatttgtagatagcactggtaagtataaataaagacaatacacaagaaa

SEQ ID NO: 37669 - DNA, 1052 bp, Homo sapiens
aaatcactgttacctccaaataaaatcttactatgtagttggttctaaagaaccttaaatattcaattataaattcatccccaggtattttgaagtgtttcatttaatttgaaaactgtcatctggttttcagagactacagcagtatgtttttaatgtgttggtttagccatgtgacaaattaagcaagccctatgaacatgtgttactgagattggtattggcaaggacaataataactaacatttgttgagcacttatatgatagagatactacgacgggctttatgtaggatctcttgtttgatatgtctattacattaaatacaattaggtaatactataatctccactttataggtgaggaaattgaggcttagaaaggttaagtaaattttcaagattatactagtaagtaaatgatctgagattgaagcacagagaccacactcctatttattacactatattacccagttcaaaagcattagtgagacatgtgatgtgtgacattgacctgtcatcctctgtgagaagtagcttctgggactgatggtcttagttgtgcatccatgactagacttctggatgaaagaactccaagtttctaggagggcttgtttcatttctagtcctcaacagaatgtgtttgagaacttgattttttcatgtaattcattcacttatggggcaattaagataaaatatcctggttttcaaactgaaaatgttaccaaaaacacattgcaattacataggatggttgtttcttcttttgggaatagagacgtatcatagattgacaatgttgttttttttaaaaaagtttacttctttgtcagctccgtgaagggagggatcttgtctgtcttggttgtcattagcacccagcacaatggctggtataataaaaagatgttcaataaatatttaatgttttatgttatgactgcttaagttagaactggaatgtggctcctcatatctcttttggtttatgactcctaggtttttttaagagagttaggtagtagtaggtacatttattatta

SEQ ID NO: 37670 - DNA, 1031 bp, Homo sapiens
tccttgcagttttatacataaagaatcatgtcatctacaaatacagatagttttaattccttctttttgatttgaatgcccttttgtctattttttctaatgtgattgctctttctgggacttccagtagtatgttgaacacaagtggcaagagtagacatccttgccttgtaccaggtcttcgtggaaaagcttttagtttttccccattgattataatgttagttgtagagttttcataaatggcctttattatgttgaagaaatttctttgtttacctaaactgttaacagtttttattggctgggtgtggtggttcactcctttaatcctagcactttgggaggccaaggcgggcagatcacgaggtcaggagattgagaccatcctggctaacatggtgaaaccccatctctactaaaaatacaaaaaattggccaggcatggcagcgtgtccccgtagtcccagctactcgggaggctgaggcaggagaatgtcgtggacccaggaggtggagcttgtagtgagccgagattgcgccgctgcactcagcctggctacagagtgagactccgtctccaaaaaagaagaagaaaaaaaaaatttttatcaagaaaggattttggactttgccaaatgctttttcagtgtcaattgagaaagttatgtgggtttttttgtatcttttgttctgtaaatgtgatgtatcacgttgatttccatatgttaaaccagccttacatgtcagggataaatcccactttgtcatgatgtatattcttttttaatttttatttttatttaaatagttttgggggaaaaggtggtgtttagttggatggaaaatttcttcagtgggtaatttctgagattttggtgcacccatcactcaagcaacatactctgtatctagtgtatagtcttttatccctcatccccttcccatccctcccccaccccaagttcccaaagtttgtttatcattcttatgcctttgtgtcctcatagcttagctctcacttacaagtg

SEQ ID NO: 37671 - DNA, 1029 bp, Homo sapiens
ctgttctcaatcctcagtgtgtgtggcagcatgtggtcatagagagctgggcaaagttcactttctctttgctgacagtctcaccttttctcactgggaagctgcacaggagcctttgggctggttcagcccagaggcccctgttctcctgccttcctggcattctctgctccccttctgcatggcacccctctactcctgccaggttagaatggagcagaggcctttgaacaagatgacatttgtagacaacctgatccatcaggatgtggagagatctggacaaatggcaaataatttggggttgaattatggcccagagaagtaagcaaatgaaaaactaaacaattataaatgtatctgggaagcaaaggtattcataatatgtcccatggccagctgcgagcagtatttaactagacatgctgttgtcaatattgaacatgaatcaagccaaatactgatatagctattgagagaaggttggcaggaagaaatcatgggtgagggtatgtgggagtgataatcttagctatagattttaggtaaaactgattctgaaagctttctttgaaacaaatttataatttttcttctacatgtttctagcacaaggactcaattttttttggttataatgttcattaaaacatatgccttcaatttgttcctctttgttcttttttgctgatttagcagatataaatcacttgttagtatttttaactatccaagttaaaatgtacatttgtaagtgttattactggtcttatatttgaaggtgcaaggggtcttgtgctgctcattactggttatcttgagcatttcataactgctgcctcctcctaaatcctgtgttccaaccgctactgctggcaatgcccagcctccattgtggatgcggggaattgtgttcagcatgcttgcttctgccacggcactaaagcctaacttgcttaggatcttgctgtacttggagagagcatccattcgctgagcctagcagccaggctcttgtgactccctggg

SEQ ID NO: 37672 - DNA, 1029 bp, Homo sapiens
aaaaaaaaaaaaaattaataaaaataaaaaaaggctgcatgatatttcactgtattgttataccacatttactaattcatcagatgatgcacatttgggttgctgccaccttttggctattgtgaattatgctactatgaatattggtgtacaaatatctatagagtccctgccttactatgtttggttatatactcagaagtggaattgctcggtcatgtggtaattctcttatttatttatttacttacttgagacagtctcattctgttggccaggctggagtgcagtggtgtgatcatggctcactgttgtctcaaattcctgggcttcacgagtagctgggaccacaggcagacactatcatgcccagctagtttgttttaatttttgtagagacagggtcttgccatgttgcccaggctctgttatttaattttttggggcaattgccatactgttttctacagtggctatcccattttactttatttttcttgagtaatgtcagataagactgggcacgctcagggtggtttggtttggctgtagactttcctgttaatttcaaaccaaaattatatgaccaacataaggaattcctgtaaaccctttaatcagagtcactaattgcttacattttgccccatttgatttctcattttctctctctccagcaacatctgtgcgcgcgtgcacgcacacgtacacacacacacacacacacacacacacactctgtgggtgcatattattgttgaactgtttggagtaagtcaaagatgtgtcccctttattactaaatattttggtgtgtttcctaagaatgtggacattttcttgtataaccacagtagttactaaaatcaggacatttgatattgatacaatagtaatgctactttataaattagaaaataagttgaaaaataattgggatagggtgtaatcaggataggctatatgattgggataggctatataaaaaataattggacaggctatataatttaataattgggattaggc

SEQ ID NO: 37673 - DNA, 1053 bp, Homo sapiens
actatgtaggcattgcttttaaaaaggaatttattaaaaaacagctaatgaaaaaggtcagcaaggttgcaggactcaagattgagatacaaaaatcaattatatttctatgcattaacaatgaacaatccaaaaatgaaatccagaaaacaattcaatttgtagtagcgtcaaaaagaataaaatacttaggaatacatttaacaaaagaagtgtaagtctgttgcacggagcactacaaatcatcatcaaaataaattaaagatgacctaaataaatgagtagatatccccttttcattttttggaagatttaatattgttaaggtttcaatatggtccacatgattacagattcaatgcaattcctgtaaaaatcccagttttctgttttgtgacaactgacaagttaattctaaaattcacatgacaatgcaaaggaccctaaaaggccaaaacaatcttgaaaaagaagataattgaaggactctcacttctcagtcaaaaaatttacggcaaaactatgataatcaagactatgtggcaccagcataaggatagacataaaaatcaatggaatagaattggaagtccagagataaacccttgtatttatggtcagttgtgtcaagggtgacaagacatttcaatggggaaaggatggtctttttaacaaatggtactgacacaagtagctatctatacacatgagtgtgaagtcaggcccctactacatctcctatgcaaagacaaactccaaatgtatcaaagacctataaaactcttagaagaaaacataggaataagttttcatgaccttggattaggcgatggtttcttagaaatgacaactaaagcacaagcaacaacaattaaaagacaaattagtttttatcaaaattaaagcattttgtgcttcaaaggacatcaggaaaaagtgaaaagaacaacctaccgaatggcagaaaatgtttgtaagtcatttgataaggaacttgtatgtagaatatataaagaactcttaaaatgtaagaatataaaagacaacccaatt

SEQ ID NO: 37674 - DNA, 1834 bp, Homo sapiens
ggtggggcggccgggcagtggcgctcctcacatcccagatggggcggtggctgggcagggcgctcctcacttcccagacggagtggcaggcctggctaatttttgtattgttagtagagacagggtttcaccatactggccaggttggtctcgaactcctgaactcgtgatccacccaccttggcctcccaaagtgtttggattacaggcgttagccacttcacctggccttcctatacatatatacttaaaaaaaacaaaaacaaaaaaatagaccaggcacgatggctcacgcctgtaatcccagcactttgggaggccaagtgggcggatcacctgaggttgggagttcgagaccagcctgaccaacatggagaaaccccgtttctactaaaaatacaaaattagccaggcatggtggtgcgcgcctgtaaccccagctacttgggaggctgaggcaggagaatcacttgaacctgggaggccgaccttgcagtgagcggagattgagccattgcaccccagcctgggcaacaagagcaaaactctgtctcaaaggaaaaaagaaattaatagacttttattttttacagcagttttaaatttacagaaaaacgagtagaaagtacagaattcccattactccctcattcctcttcccaagtttccttttcttcttttttttttttaagacagagtcgcccaggctagtgtacagtggcatgctcacagctcacggctcactgcagctttgacctcctgggctcaagcaatcctcccacctcagcctccttggtaactaggactacaggcatgttcctccacacctggctaatttttgtattttttgtagagatgaggttttgctctgttgcctaggctggtctcagactcctgggctcacgcaatttacccacctcaacctcccaaagtgctgggattacaggcatgagccaccatgcctgtaataggccatttcccctgttattaacattttgcattagtatgtcatattttgttacaactgatgagccaatgttcatgtgttattataaactaaagtacacaatttacatgagggttcactctttgcatatcctgttttgaatgctagtgcaacttaacatgttgtcttttgactagaaacgtctattgtatgtgtctatttatctagggtaaatacaaacatttgaaaaaaaaagaatttatgtgaattcagggtcttgtcttttcctgaactggtttttattctgagactgagtcttgctcttgcctaggctggagtgcactggcatgatcttggctcactgcaacctctgcctcctagactcaagtgattctcctgcctcatcttcctgagtagccgggactacaggcatgagccaccatgcccggctaatgttttttttttgtattttttagtagagaacagggtttcaccatgttggccaggttggtcttgaactcctgacctcaagtgatctgcccacctctgcctcccaaagtacaggcatgagccaccacacctggaatgaactggtttttaaatctatctttgccctagggagtgccagctgacattatgatctttcttaaatattgggctgtactttttttgttgctattttcacattcaggatctcatttggcagtcaactcttacccaccatgccagcctctgcacctaacatcctttctcatacttctggtgctttttagacctcccaacaaatagaatgggggtgctacgtgggaacaggttgctttcctgggtaatagtagagtcagctggggatcctacttgtttgattttgagttaagcaattgagttcaa

SEQ ID NO: 37675 - DNA, 1063 bp, Homo sapiens
tcgtctcataaaaaaaaaaaaaaaaaaagaaagaaagaaagaaaagaaaatgggaatggtttttaccttgcacaggatttgtaaagatttaataaaacaatatatgcagtgtgttagacatacaacatgtgaaggctaaatagtaacgcttactaatagtaatcatgtgtttccattgaaaatcaaggaaaaagaatggaaaatcttgaagccttagaattaggtaattgtggccgggcatagtggctcacccttgtaatcccagcactttgggaggacaaggtgggtggatcacttgaggccaggagtttgagaccaacctggccaacacagtgaaactccatctctactaaaaatacaaaaaattagccaggcatggtggtgggcacctgtaatcgcagctactcgggaggctgaggcaggagaatcgtttgatcctgggaggcagaggttgcagtgggccgagatagtgccattgtattccagcctgggcaacaagagtgaaactccgtagcaaaaaaaaaaacaaaaacaaaacacacacacacaagaattagacaattgtgcacatttttggtcagctactttacaaaatatacactttccttattctctaggtgtttcccatacctaatgctaaacctggattatggccttctgttctctcatactaagttagtcaagctccctttattcaagtaattcctgaaatcttatccctccaaagttttccccaatgaattagaagtaacaaatttgtaaatttggtgacaacacttctgcatttactaggatagtggtgatttcaaatatcctgcctttgtttttactatacacctccatttacttgtcagggcacatgtcctgattattggttagaccatatatatccccaccaagtctcaaaatgccatgccatcattttcccttgtccatactcctcctacaactacctcactacatgtaaagaacttaattgacatttgtcctactttatgtatgtcatttggatctgggacagaaaaatatatgatacataagacatctggggagaaggggccat

SEQ ID NO: 37676 - DNA, 1064 bp, Homo sapiens
gtggagtcagctcagcaataggttactgaatatagaataactccgtcccagataaatgctgtgctgagcggccctggcaagagccgtaattcagaagctgacagcacttggaaactgccctgcggcagaaacccattgtaaacaagctgtcaagcttaaggagaatatgctgtgaaaatgtcttagataaacaaacacggtgtcagtccaagcctggctcctcagaggagccgttcctggaagggcctccctggtactgtgaagaaggacaagcgctcacgctgcacgcctcagagtgccttggagtttctcgcaggcacacgtggccatgcaggtccagccttgacacaccctcatggagtcccaccttctggaacctgctgtgttccagaagcacacctgggccccaggaggccagggccttggtcagctccaccctaagagctcagggagaggtgtcctagaaacatcactgtccatgtcacaagtgatttgaaacccgtagacagacacaaagagagctggctgagaactgagtccacattaaacatgaagaaattgtcggtaatggacttggtatcagccccagtttggagtttggaggagaattgaggcaccatgtacaggaagtctttccactcactgcatcactgatgcaaccagtgtccagcacagaagggaatgaatgagcgacccggttcctcaaagtgtgactcccagtcccaaggtttgattgtttaaattcttcttataaagggggaactgccaatggaacgctgtcccaacaaggctcactgtggggctgctttagacacatcccccacacggcctacaagcatcctgagggtattcagcggtatttccccatgaccaattcactcctatactccttttccccagtgcagtcagagatagataggtgagctgggcacattgctgaggaggccgtttgccaaggcctagtcccatcgatatccctaagtcacaccacttccagagagaaagggcaaaatcaaaatatgtaatcagatatcccaaagccttctgtgacttttttttttttt

SEQ ID NO: 37677 - DNA, 1045 bp, Homo sapiens
ggcagaaataaagatgttctttgaaaccaacgacaacaaagacacaacataccagcatctctgggacgcattcaaagcagtgtgtagagggaaatttatagcactaaatgcccacaagagaaagcaggaaagatccaaaattgacaccctaacatcacaattaaaagaactagaaatgcaagagcaaacacattcaaaagctagcagaaggcaagaaataactaaaatcagagcagaactgaaggaaatagagacacaaaaaacctttcaaaaaattaacgaatccaggagctggttttttgaaaggatcaacaagattgatagaccactagcaagactaataaagaaaaaaagagagaagaatcaaatagacacaataaaaaatgataaaggggatatcaccactgatcccacagaaatacaaactaccatgagagaatactacaaacacctctacgcaaataaactagaaaatctagaagaaattgataaattcctggacacatacactctcccaagactgaaccaggaagaagttgaatctctgcatagacaaatgacaggagctgaaattgtggcaataatcaatagcttaccaacgaaaaagagtccaggaccagatggattcacagccgaattctaccagaggtacaaggaggaactgggtaccattccttctgaaactattccaatcaatagacaaagagggaatcctccctaactcattttatgaggtcagcatcatcctgataccaaagcctgacagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaa

SEQ ID NO: 37678 - DNA, 1034 bp, Homo sapiens
attgattcaggcaactgtcatcagtggatgcaatcattagacccttagaattgtgtacctggggacttccctgagcccactaaaagtgggaccgccatacattacttgccatctgatgtgatgcaccaagagtagacagtaccatctatgagctagtattgcctgagagttgaacctgaaatgaatcaagccaatcctggggttccagaaaatacaggaaagagaggaacaagtgaaatggtaacacaagaagacagacaaatttaaaaaatggagattaggacagggctctagaggacctctacgtgaatttcttcaacagacaatggcttgggaagaaagggagaggccgatgtgactgagagggacatacgatgaataacatccaaatatgatgtgtacaacttgtttgggccatttaaacaaaccaaccaaaagattttttgagacaattggggaaatttaaatatagtctgggtagtagatgatatcaagggaatattaagtttgttagataaaataatggctgtgtggttatatgagaaatgttcatatttttagaaattcatactgaagtatataggggtgaaatgactgatttctgggatttactttaaaatcataataaaaaggaaggaagaaaggataggtgaaacaaatgtgataaaatcttgattaatttttagattggcatatatacattctcctgtaatagtgtaaataatttttatgaacaaagggaaggaaatgcaaaaagtaaaataaaaatattggcataaaaaattttagattgggataagatatatgtggatttactatcatgttctatttgacacttttcataataaaaatattaagaaaaaaataacaaatctctctcagagataatagtggggggtccatggcctagaagcaagataggacctctgactagaaaaaggtcattatctgagaattgaacattttaaaaaaaatttttttgacaatctcctttacttaaatttaaaaaaacctatttcttttggatttttggt

SEQ ID NO: 37679 - DNA, 1047 bp, Homo sapiens
ctgttgcccaggctggagtacagtggcgcaatcttggctcactgcaacttccacctcccaggttcaagtgattcccctgcctcagcctcccaagtagctgggattacaggtgcccgccaccacacctggctaattttgtttttttgtatttttagtagagacagagtttcactgtattttcaggctggtctcgaactcctgggctcaagctatttgcattccttggcctcccaaagtgctgagattacaggcgtgagccaccatgcctggacctagttcaagctttctaattgtcttgctgtgtaaacctgaatgggaaatataagatctctgcatctttgtttcttcatttataaacaaagaggcttggtttaaaaatatcttcagggtaactgaagacaaaagaaatcgttaggttgcggtacagatggacaatttgaggactagaagaaaactgtttaaaaacaggttctgacaaaaatctgagacctattcattttaacagtgtagaaactccgaaaacaatctccaaaatgtatgtgggaatttggcatagagtagacaaggcattaaaaataagtgggaaaagaaaggattatttaataagtgatttagttctcttcatgaaaaagaaaggtagattaatgtctcatcccatacaaatggataattttaaatgtattaagggcctgagtgaaaaataaaactttaaaattattagaaagaaatgcaggcaaatatctttatgactgtggggaagagattatttctcagtcggtacacaaaaaaggacaattcataaaggaaagattacactaagaagtaaaactattttatgcaaaagcctctatgagtaaagctaaaagacaaactctgaactggaaaaatattttttcaacacataaagcagaaaaaaacgtttcagactatatagtcagagaatccttacaaatcagtataaaaaagacggacaacttactacagaaatgggttgcaaaggataccctcaggcaatacacagaggagcggatttaaagaaccaataaa

SEQ ID NO: 37680 - DNA, 1046 bp, Homo sapiens
gttgcagcttcccagtgggcctggggttttgttggcatgttgctggacagctcactcccaccctctgactttcctgaagttttctccaatatattctagactctttcattcttgctttgtatcaggtagggttctccatagtgggggttgggggatggggaagtggcagaggggtgaaagaaagacagagaaatatttgttttaaggaattggctcacgcagtcgtgggggctgggaagtccaaaacccatggggcaggcagacatgccagaaattcagttaagagttgatgttgcagtcttgagtcccaaattcatagcacaggccagcagactggaaactcaggcaggaattctatgttacagtcttttttattttctttctttttttctgtggtaagaacaaaacttgagatttaccctcgtatcaaatgtttaagtacaccctgtattattcttgataatgtcaagacaagaatgacagtggatttctagggcatattcatcttgtttgactgaaactttatacccactaatgaataactcctcattttctatgttacaatcttgaggcagaattccttcttctccaagaaagctcagtttttgcccttatggccttcagctgattagatgaggcctacccatatgatggagggtaatctgattgacttaaattcagatgattgtaactgttcatcacatccacaaataccctcacagcaacatatagactagtgtttgaccaaacaactggccaccatagcctagccaagttgacacataaaactgtcatacattctattctatttgccatcttcttcctggcctccagaaatttgttgaaattttcttttcatgatgttcatctcccaattgcatcactctcatgtctttttccttttagtattattctcttagagtccagagaatcaaagtttatttgttaaagagaacccagtttttcatacaggtgcctctcccaaacactggcatgtcaacgaaggtcagcagtcttcttaaggttaaaaaagagaaaaggcatat

SEQ ID NO: 37681 - DNA, 1046 bp, Homo sapiens
agtcaataggcttaatatagtcattctccaaaacaaccggctatgtttctttgctatattaatactatagcacaaatggttaattccccaatagtggtagcaggcaagcctaggttgaccaggtgtaccaaatgggcaatgagaattattatttatctaatgtaattttaaggggggaagagatttgcagaaaagcatagccttatcaaaaaaattaagtatgcagtcattttgagtaaactggaatttagaaaaataactgaatagatgattctactgtttctattagaaacaagatgtgaatctacaggacagactggcctgaggacccagtcctttcgaccttggggtatcagtgatagggagagatcgaaagcctatggattagagaggaagttctacctggtaagggggtccagcctccctcaggcagcattctgccatcccttttgagacaagtcctcaccaaattgacttcccttccatgtccgttgaaaagcccaccatgttttttcttgtcttctcattctgttgctctttctgtgtttcttctgcttcacccatccaaaccctaatccccacctccaccaagaagtcttctctgactacctggctttcccatgcattcacatcatatctgttacctttctctttgtattaacttgtccgtgtactctattgacagctgcttaaggattggacagtaacctactcagtaaccacttactaaattaaatgatttaatagttgttaaatttaacatctggtatctattggtccttttataacagtagttgcttgtcctcatactaaatttcaggtcagccctgggaagtactgtaagtattctttaatacttactcattgtcatcatatgagttgcttttaactatttgttaagggtataaattcaaaagtaaaatttttgctttctcttatcctcatttttcactccccagatataacaaatgttaacagtttgtatgcaccctcctagaagtttgtatatatatgcgaacataaatgggagcctattacatatactc

SEQ ID NO: 37682 - DNA, 1108 bp, Homo sapiens
cttataagtgggagctaaacattgagtacacatgcacacaaagaggggaatgatagacaccagggcctaattgagggtggagggtgagaatcgaaaaactacctatcaggtgtatgcttactacctgggtgatgaaatcatttgtacaccaaaccccagtggcatgcaatttacccatgtgacaaagctgcacatgtacccccgaacctaaaataaaagttgaaaaaaaaatttttttaataaagataccttatttagtatatattgttgattcattaacactaaactcacagccaatagcacttgtgtataactcatgcctaaatgaagcttatcgaacacatgtattttctccataaggcacatcacagtcttcttgtgcttaggaacactagccagcacttcagcactgtgtctgggggcttatttaaacagtgaaatcaccaataaaaagcacaaaaatgcaaaaatcctggcactatgcacaccatgaaaaggacactagcttacatttacagtatgagagctaaaacaagaaggcagagcatcaccttgtttgacctcagcttagaatgaatgctttgggtaactgaaatctctcaccagtctatgcatgtgcatgtctgtgaatacctgcaaaagcgcttcaagtattgacttgggggttgcaaggaagttttagcaattaggcaaattcataaatatggaatccataaataatgaggactgattatagttgttttcttatccctaacactagttttaagccataaagctagttttaaaatatttaacagctttatctccctgaaattataatacagacattactgatttctttttttgctaattaacatcactttgtgtgatttaacaaaaaagaaataaagtgcaggttaatagaagtaactttggtgaataatactgcaattcaaacaaaaaagatctcttttcaataggtttttgagatttcaggcattttagcaatttggatatatatgacagttatttaataacaaagtttaatgagttttaaaaatgaatttattgatgaaaatatttaatctaaactactttttatatctgtaagtatatattgcactgttgg

SEQ ID NO: 37683 - DNA, 1049 bp, Homo sapiens
tctcactttctaagtctcttggctctaggacttttctccaaggatgaactaagatctgggactcccagagcagatttcacttgtgtccttccctccctggggtggtcgcttagtcctggacctctctgccttcccgcttggatgtagaccatttaaagggtgagcgccatgcagttagcttcaagcctggggacaccggggtttcaacaccagggttttaatatcggagcttaattttgacgcatacttttccctgccttccagctccacccctttccctgatcaatggggctaggaaggggaaaaagtgaacagcaaaaaccagtcctgagaagaaaatgggatggaatggctgctgatgagagagctctcatcccctgaaatcccaccaatacgcttttttgctgccgatggccatagtacttcacacttggggaacgacatggacaaactacaagggatattacagtctcatctgctgcctaaaactaaattaccaaaaactaaaattttagatgccataaaaattcactgatgaactctttcgtttttcttattgatgcctctctttttcatttatctcaattgcccatttttgctttcaggaataaagccaaaaaaacagaattctccaagtgtcaagcaaaaacacatactttgcacacgtttctcgaggtccagcccgaaagcctgcgccctgggcgtccctgcttcggcccccagaggggggtgcgctgctcgctcccctcgctccacctcccgcgtagcctgcgggcccctggcggcccagggcatggggcagagacgccatgccggctgatacacacgcccggaggaggtgagggaggaagccacttgaaaataaacaggtgccgtaaagggcataggtagcttgcccgggtttcctgcttcctggtcgctcgcgctcgcctccccgccgcctcgcctcccctcgagcagcctccgcaccccgttctttcactcctcggcgcgtgagctcctggcagcctcacccttttgcacatgacgcgcctccccgggtctcccgc

SEQ ID NO: 37684 - DNA, 1035 bp, Homo sapiens
tgaaaatgtaaaaactgaaatgaaaatgttgaaggcaggaaacaggtttttgtcaataaattcacatgggatgaatgaattaattaaaatttatccagtttaggccttctagcctttcacaaatagtcacaggttaacctggctcccagactgattttcctaggatacccttaaatcaagtgtcttagcttaagagtaaaccaaattcacccaacctttaggtacatataaacaagtctgaaaaatttgcagaggaggtaaggagtatgttgtattcatgagtcttctgagcaaaaagaaggagtttgaccaatactatagaaaaggggtgacactgtgtcttccccctcaaattaatccttaatactcagactaatccctggtatatacatgtaacaggttcagtaactttgccagaaagtggactagaagcttcagtagatgatggccttggctgcaagtattgcactctcagctagacacgggtggtggctgctgcctttgatgtcctcagtaggaggaaatattaccctataaaaaggacaggagaagagaagcactagcagggggtcaccaagaacattagtttgtggaacacagaggaagaagttcttgagaagcctcatacttcttagcagaaacagaagctgagtcaggaaatattgttttgtgatcattgttttgactatatatttattctctggctgtggtgacctaggaaacatggattttccaccagcttagagtttgtgctagaataaagatgactgaagtgggtgaaaaaaatatctgagacattgaaacatgattatatatgcattttagacaatatttatagttcagatttaagtgaattggttgtatattactgatctgcatggtttagttcaatgttgggcgggaaatgtgacattagaatgtttatcaactgataaaatgtgatttattaaaaatatatggtgtgaagaacattgttaaatgccatggaaggttgacattagagggaagcaagacatgtgtggcaaattcctacct

SEQ ID NO: 37685 - DNA, 1050 bp, Homo sapiens
aattgtaaaccaaagctaatacaaacctttaaaagtttctgtgggaatcagagaacttatatatggaccttgttcccagacactccatgatagaaagaagaatatatgtaaattagttaatttttgtgagccttggtttattcatttataaagtgaaattattaacacttatcttgaaaggttgttttgaggatcctagataatgcacataaattaattagcacagttcttggaatatagacagcattaatcaatatatcagcactacttgtgggaaaggctcttagggctcaccagatattctggtgctcttctatactttccagactacctagcagttaggttagtgtcatgtgagtagctctagccaatgaaatatgaagagaaattggcatttctgggccaggacagttaaatgccagtgtattttctgcatctgtttccacctctgcagcaggaaccttggctatggtgtagctacaatatgcaaggaaattgcatccctgagtcattatcaaatgggaacttctcaggagagctcctagactgtattggactttgtatgaacatgaattaaaatttgattatgttatgccactatgacttggggattttttttttttttttttttttttggtcactgcagtttgcctagcattatccagtcattattgttgttgttgttactattgaattgaatagaactactcaaactttggcaattttactgatacatggagctaaagtgttggtgcctaccctcaggtaatggagacagtaaaatattcctgttgcaaatcaaacctttatttctttcacaaacatagattccaagaaaattaagggaaaataacataggagggagaaaaaagtatattaaattttccatttggctccccagctaatcctctttattaggctaccttatttccttgaaacactctaagagtcaatgcatattttcatgacttataatgtctctttatcaaagttttagaaattatgttttctctcttctaaatttcattggttcaaaaatcctcctccaag

SEQ ID NO: 37686 - DNA, 1034 bp, Homo sapiens
aacaatgcattcctgaagcagatgctaaaattgtcacagaaaaaaaaaatatacagtagtgatagagagtttcagccagctgatcatctgcatggatgtctcaattggctgaagttaaccaagttcttatctggctttattcacaattatatgcaccaaaaaagtcagttacataagccagtgtattatctgtcattatctgtcatccagtgtaaataatttcatgatgttagtccatttgaatagtatgttggtctcctttccacctggagaaccataagactaacaagaacttgcaactctcccaaaatccaaataaaacatatgtctgatagtcagttgactgaaacaataaaataatctaaaatgttattttcctaatttagtaaattcttttctatttgtcattcagatagctctggagtcttcactcccctttttgccttgtaatggaggaggtttatgattttccattcatattacatgaaatgtagagaagagagtaaggagcaatgaaggaaggaaaaatggtgtacaaaacatgattcttcagaatagtatttcagtaagtaatgagaatgtgaagaatcaagtttggctgtagttggctatagtgcttaagacgggaagtaatgggaagtaattttggatagatagttggcagtcagactgtggaagccttgagcgccaagctaaattgtttgaattttatatttggggtataggaagtcttaaaatatttgagcaggaagtgtcaaaatgagaatgatttttaggagtgctaatttgggtgccatagctaggaaaaatttgtgggccaaagcgattaggagatactaaaaacaggggaaaccagacaggagaatattacactagagcaagcacaaggtgagaaaaggctgaactagattgatgatagtgccaatgggaaagagagattatgcaaaaaaagaattgttagggcttggtaaaggacaaagagagaagtgagattatgctgaagttttgagcccaggtgaccagaataatgaaag

SEQ ID NO: 37687 - DNA, 1099 bp, Homo sapiens
aactcttagcagagattgattaattgggagataattgattaattgggagttgattgattaattgggatttattaatttgggagtaggtaggaagataggaagttgtataaaataagggagagataacttagtacctggaaaaaaagaaatggaaataggtagaagctaagagttcaattaaaaaaaaggaataaaagatattggaagggaacgatgaatgtagcatggaagatccaagatgatgggagttcaggggctaattacagctatggggaaaaagtaatgtataagctggaagccagagataagagccatgtaaatgaagaagttgggccccaataggaaagaattataaggactagaaggagcaggagccatgtggaaaaatatcatgtagtacttttaagcttgatctgtcatctgtagcaaaaccagcatgcttgagtactgaattgacctgactgaactatgttgaaatgtactgtggttttatatccatatgcacttggtctgtggagttgtgggaaaagcatcagtgagtaggaagcccaaggatttgggtcaagtattaaatatgctatttactgtctagctatgtgaccttatataagtcacttgtggtctctgagccttcatgtattcatccataagatgagttgttgtttatattaaatgggatgtggtatgttaaagagctgaatgcatagtgatacagaattactttctgtaatactattttttaaatattttaaatgaaaaattaatgaacttataaattaaaagattcaaaagggataaaaaggtatacaatgaaaagcaattctccttcccaccagtaactctgtcctactccttaggacattcaccataaacagatatcctgaattcttctagaaatattatatataaaatcttatatttcttatgtttcttttttactattttaaaggggataaactaaactttgctttttttcatataataatatattctggagatcattttctaaaagcacatgtaaacatacctcattattataaaggtttgaaaatatcaatttatttgacctgtcccctctcgatagataattagattgtat

SEQ ID NO: 37688 - DNA, 1063 bp, Homo sapiens
atcaaatgtttgctttttacactttctggaggtataatttgcatgccatagttttttcccattgaaagtgcacaattcaataatttttagtaaatttagtaattattctacttgggtgcagcaattcaacagtactctcagtgaccattgctctttgtatctttcccttctgccaccctcagtggtttgattttctttctaaggtttgtctaaggcaagtttgcagtacaactatgatagctccaggaactgcatcttcaaagttatgcattcacaaccagaagaagatatagtccttctcactgtttcttttttttattaaggatcaaaattccttccagaaatccccatagaaatttcccttatatttgtttgattgatactaggtcacatgcttattcctgatttggtaacccaatgggttacaatgctcacttagaccaattatactgtatacccagccttcatcacctagcgctgggtgagaaatagaaggtatattattttgaatctcactattatgattcctttgacaatctttagaattcatgttgggactttcagtttatctttctaatcctcagtttcctgcttggtaaaacaaggggactggagttagactagggtcaggaaaatctctgaagattccttccagtgcaaaagacttgttggtcccttagagtttttcacagtttcccttatccattccaatggggcttgtagggagcctagctccattctgatttgattccaggaactacaatcaaagtgtagaggtgaggaagaaatgtttcttttcgtttatctttaaccaaatctacttttttctccatctgactttgcttggagccataggcttgtattatcttggattataatatacttctatttagatagcattgaaaaaattgaaatcagggtgttcagtgttaaaaccccctggtttaaaatatgtctttgtggtttggcttatctgctattttattttaattaatttatttttctttttcttgcagccacagcaattgtctgctattttaaaagcactgtgatgcttaaatat

SEQ ID NO: 37689 - DNA, 1033 bp, Homo sapiens
aatagtgctgcagtgaacattcgtgtacatgtgtctttatggtagaatgatttatattcctctgggtatatacccagtgatgagattgttgggccaaatggtagttctgcttttagctctttgaggaatcaccatactgctttccacaatggttgagctaatgtacattcccaccaacagtgtataagtgttcccttttctccataatcttgccagcatcttttttgttttgttttgttttgatttgacattttagtaatagccattttgactggtgtgagatggtatctcattgtggttttgatttgcatttctctaatgatcagtgatgttgagcttttttttatatgcttgttggccacatgtatgtcttcttttgagaagtgtctcttcatatcctttgcctacttttcaatgtggttatttgttttcctcttataaatttgtttaagttccttatagatgctagatattagacctttgtcaagtgcatagtttgcaaatgttttctcgcattctgtagattgactgtttactctgttgatagcttcttttgctgcacagaaactcaagtttaattagatcctgcttgtcaatttttccttttgttgtgattgcttttggtatctttgtcatgaaatctttgctcgttcctatgtccaggatggtattgcctaggttgtcttccagggtttttatagttttgggttttacatttaagtttttaattcatcttgagttaatttttgtatatggtctaaggaaagggtcagctccaatcttctgcatatggctagccagttttcccagaaccatttgttgaatagggcatcttttccccattgcttatttttgtcagctttgtgaagatcagatggtcatagatgtgctgccttagttctgggctctctattctgttccattggtttgtgtgcctgtttttgtaccagtaccatgctgttttggtcactgtagccttgcagtatagtttgaagtcgggtaacatgatgactccagctttgttctttttgtt

SEQ ID NO: 37690 - DNA, 1050 bp, Homo sapiens
caaattccaagaaatttttgatcaaaaaaacattttttgtttattgttatctctaatctatacctttactaactaacatcagtcttttaggaaataggaaaagtaacctacatataaagtgtaattttctgttcattttattaacagtttggctaggattgtttataaaactgtattaaagatttaattggcttttaaatctgaaaaaaataattttatttatatttttataaaatctactcagtccaagtgtttgaacagtctttcagatgtagaaaatatgagatatcagattgaataagtaccaagctcataaaatatagtctagagtttgctttccagaaactaatcctggcactcatttgtttaaaggaaaataatttaatttgattttcctttcacttgtattctacagaaatggtaggtcactatcatttagttggcaatggattggaggaaaaaatctatctatttctaaagtatagtatcactttttgtcaaatttaatagactgtagtctgtagtgaaagaatatgctatgaacttaactgccagcaaaacttaaataattaagacattaagctgtcttaattattcctaaggaggaaattcttgactgccctgcttaatttgaaagccaggataatgaaatgtcagttccgcatccttaactctttctactttgccatttcagacaatcgacagggtctctgctttgcagaggtactgcagacaatatgtcaaatggcatccagtagtcgcaatctcgtcactaagtcagaatgctgctgtgatggtgggcgaggctggggccaccagtgcgagctttgcccacttcctggaactgcccagtacaaaaagatatgtcctcatggcccaggatatacaactgatggaagaggtaaggagttgaggaaatttattcatataatcaacacattaaattttatgaattcagataaatgtgaaggaaaagtgaaaaattgatacaatcaaaagagtagctaaaatgtttataccttgatatttatatttgatgtgtgttttcat

SEQ ID NO: 37691 - DNA, 1752 bp, Homo sapiens
gagaaataggggtgacatggggatcacaatttggattactgagagagagttatcagggagaaggggaccagttcatagaacatttggccacatggagcctgcaatgcccatgagacatggagttgttcatgtcaggtaggcaggtagacatacatacacccctaaagatcaaagacaggaaggtggacatggacttgggactctctggcacatggttggttgaaattacaacttttgacttctgaagcaataatagtttatttttatgaataagttaaacatacaacgtaatatctcttgtctgaaatatcagctggctagtggacagtgatagtatggacaattgtttattttcaagtgttgaatggctaataaatactccccctgttctgcagatataaatgaatgtgatgaagatcccaacatttgtctttttggttcctgtactaatactccagggggcttccagtgcctctgcccccctggctttgtactatctgataatggacggagatgctttggtaagatttggcatgacttcactgtcacagttcacgcttagaaactttaaagctgaattgtaaaccatcatgctggtattagtcctaacaaaatacatgtctatgctaaaatacatctgcaagttaaaaatttaggtctcaaacataagcaatgaacaatttttaaggtactttgaattattgccactgtttctacatttttataaatttttttactaaaagaaaaattcttattctgatttatcagaatgactatgttaattttgttgttgtcatagcttttttgtttgttggtgtatgtgatgcttttgatgtgatgtaacttactgaaagttaccttgattgtttttcttagactatcatgcaacagtgaaaaaagagactctgtgtggaaatcactttgatactgagcatgatttctcgaattttcttagcacattataaaaatattttaagcatattaaataattaaataattttatagccaggtcagtctaaattggcaaatgaaatcagcaatcgaagatttccagacctgccttaactgctgatctagtctgcatcccgtgttctacaatgagaaatgttctgtccaaacagtgttacaaaataattccatctgtaatgtttgcttttttgattagatactcgccagagcttctgcttcacaaattttgaaaatggaaagtgttctgtacccaaagctttcaacaccacaaaagcaaaatgctgctgtagtaagatgccaggagagggctggggggacccctgtgagctgtgccccaaagacgatgaaggtaagagcaatgacatcatcagacagcactttgtgtaccagtttttgaatgtttgccagagtgggtttaaccatgtaatttaagaatattttgagagtgaaatcatctccttgcatataagttttgatggttcattgaacaacctagcctgagaaacttctttcagcttttgaataagacatgtctaagcacaggtggagttacccttttatttcattccccacctccaaggttagtattacttgctttcaaaagtacgaatttgagaggtccaaggcaggagaaagaagggaatggaaattatattccaggttgctccaggagtcccatgtgggcattgtatcacaggctgtggctctcagaatgttacattaaattctgagaagctgagtcagcacaatggccctttacaggaaaagatcaatagcctcagg

SEQ ID NO: 37692 - DNA, 1042 bp, Homo sapiens
aattccaccaaaatgggggaatataaaacctggaggagcccctgcaggaacatgagagaggactccattaaatggaacagacctacatacagaccattttctataatttctgaggagagagcaaaggctaagttcatcaacatagagcccagaggagctctccccattctcaatcttctctccctccaccttacgaaactttgggcgactgaatacagctttaatgaaaccgaaaccagctatcttccacataaagctctgataaagaaggaaagatatcaagagatgttatttaaactgtactaaagtagatagaagctcttgaaagagcagacaaagtagtgtctatacaagctgaaaaacagtagcaactatgcaggcattctgtgaaaacgaaaggaagaaaaacacaaaatcagctaaagaaccaacccacgatggaagaaaacaactcaagaaataaaacaaattttccataggtactttatgccatatatgatcttaataaaatcataaatgtagttgaagaagtttgtagagattataagagctatagagtaaaagggagattgtagaatcaagggaagtaagaaatggggaccaatacagcaaaataagaggactattaaataaaaacagcaaaaaacagaggacatacagatgaaaatgtaattgctagcatagagaaagggcctgagataataacagtggaaagaggaaagagaaattaacactattagagaaaagacaaaaactataaacatcagtataattggtgttgctgaagagagcccaaaaaatcaactagaaaaaaggtactaaacaaccaaacattttcctgcaataaaacaaagaactgaatatacaaagcctaaattgtaagacaaagacttagatttgctacatttgtcaactttaatcatagaggaggattgaagacttcagatagaaaaggcaacgcatctcacgtgcaaagacacacataggcttaaaataaagggatggaggaatatttaccaagcaaatggaaagcaaaataaaa

SEQ ID NO: 37693 - DNA, 1125 bp, Homo sapiens
ttccagggttactatcataacttttcaaccataccctcattcccattttcgtagccccatgtgcctactctttttctctttttggcctcccatttttatgcttcttgtccatctgtcattttggccaactattgcaaaacagcctgcctctgatacaagacattcagctgtgtccagcctcctgtgctccaggatgtcacccaaattcatcctctcctttacatcttctttcccctactctagtcccaaccagagagagtttctgtctctctcacatgccctcgctcttcgtgtctgctgaatgctaaaagaatcccctctggtatgttggcttgttccctctctggccctcctgcaatccattctccacgtagcagcaggaggaagcttttaaaccatggattcgatctcttcatagtcttcactataacccattgaattcgggataaaattcagcttccctcccttggctgcgggtttccactgtctctctagcttcattgtccatcaccctctgtctggtgcattctgctttgccactctaacctcctttcattttttcagtcacactgagctcttttcctccttggtgtcttaccatgcactcgtccctctgcaaggaatatccttccccacctctgttcagcaagttaattgtttctcatcctcaggtctgaccttaactaaaaactacttcctcaatgggggcatctttgttcctgcagcccaaatcagatgccttttttattctctcatggcaccttgtaacttttcttcatggcacatatagcaagatttagtttttttctgtgtttaacatctgtcttttctgctcaactaagggattccatgaggtcaagaatcatatctctgtttcctcatctattaaataaacttaaaaactctttgttaattttcctgctctgaaattcagtatcaccttcagaattgattcttctactgataaggaaaccactaataaaattcaccctcagtagaagtcagaatgagatctaacactaatttgctttaagctgttaaaaaattcacgttgactagatatctcacaaattgcttgaattcataattttggcccacatttatagcctggacattggacattgg

SEQ ID NO: 37694 - DNA, 1022 bp, Homo sapiens
gggctttggagtcagactgcatgggcttgaatcttgatgctgacactgtactagctgggtgaccttgggtaaattggttgacctctgtgtgcctaaattttctcatctgcaaattgtacataattcacagggttgttttaatgagtaaataaattaatacatagaaagccttccagttcctgtcactatcttgataaatcttagcaataactgttgtttatcttacttaaaatgatgacaaggtgataaatcagaactagtccaggtcattaaaagatcatttaaatacacagtagctttacacaaacatctctgtttcctctgtgctatggaatttacagatgtaaatctataacaagcctgcagtttgagacctgacacaaatgcttctctacagttttatccaaactgaacattccagccagagtgaaaaagcaaagtgactgtccagctctttttcacacctttgccctgtaactttttattcagtacaggagagaattgttttgtttcaacctctgtcttggtgtttgggttgttggtaacttcttgtgtttcctagggaatcagaaattactatttctgccatcataggcccatggtttaattgtaattccctttctgtgtttgggggcaggggggtatttttgttgttgaatttagaagtaaaaacttttttttttttttggaagacagggtctcactgtgtcacccaggctagaatacagtgacacgatctcactgcagcctctgcctacggggctcaggcaatcctcccacctcagcttcctgagtagctgggactacaggcatgtgccatcactcccagctaatttttgtgttttttgtagagacggggtttcaccatgttgtccaggctggtcttgaactcctgggctccagcgatccgactgcctcagcctcccaaagtgctgggattatagtcatgagccactgtgtctggccagaagtaaattttatctgtacatattattaaaatgaattttcaaataaatactata

SEQ ID NO: 37695 - DNA, 1024 bp, Homo sapiens
taatatttttaaagtttagacattatttcatgtacttttttattaaaaagagaatctagttgaaaaagaaaataacaaatagtaaaatatacacaggacaagtcatgaatgtataataggactgtcagtggctctcatcagtggttagcctgcaactttctcttccacaggtccaggtcattacattttgaaatttcatgatgtgattactaatttaaaattacattagattatatatgaattagttggatactatgaatatttaaagatttagaatctatttttcaagctttctaaatataaattaatcttcaactattctgcaaactgcttaaaaagactatggtgttctggttgaatatggttaaatgtaatagaacaatgcatttgattaatatttcctgcattatactgctgtggtttgatggttctatataatccagaccagtttccctcatctttggcttgggtctgcgctctgtcttcaacttgcatggatatatggctgtgaccactctgctgtcaaatccaatggtctattctcattcctcaccttagattattagcagtatttgtcacagttcattaatcattctttctcaagaaattttgcatttttggctttccaggcacaactatcttcttcttctttcacttttatggcacattttctctttcctttactgagtcctccctatcctcctaacctttaacctgaagtgttccaccagtccgtctttggacctctgtttctctttctacactcatcctcgagagcctctgtgttgactctcacatttgtcactctagttgataatgaaattctaggcctcaaccttgccaccaattccagatttgtgtttccaactgtctgtacagtgtctccacttggatggctcatcgatatctcaaattcccatgtctaaaaccaaattcctgtgtactggcttgaacctgagtctcccaggaacatttccatctcagcaaatggcaaattcattcttctagctgccaccccttaaaa

SEQ ID NO: 37696 - DNA, 1049 bp, Homo sapiens
tgataactttaataggtttttagtccaagagaattgtcctttccatttgataatttaaaagttgtcatttgagtttatagaccataactagtgtttaaaagcttctttgttttcttctaatcacatatttttgcagtggaagttacttaaatgagttaaatggttagagaagtcctcattttcagtgagatactggctgagcagtgagtacactgaattatgtttttgtatcttgatcaaagtactgtatatttcagaataatctgtggtatgaatactagtcattgttcctgtttaaatctcactgtgtgggcctacagaagggtcccataacattctcaaatccaattactactttgtaatagaaacttttaagaaaagatttcatctttgatgactgtggaatagccctttttttttatctgttaaagtatttggtttttttttttgtgatgccacagccaagaaaactgcagtagtaatagtatgcaaaaagatgtaacattctctcttcatcttactgtttaacttcaaagcattcttgtgaacagaaaccagttaggactatagaacaagatgccaaaacatgaatgactctgctgaagtcaatgaaatgcaattacaaagtgcagtgctaactttgaattgaatcagaggggccactaaaaaacagtaattagcctaaagaaaaaaaaaagaaaacttcagcataaaatcccctttttctaaacttacttctggtgacagtttcccctattgtccaacatcttttcaggaactcctcaaagaggagtgctcattccattcccactgaaagtacttgaagatttatcttttcagtaggtgagaaggggacacacttaagagtttgaaatatctttcaataggttatgagagtcctctttttaagccagctctggcttctcaaatgtattcaactacagagtctctattttctagatcctgctcccatctctaacaccaattcttcagaaatgctctgagaaatgtactttatgaaaaagtatcctagccatatttcctccatg

SEQ ID NO: 37697 - DNA, 1358 bp, Homo sapiens
tctctattgaattgcctttgcaccttgttgaaaatcatttgctcgtatatattgggtctgtttctggactctcagctctgactcacctacttaggggcttgctgcatcctgccagtgttccccctgtctgcatcgtggtctgaaaaccctcttaaagcaataagctgaaatagttatgatattcactgtgtttgttttccttctcttagggatctatattctttgttgcctgatgtcaagtttcttgaaaaccatgatttcttatactttgtccatttgtttgtgttttgaggaaggagggtaaatctgtcttggctgggaacagaagtgtcccctattttcttagtgcaaagattgtggaatgaaaaaaatgggaacaaaaacgccagctagtaaatttttatataagtctaggcaagaaattatgacaatagtgatgtaggactgcagaaaaacttaatgattcaacaagtgcttgggaggttaatcgatagaatctgatgacagattagttgtggggagtcaaagagtagaaaactacaatgatacacaagtttctggctgagcaaaactggacatatagtggtggtgttaacatgtataagaaggtgcagattgggaggaaatagttgttgagtctttcttggacatgctgagttttaggtgtctagggtatttaattatagagctctaatgctaagaggaatgtccggggtagagttacagatttaggagtcaacaacacacaggtggctcttagaaccatgaggatgaatactgtgtcccaagctgaacaacaggacaagtgaaaagataacaggaatactacagctggaatcttatggaacagacacatcgaaggcccttagtctagctcaactcagacgcacctcgttctagctcatagtgttagagagatagcaaaataatatggagaattatgttcctgaagttagggaagggcacactttcaagagaaaagtagtgttaggtgttaaatgcagtagaaaaatcaaaggcagtgaggaaaaacatctgttggatttggtaattggggggttttattaactttgaagagtggttttaggatggtaattgagtcattttgaggttattttatttattcataatattaacacacatgtgtttcattaactagcttaaccctaaataacagatttgagttcaggtcttccattaaacagtatagatgagaggccaggtatagagagagttagcatcataattttgccaaaaatgtcttaggtccactatgattataaaagaaaatgtgggccaaatatgatgttttggaaaaaacaatcattctaaactaggtacagggctacaagatcaga

SEQ ID NO: 37698 - DNA, 1059 bp, Homo sapiens
taaacctgcacttgtactccctgaatgtaaaataaaagttggaaagaaaaatatatgtgtatatgtaaaacatatctttctccatgtctgagttctgagccaattgagggatagccaaagaacccatttcatatggagttctaaaaattttgagaattaaagttgtttgtactgtctaggctccctatttgtgcttgcttagttcaaagtcttaaagaagttggtcatgatcctaagatgtactccatgtttgcacatactagtcaaagctgggattaatactcccagctttgggcccatgtctgaaaaaatccaactataatttcatctagagccttggttttcccaagtagatttttggtccccaggtgccacttgaatattttctccagttttcccagcccatgtaccctgtgttgaagaatagaggcattctaagcacttatttctaaaagacaaggaggaaaatgaagctcttaaagatatgctgtaaaacagccacagagttcacaacaccttatatcataggtgttcatgactcctaaaagtctgtaagcccaagaagacaagaccatatctttttcttagttaatcatgatggaagtattgtgcagatttttaaactagctttattgtggtttaattgacatacaataagttgtatatatttgaagtatatagcttgataagttttgatatgtgtataccaataaactcatgacgacaatcagataatgaacatatccatcaccctcataaggcttacttttgtcccttgtaatctctccatcttgctcctcctttcatccatccccagcccccatcctgtccccaggcaatccctgattagtcactgtacattactttgcatcgtgtagaattttatataaatgaaatcatactgttacatatatgacttttgtctgatttcttttactcagcataattattctgtgattcttctgtgttgtggtgggaaaaatcatttatttctttttgttgtggaataatattttattgtatggatatagcacagtttatttatatattcccaagttg

SEQ ID NO: 37699 - DNA, 1034 bp, Homo sapiens
taatcaaccatgaatgctctcatactcttaaaaaaaaaatctcttttaaaagctatttaatgaaggcctttctcaatcatcttctccttcttcccttgattagacattgatgagtgcagcatcattcctgggatatgtgaaactggtgaatgttccaacaccgtgggaagctatttttgtgtttgtccacgtggatatgtaacctcaacagatggctctcgatgcatcggtaagcctcgcattttgaaggctcaatacactgggtctttataatgacaaaacagcccaaacaggtatgaagatggcaacgattataaaatattgaagaaatggctgaatgagttgtttaatgtaaacggtaccagtattgagggattgatagaccaggtactctttgcaaagacttcagtttcagaatccaactgggtttgttttatgttgtcaaagtcattttgggaataaagaaagacacaaaggcacgagaaaaattttttaaaatctgctttgggagacagaatgtagtaattaaagcttcttttgtgctatgaatcatgaatgttattaacatcttatttacttagaacttgtttattctattgaaaatagttactatacaaaaaagacacctttaattttgtgtttaaatatattcaaattaaaaccattgtatgctctcccttgtttatttagaaagatgcaatagtgctacagtcatggtgaaggtaatctgttattgagcaaggcttagacatctgtcttattgcgagcatagagattatgaagtgtcttttgatgcataatcacagcacagtgagctaccctcacatttcccttcctgagcttttaacctagtctattccaattttaagctgacaataggtaaaaagagaggaaaaaagaggcactgttatctttactggcactaaagattcatgtagtgcaggaattaggaaaattaatccaatacttaaagaatggtgttgtttggtccactagagggtggccgtttgggcagtgtctctctctccccaaac

SEQ ID NO: 37700 - DNA, 1034 bp, Homo sapiens
caggagaatcacttgaacctgggaagcggaggttttggtgagccgagatcatgccattgcactccagcccgggcaacaagagcaaaactcttgtctcaaaacaaaaaaaattatacatcagtatcagttgagatttatctcaggaatgccagattggttcatcatctgaaaattaattgatgtaatatattatttaaataaaagacaaaagccgtgatcacctcaatatatgcaaaaaaccaaaagcatttgaaaaaaagccaatacccttgtattctaaaaataatcagaaaattaagaatagaaagaaaaaaataagaatagaaaggaacgtactcaactttatagagggcatctatgaaaaactacaactaacatcatacttaatggtgaaagaattaatgctttccctaagattgggcacaagactgatgtctactctcaccatttctcttcaacattgtactacaggttctagccaaggcaattatgcaattaggtaaataaaagttacccggactggaaaaaaagaagtaaaactatctctatttgtagatgacacgtgtttagtggacaaggtaacaactgaagtgaataaggaatacactaaagtggctatggtgtactctaaaaactattagaaccaatgaatgatttaagcaaagttgcaattgtacaagatcaatgtacaaaaatgaattttatttttatacaaagaataaatggcttaggaataaatttagcagagtaggtgatagatttgtacactgaaaactgtaaagccttgttaaattaagaatgatctaaataaacaaatatacaccatgcttacagattgaaaaacttaatattgttaagatggcagtactctccaagtcgatctgtaaatgcaacacaatccctgtcaaaaatgaagcttgcttttttgcagaaattgaagaactaatcttaaagttcatatggatgcaaaatacacatttttcgtagcagcacatagaatattctccaggatagagaccatatgttaggtcaca

SEQ ID NO: 37701 - DNA, 1076 bp, Homo sapiens
atccattgagggtcatggaacatatttcccagagaaggagagactgctgtattagaaagcgattttaattcttaaagtaagtgttgtcaaacaggaactcaggatcttattatttttgccagaaagttccaaagggaaaggaatggcccactaagataacaataaatttggctctactgtttttctttgtagatctaccttacttattcccaactatcacctcctattttttctactcttcgttatattacttctctttctaatcttctctactattgtctagactgctattaaaacctgggcattcctgaaattagaagacatgaaattctctcaacattatccaaatcatttcagttgttctatgtttatgagtttgtctacctgtacactacatgggatatgagtcagtgtggcacttgaaaagaagttcatgctattgcaatcagtattttgtgttatttatttatttatttatttatttatttatttatttatttatttttgagacagggtttcactctgtcgcccagactggagtgcagtggtgctggtgtgatctcggctcactgcagcctccgcctcccaggctcaagggattctcctgcctcagcctcccgagtagctgggattataggcctgtgccaccacacctggctgatttttgtatttttagtagagacagggtttcaccatgttggtcaggctggtcttgaactcctgacctcaaatgatccactcgcctcagcctcccaaagtactgagattacaagcgtaagccacctcactggcctgtattttattttttcaatatgattttgcaagagaaaacatataagcaactactgctataggcttagacataaataggttctgttttagacacgaatgtgaacaagaaagaaagtgctttaaacataatgctatgtttgaaatatgaatgtaaaacataaggaagtaagccaaatataacaaaaaagtaaagacttaaattttaaatagaacaataaatgtacaataatacaacataagagaattcttttatgttcaaaatccagaaattataaaagaaaata

SEQ ID NO: 37702 - DNA, 1069 bp, Homo sapiens
tatgtttcagattccaaatagaaatagacctattatttagttgctgcccttaaagttagacatttgttttcataggaataaaatattatgtgtgaatatctacagagtatagaaataagaatttctgtttactaatggaaataataagcactggggactccaaaagtagggaggctgagaggagggatgaggactgaaaaattacctattgagtacctactgagttttcactatttggataatgggttaactagaagcccaaaccttaccattatgcaatatattcacataacaaacccgcacctgtatccccgaaaccataaaaattgaaaagaaaaagcaagttcaatgtaaaaaaattaaaattagaaatggatctaatttggtaacaagaaaagttaaaaaacacgctatgaaatatagtagtaatttctatgtcccctggttgctacacatataaattaaatgaaccatttttatatgcctataatactgcacatattttccatatttggacatgaactaaaaataatatatcatctaataataatttatgtaataaaataagtttaattttttagaacaagtttacacggagaatttggagaataaatgaggttataaactagaattattgttgctttgttacattatttttaaccttaatagacatggactgacgttattgcataaggtataaatttcaaaatatataattgtgttctataaaattgttacatgtgatttggaataattcaaaatttaaagaaatagtaagtttttgcctgaattgaaggaatgagcaaagataacatctgtacagtctggtcattggagaattaatcaatcattagtagttgcttgtgataggactttgcagatgtagaaattcttgcatagtttgaaggcttgaggcatgcttttttatatttataaagagcacatcttggtccaaagtggttattttttggttatttctatataatttcttttaaattttcttttttattttaactgctaacttgatctaactaaaagaaattaattctacataactgcagagcctagg

SEQ ID NO: 37703 - DNA, 1045 bp, Homo sapiens
aaaaaacagtttactaggctgggtatcacactcactcatgacctcccttagctgcggggagggggtttcccatccccgtgtggctctcaagtgggccgtggcaccacactactcatccttctctctgtggatcacgccagccttctagtcaactttgatgaaagaacctggatacattggttgccagtgaaggattcacactctttgtttttttttgatgggagcctctgagagacgctgcttctagtcggccatcttggccccacattttactttaaactgttgccatgctaacattctggacttaagtagtgtcagaaaggtgtgccctcctagcgtggtatgaaatcagtcatatcaattcttgatggctttaatattgagagccatttgagttttagccgttgtgcttaatccacatttaatctactttcttccattttattatacattaaaggaccaaagttaactcatataggacttaaaatttaagctatcataaaacaagtgaattaaaaatgttaatagtgtcattaagcccttttccaataatatttgtgaactttaaatatataacaaattgccatgtgcatatgatgtataattttcttacaaagtttcttctttttttgtctttagtctcatgaacctactctaattaggagtgacattttgtttaagattagtacttggctttggatcttttaggttttcaaatgaacagggtgctcctaaaatttttttaaatatattaaaattaaactggcataattattaatttttgtaccatgtgatatttagggattaggcttttaaactacttcaaatgcttcaaaactgaaggtatagcagaagaaaattgtttgtgaaatttcatctcttgcttcatcattgatgataataacattgatgccaagcctctgctcctttccaggtaatgtgaaatgcacaggaattcacatatttgacacaggccctagctaggacacaggataaggtcatgaataaagaaatagcaatacagaccctaaattggtttctgcaa

SEQ ID NO: 37704 - DNA, 1059 bp, Homo sapiens
gaaagattaaaaatgttaagtagagatgtggaatccaaattgaacttctacagatgaaaactacaatgtctgaggtgaacatttttctggatgggattaatgggagatgagacattataggcgaaaagacgagtgagcctgaaaacatagcaacagaaattatttgaaataaagcacaaagaaaaaaaggcttaagaatgtaggagagcataagtgagctctgtgacaactttcagcaaactaaatacatatatttagagttagcaaaataatagatggcagaaaaaatatatttgaagaaataatggtcaaaatttttccaaatttgataaatgctataaactgacagacccaagatcaatgaatccccaagcaaaagaaacttgaagaaaattatattaagatacatcataatcaatttctcaaaaccagggatacagggaaatcttaaagtagccagagaaaagagatacattttgtatagaggaaaagaagataaaaataacaacaaattatttgtccaaaacagtacaagtaaaaaggaaagtggaacagcacatttagagcactaaagttgaaaaagacaattctctgtctaggcttttatatttaataaaatgtctttcaaaatcagaagtaaaataaataaagctttttcccaatatataaaagggaagaattcattttccagtcacctgcacagtaagaaatattaaggcagttctttaggctgaagaaaaatattgccaaatatttttgaatattctttgaaaaatattgaaaggaatgaaaagtatcaaaaaacgtaactatgtgggtaaatatataatacttttccttagtattttaaatctttttaggaaacaattgactgaacaaaaattaattacaatgtcctatggggtgtagagtagatgtggtggtaaaataataaaacaatacacagaggctgggatgtgcctatactatatgtcaagaattatgttacttgaagatagacattgataagttaaagatgtgtggtgtaaaccttagagtaagcactaaaaatacagagta

SEQ ID NO: 37705 - DNA, 1067 bp, Homo sapiens
gtaagctatctaaaataatgtcctgatggtaaacagtttcatgacatatcaagaagttaaacttcgtaaaatgtgataaataactagcatcgagccataacagtaaaaacaaacttgagctaaaattaatattacataatcattcattgttatttacatcctcagtgcatttttccagagcttgttgtggcatcaagttatacagcactttctttattgtgaaactagaatatatgaaattatgtcaatgaaatattacagataagtaggggtcaaggtttatatacatatagaggctttgagtcgtgaaaaagccttatattttaaaaattatactcattaccctgacaaaacttcatcttgcttttcaagtttaacctggagaagaaactgagaaattacaattatatggtgaagtttgaaaagtaaaatctttttcacatacatttggatgtatatatacatcaagatatttttattatttttaatgtaattgagatttcttgggactgaagtacattccacaaatgataagagtttaatgttacacttaggatgaatttaaatgtctttaccagatgcttttatttgggaaagaaaaattaattatgaaacgttagcataaaaagataaattattcagaatggaataacacacatttcttagataacgctaagtttatttgaacatcatagaatgtagaataaatttaaaatttcaaacataatcataattggtagagatgatcttcatttttctgggagtcaggtaaactttgtagctctttcatcctgaagcagatttcaaagtcaatttgtaattggcaaagaaattgggtgagtagtttcaactcagaggcttccaggaattacgtcattattcttcaacagttattcattcattagatttgttagtccttactaaatttctgagaattcaataaagatttacatatattttacatgtacagtagcatgttttccaaaaaaaattgtaagattaattagttaatggattacccttgggatattttttaaatgttggtttgtttcttaaaagtcttatta

SEQ ID NO: 37706 - DNA, 1045 bp, Homo sapiens
ttttccctttattgccatatcattttcattttttcttattacatttttctcctcctactccttccctgtgctaccgggatcggcctcttttttccttcatttcccatattttattcattccttaccagtgaaaatatagattatagggttagtagtacagaaattgagggttgagtagttacattctaaatgagcatgagagccagcgaatatgattctgattaaaaaaaaaacaaaaaaccttttaccaaacacttgcttaacagtgtgatttacatgaagtatgtaagtttttgtctgaatatacttaaatatatttacttaaatttaagatgtgaactttaacctgtgtaatttatacaagttgcagtttaattaacataatgtactataatttaacataagatcctttattggcagcatcactgcactactatattgtgcttggagactggctatataatgagcttcttgctatttttgtatgcagctgtctgtgaaaatggatgtcagaatggtggacgttgcatcggacccaaccgctgtgcttgtgtttatgggttcactggtccacagtgtgaaagaggtaagaagagaaatgagactttactttctgaagaagtctattttattgtaaaaatgtataattttttgctattcaatgaagattctgctaatgaaattatatttttactcttctttgattatgtctctaagttgaatggtaagattttgagacatagctaatagtggcagaagtgtctcaactttttccaccagtgaactcagtttgggcggccaactctggggctatggctctagggtaattttgagtgagtgactgatggcaaattctaataatgtgcttaattcaaattaggaggcattgttgaaagtactgcttctgttaaaaatgaaatagtgtcaagttatctttggctgcaaaccccacaaaatctgacataaattgtcctaagcaataaggaaatgtataacatttcacaacaaaaagtctcgagctagtgggcctcaggtaggatgtgat

SEQ ID NO: 37707 - DNA, 1049 bp, Homo sapiens
gtccctcttccagcccggccttcctctcgggttcgccccccttctccccaatctccgtcctcttccctcccttcgccctcccccccttccttcctcttcccctcacccaaccctggttcccctcgttcctcagtcccgatctctcccttactctgtccccgcccactctgcgccggcctctcagtccgggttgagccccacgtgtggacggccgcgcccccactgacagccgccgcccgccggcccgccccgcgccccgccgggcctctaaaacccccgcgccgcgccctccaccgccgcatcttctccagcgcccagcctcccgccctctctcttgctggccgcacgccccggccccgcgcacctccgcccggctccgcagccgctacccgcgcttcgttgccctgtgggactccgagcgagcccggagggaaccctcctcttcttctgggggcgacttttgtttgcttgcctgtttctttctggtgacttttgcagctttccaatatccgtcttcggagcgcacgggaatccgccgagctctgcgtgcaggcccttttttcttttgaggttcacattttttgaaattttacgccagggcttttgtaatttcctcccccgcccgctgacggtcctggagtcgctcggggctttaggccggttatgcaacgtgtaccgctcggggctgccggctgcacctccgccgcgcctcgccgctcactgcgctagacccggcgccccgcgtctcgcttcgcgggcagtcagggggccggcgctctgtcgaggtctccagctagagcagggagcccgagcccgagggagtccccggagccgacgaagggcttattagaccctgactcttttctgaggcgcgcagattttgtctttgatcactccctctccgcgggtctacggccgcgcgctttcggcgccggcgatggggagaagacggaggctgtgtctccagctctacttcctgtggctgggctgtgtggtgctctgggcgcagggcacggccggccagcctcagcctcctccgcccaagccgc

SEQ ID NO: 37708 - DNA, 1031 bp, Homo sapiens
atatacagatacatgtatatgtatatctagatacatacatatacagatacatgtatatgtatatctagatacatacatatacagatacatgtatatgtatatctagatatacatatacatgtatatgtatatctagatacatatacagatacatgtatatgtatatctagatacatacatatacagatacatgtatatgtatatatagatacatatatacatatacggatacatgtatatgtatatatagatacatatatacatatacggatacatgtatatgtatatatagatacatatatacatatacggatacatgtatatgtatatatagatatatgtatgtgtgtgtgtgttggtaaatgttccttgcatattagaaatgtatatttaattttttggagtgcagttccatatatgctcattacatttagctcttaaaagctctgatatacaattgttaagtagaataatcaatactggattgatttttacattgtactgacaaaagactgttaaaattccattgtgcttataattttttgatgtttccctgtgattctaatttttgatttgtttatctcaaagtttattgtttattaagtactcggtctctaagtttgtttattttgaactattatttttattattgtgtaaaatctatatgtttactttgctaaggtggattgtgtctgatactaacaaatattaatatacagtactgcactaatatttgcttgtcctatctctttcattttgttttcaacatccattttctctgagtctcttataaagaacacatagtgaaatttttaaaagctagttatataatatcttttaaatgcatttaatccttttctattattgatatgtttggatttctattatttatgatttctatttaccaagttatatttctttttttattttatttatttatttatttattttattattattatactttaagttttagggtacatgtgcacaatgtgcaggtttgttacatatgtatacatgtgccatgttgc

SEQ ID NO: 37709 - DNA, 1063 bp, Homo sapiens
ggagggactggccttggaaaggaggaattaaaattctgccatatagcagaaagcagatgaagtatcctacgttaggctaacgtgtcttgatagcagaaaataaggaggtaatctggtggctgctatatttccccccaccaccactagtagtggaataatctgccctattgtttggctgtttccattagtgcttgtatgtaggtgctactgtgagaaaagggtttcatcagatgggggcactgaaatggacaggcaatggagtttaggttattgagaagagtgtaactggaatgatggaaagcaaagttcaaattgactaaggggagaaaagagagactagtggcatcataaccaatgaaatcagatgatctgtcaccacttttggtggctgcaactcagcccacacccacagcccactcaccatgggcaagtattatcatttttcttttctttgagacagggtctcactctgtcacccaggctagagtaaagtggcaccatcttggctcactgtaacctctgcctcctgggcttgcctcagcctcctgagtagctgggactacaggcacatgccacaacacccagctaatttttttttctgtatttttggtagagacagggttttgccatcttgcccaggctggttacaaactcttgagctcaagcaatctgtttgccttggcctcccaaaatggtgagattacaggtgtgagccaccttgcttggcatatcattcttaactaataaggcagcatacaattttcttaaaattcttattttgaaataattaaatatttggaataacttgcagaaatagtacagagagttcccacctacctttcattcagtttctccccatggttatacctgagcaactatagaactacagcaaacccaggaaactggcatttgtacctgtgtgtgtatagctgtacgccattttatcacatttgtagatttgtgcaaccactgccgcaatcaaggtctgaaactattcattagcacaaagatcttcctcattctacccctttatagtaatacccatccctctccccaccaccat

SEQ ID NO: 37710 - DNA, 1050 bp, Homo sapiens
aataaccattatgcattcatctctattgaattgcaatatctgaaaatgaagggtaacttttatttactaactctttgtgctttggaaatttaacaaagactagacattatattaagtgagccgccttttccagtttcacagataagctgacactttttactataaaatatatgctctgtatttaacccataaaatggatatttcaaaataaaactaaattctattgaggtacctcacattactagaacttgcattgtaaatgctgaaacatattcttggttgtgggttcagtgtttcaatatgcataactgaaattttctatacattatttaacattctaaaattttaaattaaattatagaactctgtaagacagagactatgtgtgtgggtatgcctgtgtgtgtttgtaaatttctttataatttttataattttcttttaaaatttctacttattaattttcttttggattaacaatggccagtaagcatgagaaccaaaagtaaatatactttaatgaggatgaaggacttttctctgagcgcttcctagatctttgtaaaatgctgattattttttacacctacatttatttaacttaaacgactttcaaaatcatgtcatgccatttactttttatcctttttttacattaaaaaatattattccctaaggatattgtctgagtgttaaaatgactagttcatttttttattttaatgaaaataatttactttgctttgttcacaacacctaatatataactaatctgatcttgccatttatatgcatgcaaatattttaatgagatcacatagctgtcaagttaaatttaactgttagcataacactcaaggaccttcatgaattggctttcatcctacttttctgatcaaatcacttcccacccaccaatcctcatactttacactatagtaataacattttcacttccaagaaagccttccacctggcacgtgggtgcctttgcaccgaggtatatccttggaaggctttctatatcttcctttatcactgagtaaggtg

SEQ ID NO: 37711 - DNA, 1061 bp, Homo sapiens
gcttagtgctgagaaatccggggttgaagtagtaagccttagtctaaattgggtaaggaaggaaaataaaccagagcgaatctatcagaattatacaggtgagggtgtcctgaagacccagctaaaatgcaaagaacattagttaattgtgtccgtgaaggcattgctgagctagagagacaatgccattcatagccaggatagttgccaagatgtgagagcctgaaccaatctgacttaaggagccaaggcatgttgtgaattatagcaacaggaatcaaaagcaaggagtgaggataaaacacaaggaaggtggggcagttcaggaagctacgtttctgcaattttgactgcattctctatgggcccagcaccttaagtatgatgtatcacattgaacactgagaaaattgaagcagctcaagtggtaggaactattccacaaaattatttttaatgagtaaggtttaatgattttctttagtaatctgaatgatgtagaaatactgcatgactgcaattcaggatgtgttgtgaccatttttttctgaagcttccaaccagatgactcaaagaaaaggttttgagttgttcagtttgtaaaaggttttgagttgttccagtttgtccaaattaccccaagaaaagagtatcatgaattgtgaatcaagttatgcattgcattaaggccaaggccatgagatgagggacagctgaagctctcttcttgctctgcttaccaagttgtataccctcagggttgttgtcactctgagagtggattttctaatcccatgctcaaagtgggggaatttttctaatttctgaaaatatatcacagtggcaaactgtagcccaacactagagaattgttttcaaggttgaacagcatgatggtgtttcagtagccaatgttatctagttttcctttaggaaaaaaaaaaaaagccccagagcaaagttaccatcacagaacaatataattattgtgttaaaaaacaaaaacacatgaggagttggtggtagaagtagagcattagctgcaatctgtaattgcttgt

SEQ ID NO: 37712 - DNA, 1031 bp, Homo sapiens
tttacaaggcatatacgtcacttgaggatttcaaatgatctccaagcaaggaatggatattatagcaacaggaggggacacttctgctgctggcttagaaggttcagggtaaatcttggagtgtaggcctcaaggtcagccatccgtatatcctcatctcagatctcaggatctctctcctcctttattgtggccccaacattagcctagaagacttgccaaggctgttaatttagccatcttgtaaatctgcttctctcaaaatcaggtcctgggactgaactttaaaacagtgctgtcctctgacatgagaagatgagggttgctttaaatgctactacagagtccttctaggcctttcacacattgaactgacttgacataactgtcaactcatctgaaactgaataaacagcacagaacaactactaaccagcttcacaatccttataattatcattctgtctatcttgctgaaatgctggaaacactgtataacccagtacattcctcccatctataactcaaaacaatttcaccagcagtaagagtcttattctagcatttctgaagatgtcaccagtccatcacaccccactaacctacttaggtaattattgccatctgtccagtatacaatccaattgcataatcccatcccaaaagtctgcatcctagaatcatttttcgtacatattatcttcatttggattcctccagaagccaactatgaggcagggattcaattgtaagtaatttatttgggaggagatccaggaaatactcttgggaagtgatccaggaaatactcttgggaagtggggaagtgagaaatgaaagtaaaagcagccaatgaaaagtgcattgtcaagcaagttaccactgtagataagtggggcttaaacctcctgggagccagtggggaacacatgacctcagagtaatctcatctaaggggagaaggagctgggttttttaaacacctagtcccataagtacttggtttaaggctcttccaggaagtcttaatt

SEQ ID NO: 37713 - DNA, 1065 bp, Homo sapiens
tgctcccagcctcttttgctctttgcagagctggaagtagagtcctcctgaggacaacagctgtttctatctattgaaaaaagtattagctcatggatgagagcattttggctatcccagcaggtaaggggagagtggagaaaggagtgagacctttgaagccaggcagtgatgacatttctagtttctaaaaggggaccaagatctgtgcgtcccataatgtttggtgacttgagtccctctagtagcagcctccagggatttggtaccctagacacagtggtcccacctcaacaaaaacccaggacacccaatagaaagagcagagagagtcactagaccagaaggtaccatgcataaaggagtgatggatatattagcagaaaccactgaggacccatatcctttgaagcatctcagatacttgatcctgtgcaaaaccctaagactttaaatagccctgatgggaagatgtatcctagaaatgtctgagatttgatttcatactgtcccctcaaaatagaggactgaagatgaacttaagaagacttaaaaaaataaatgttgcatggcatatatattgaatatgtagaccaagacttatggcatccacaatcttctctccctcaggcaataatgacctagaaattttttaaaaataagctctctttcccaatgacacttcctttttacataaaatgttaattaagtgcttgccgttgcttcaagttcttgtaacttctgaacgtatttcattaaacatgattcttagaaatcacatttattcagctaaagaatatgaataaatctgacattcatcctatagaaatttttcactctgatttgatactctgaggaagttacaagagttaggatgcataagatattagattattttaaaaatattatcaccatatgctaaaatactaaatcagactaatgtctaatttcatccatttaaatatatttaatccttaaaatttgatacttagatgtgatgtcattacattttagcctagacatgtgaattttgtacattattcctgtaatagcagtgcagttgga

SEQ ID NO: 37714 - DNA, 1047 bp, Homo sapiens
ctccttgtatcttcttgatgatttggtgtcattaaacccacctgagattcttcctggctacataggactttcacttgcttattttggggtatggctgcagctgataggtaactgtatctttttcctccttcagtatatttactaccatgtaccattcaaacttttccatataccttcccaagacattttcaaatatgtgtttcatttacttggggattattctaaattacgtagagcccaatgagaaggtctgctagagcatgactgagtttgatcctgggtctgaaagcgtcagttagctgaaacctccctggagttccaagacacactatattattgcttatctgcttcttctttaatctttctagaatttgatacttttggattcaataatcttattccaactcaggagagagttgaattggatgaagttagagaaggagtaactgtgagtattagttcttgctataggtaaagcaatagaacagcaaacagcaagatggatagaacttagtcaacttaaaatgtattttttgagatatatgctattgaaatataattcacacaacataaaatttacccttttaaagtatacaacccagtgggttttttgtgtgtttttttttttttaggattttcacaaggttgtgccattcttaccactatgtaattttagaacattttcataatcctagacttatttttgacctgaaaaagtacttttgccttgtaatggcttaagagggagaaagatgatgtggtaggaagaataatggcccctcaaatatgtctacatgctaatttccggaacctgtgaccatgttaaattacatggaaaaggatattatagttgtagatgaaattacagttgctaataatggggagattattctggatatctgggtgggcccaatgtaatcacaagggtccttgaaaatagaagagagagttcaaggagtctgtcagagtcagagaaggagatgtgatgatgaaagcagtggtcaaagtgttgtgatcatttattcaaagatgcagaaaaggctgcaa

SEQ ID NO: 37715 - DNA, 1061 bp, Homo sapiens
taacaaaatgaagtcagaaggccataaaggaggggctctcacacacacattcctatgatgaaaactattagaaagactctctgaaaatcacaaccttgcacaaaggccactgcaactttatacaacgactacttctggaagtgcatctgcccaacaactgtctagtcagccttgaactgatgccacccttgttattgatccctgtagccaaagataattatttcaaaataatgtacctaaccttcctcattttgcctttgaaaaccgttgccgtcctttgcctccttagaggtctgtgctccctccatggttcaccatggcatgtgtattcctggattgcaatttgtcatttattcctgaataagctaattttagagccactctctctgttgttttattaggttgataacatatatatacatgtatatcatgaatgaaaaggatacagatattttacaaaagcaccaaactaaccaaaagaaaactctaaactgtaacacatgatgtgtctaatagaccctttactgaaaaactgtctcccaagaaaatttgaatattaatcaactgaggggaactgtacagcttacaaagtaaggcaaccagtgttggcccaagaaacagtatggggtgagatttgcaagaggtgcccaaggttctgaaaggcatcacagggagaaaggcttgttaattgtcctgatagaaaaggtgggcttacatgagaaaaggaaagaattactgaacaatttgtaggcaaagcaatttttttttttttgagatggagtcttgcattgtcgctcatgctggagcgcggtggcgcattctcagctcactgcaacctctgcctcccgggttcaagcaattctcctgcctcagcctcctgagcagctgggattacaggcacccgccaccatgcctggctaattttttgtatttttagtagagacggggtttcactatgttggccaggctggtctggaatgcctgaccttgtgatccacaggccttggcctcccaaagtgctgggattatgggcgggagctactgtgcccggccgagcaaag

SEQ ID NO: 37716 - DNA, 1035 bp, Homo sapiens
ggccagttgtatttttgggattggatctcagataaagctgggcagattggctgatttagatagaacaaattttgtaaacagttttgttaaatttaggaaatataaaatctaagaaaaacatttattctactaatgtcggttagattcaaaacgttatcaaaaatttaattaggttcctctaggtaaattaaaaaaaaaaatactttgtctctactcaggggaaattctttggttttagaaaaaatatttctttttaaagttcgcagttgcctttgagaaatggttcttgaaaaatttacatttgaaccaccgaagtccaactgtagaacggcaggaagcattctaaatgaatcagcattttgtagggagtacccagtagaattactcctgagacaaataagtgtggatgggttttattaaaacagctttcacttcagcagtgagcaagagattcgaaaatattcatgtcatatgtgtatttacagacactgttttaaataattagtctaaatgctaaagaatatcatatatatactcttcagctttacacaaaaggataggtatatttcttaaatagttgagtaaagtgagaatagatattaatcaagtatcagacaaatatgtagttacaaaactgattgctatcataaagaaaaaaaaaaaaccaggaaattgcacaactaggactctgacctgggagtaatgggacggggagggcaatcagaggtttttttctgttttttcttttttctcccagaaatcatgtatgtgctgggaatggaatggcggaatgactagcagtttaaattagacggaagttggggtttggagggggagaggatcattgaaaaagctctgagggcagagagctcagaaggccagttccatgtgaagacctgcaggagatctggagaggcaggcaaggattagcatggccaatttttatgcattcattggctcccagtttaaatgtcactgcctcagagttgttcttaaacacttaatctaaatcaggcttttcctgtaatgatcatt

SEQ ID NO: 37717 - DNA, 1026 bp, Homo sapiens
caggttttctgtatcttagaaaagttttattctgttagttccttgataattgctccatgtgttcattttgctatttctggagttcctgcctatgtggacatttgaacatgtgtgtgtctataatcttccaagtttcttatattttcatcctttatttctctttataatttcactgcattgaaaagtaactctgctttatcctcttcagaggtccaagctagatagtaaatattataaccttgcaggccaaatacaatctccactgtagctttgactcaactctgctattgtagcatgaaagcagctgcagagcacatgaaattaaatgagtatagctgtgttatggtaaaaatttatttacaaaaacaggtgacaggctagatttagcctgtaaaagtagtagtctgctgaccccagctctagattttttcagtagtagccacataatttcattttttccattatggttatttttcagaggctgttatgacatgtcattgcaacattttttaatctctgaaaaagttgtattattatagtttttcactcttttccctaaaaacacttaactatataaattataagtctataacactagggaacaaagaactctcatttctttatttgaacaactttagttttacttcaagcctttttttgaaagttggtaagaaactgtctgtcttttggggccctgttccacagaatcataaaacttgcaggttaaaatggtatcataaagtcaaaagaggcttttgtctatgtgttttaatttttctatttcctagcacaatgcactggtttcctgctatctttttctcgcatactgctccctctgatgatcttagaggtgcctcatacaaagactccctgcccctaatggcagacttgacacccacaaccatcctttgatctggagtgctgcatgccagcaatgcactggtcttttcctctgttccccatctttttcacagactcagtttgtctatttccaaccaccccattcaacatacttctcttcatact

SEQ ID NO: 37718 - DNA, 1060 bp, Homo sapiens
tgtctatctgatcatactagtttcctataggaatatcagattgaaaagagggaagaagggacaaaggactgcttgtttctgtttctggttttaggagtaacagatccttctatgctattggcttagatggtctgtggccttaattccattgtgcacagattggatgtggctgcatttagagagggacagtcgagtcccttattaggtacacttacgctgtacctatccagagaaaatcaggtgagcaaaacctacatacacttgtgaaaaatgataataggacacaatggacattatggacattggaaagagattgaacttaaaattaccccatttggaatctgggtggttttgccaaaagacagaagcagagtggtttttacttcctttgcagtatttctgaaaagtaaaaacagttttttgcagaaacccagaaacagcagctgaaatgttttacatactccctaaggaagcagcgcccagcagatgaagccctgcgggagagcacagcagcagcggaggctctgggggaaggcgtggtgtctaaggcaaaggactctgccagcttacatatttatttgaaagacacagacataaaaaggatgaatatgtttatataacttaaagcaatggttaagaaataggtaactaggtgaggctctgaagattttgaaagaagtgtgttacttgcttgctgctcctttaagggagaaaaacaaaacaaaaaacattcccataagcctaggaattctttctgggcccccaaggcaggttctcagctgcatttaactgtctaaagctactgaactcatgagttctagtgagttgtaaaagctctaatgaactccatagcttggatttacaaaatagaaaatctgggggttagaatgaagcaccggctttacttttctgcaaagattaccttctaatgagatgaaaatcagctttcttcaataccaagatcaccattctttgagaacttccttataaggtcccagatcaaacacttgatcttactcagggagtaactgttttctttagtaaatgcaaagattttttt

SEQ ID NO: 37719 - DNA, 1057 bp, Homo sapiens
aacacattattaaacatgtatccactcagctgtttaatattctgcaaggttggtgaagaaaaaggaaactaagtatgacactaagtttaaacctaaaacaatttaaaaaactgaaacaggctgggcatggtggctcatacctgtaatcccagcaatttggtaggctgaggcgggaggatcgcttgaggccaggagttgaagaccagcctcggcaacataatgagacctcatttctgcaaaaagtttaaaaataactgggtgtggtggtgcagaccgtagtcccagctacttggggctgaggcaagaggaccacttgagcccaggagttcgaagctgcagtgagctatgatcgtgccattgcactatagcctggcaacagagcaggaccctgtgtctaaaaaataaaaataatctaaaacagtgactctcaactcaagacaagacttcttaggtgggatatgcagaatatatggggtaagtatatatagtttgataaagcaaaaatgtagttctttcccttgagtcctggactcccacccctacccttacttcaagatggtatttgggattcagatcaggtcaagaaatattcatattaatcaaaggaaggagcgttgggttaaaaagaagttgagaaaccctaaagacatgtacttattaatatttgtaatcttcttattttattaaatgattatagctgtgggagagcctgagaaagatatacctttaaactagttttctgagtaacactggactttgactgtctttttcttgaatgtgtagttgtattggtgtggtgtggatagtaggcaaatggttatgtaggggaatgtgtggagaaaattggcaccattatatctacatagatggaaactaaaattgcttctactttgtcttctgttatttttgtggggtttttttttttcatcctttcccctactacccccaccatatgttccctttttttgtagtttgatcagtgctcttttcttgttcaggttacacacttattccatcagctaaatctgacaacttgtctgactccagccatagtgag

SEQ ID NO: 37720 - DNA, 1040 bp, Homo sapiens
agatattatcaagatgttagaatttttaaatagtgaaatattatgtaaacaaggctaattgtgattgaccatgtcagggtttttgcatctctccctccagttggcagtatcatatctgatcacagcagcaagatcagtggccagagctgccccggaataggtggggcttacttgcaaaagaaaatccttcagattaccaggagcacagccaaaagaacagacagtactgagaaggccactgaggagaatagagacaggacaagttgtgagaacacaaccagaaaaagaatgacatccccgtttagaagacttagggaaagaatgctttcaagggagagactagtcaacagccaaaaagaggacacagatcacaatcaagctacagaaagctgtgagaaagtgaaggatgttggaagcaacatcaaagatgagaaagggagtgccatcttcaattcaaatagccaaggcaacagtaacactttaaactgcttctatacgcgattcaagtctaaaaggaggaagacactctgatgaagttccttatttaattttagtgttaagtttgttttcagttattaatgtatacatggcttaaattaaaccatttgtcaaagcttaggcagacaacttagtaaaatactatttataaacacttgaaaatgcctcatttgtacataagttattttactgatgtattgagttagtaaattttatactcttgttttctgtagttgactttatttcctactgttagctggatctgtgagtgaaatatgtagaggaggcttttttatcttctactttttacgtatctttgattgggggagaagggactagtctaacatagcaatatcagaatcatctgggaaacttgttaaaaaatgcaattactgtgtcccaccccagacttcataaacttgaattgccagaaatgggatctggaatgtttattttaattggcttgccaggtggttcttagtattattatatttgagaaatactgatcaaatagacataagaatgaaattattttttaaaca

SEQ ID NO: 37721 - DNA, 1048 bp, Homo sapiens
caagattctttttaaatgtctgttttgcctttaaaattgtactgtatttttgtctgcattttagatttgtgcctaaaatttgaaatgattggatcattttttcccttttgattcaactttattcgaacatattgaccattcatctaagcgattaacatttgagtgtctgctgcatgccaaatattgtgcttggcatgtatgtggttttcctactaacaagaaacatgtttgtaaagaatagtatgtaatatatacgtaataattctaaaatagaggtttacactgtcattaatattaacgcagagaaagattttcctctgatggctctccattgcttttccaagttgacatttgttaccttggcagattcatcagagtttggattaagggataccctttagataatcccatttatgaatctgttctaaaggcacccatgtgtgatacctgaatcaatcttatgtgatcatataacaatttgtccttcacatggacaaatcactttaacaacgtatgactttgtaacactatgcagcaagatatacaattgtgtgctccttcccagaagatgttacagtatattggcagcaagggaagagaacatgaaatgtgtacaaattcccaccctgtctttgtgaataaatttctctgaagaaagtaataaaaggtatcagaacatctccccattccctcaaggtcagtcagtaccactggctaaggctcagcccccaaagatctagtaaaatgattcaattctggagcccaggacagctaggacctacttttatgaagagggtagcaacagtacaggtaataacagtatattgttggttccttttttatggacttaaaaagatagtggaaacccatttgttcagtatatttctcttggcaaattgaaatttccatttgtttgcaataatcttctagcacagggtagagaggtatattagtccgttttcatgctgctgataaagacatacccaagactggacaatttacaaaggaaagaggtttaatgcactcgcagttccacgtggctggggaa

SEQ ID NO: 37722 - DNA, 1065 bp, Homo sapiens
ttttgatacggagtcttgctctgtcacccaggctgctctctgcaacctctgcctcctgggttcaagcgattctcctgcctcagcctccagagtaggtgggattacaggcacgagccacccgacttctggctaattttagtatttttagtagagacggggtttcgccatgttggccaggctggtcttaaactcctgactcaggtgattcacccacctctgccacccaaagtgctgggattgcaggggtgagccaatgtgccccgccctattctcattttaatttttgtaaaagtaagtccattcttaagaattaaagtcctgttttcctttacaccacaacattcgcctatattacctgatttttcagtattcctgggggagatagtgttgctcacatttacagatgagaaaaccaaagtttataaagagaacgaaatttgcctgaagtcaagcagctagtagctcaggtctgtctgacatcaaagcttgcccttgaaacactaatctttgctttcttccatgtctctttgcttttctctgactcttcagctctgtcatatcctggccttctctttcatgtctgactattaacagtcctttagcagtttatttaacagtctaactctccatcttgcatagttttctaatctacgtaaaatcctatattttacatctagtgtaatttaaatgtatttcatattattcatttataatactatactttaatctttttcatgataataggtaagtattctgtgatacttctgttggtatgtatagcaagtactaggcagaatgctgcatttgataaaatatagacaagaattaatagtaacagagcattggttttaatgtaagtacaacccttagaagtagtttttggttattgatgttgatggaaatttttttcactgctatcttatgtttttataggactgttttgcttaaaagtaagctaaaatttgggggtatctaaaacctaagtgacagtgtttgtttctttgtttttattttttctctaggtggatttagaagttgcctatgtcacatttctaaaatatttta

SEQ ID NO: 37723 - DNA, 1622 bp, Homo sapiens
aataacataaaatagaacctaagtatctgtttctataaaattagttgattagcagttatgttacttattacctaaataggaacctctgttttttttcaaacttgcctgcagcctgcccacttcctttccctttccccccactgactttccttttattagtgttgggcaacatcagaagtataatcaggtataaaaactaaagaaagaagaagatatagctgctaaaggacgggtaaatacttgacagtgtttagttgaatgagactgagaaagttcaaataatggaaagtcactgtgtttatccttaaaatttgttgttggtataaaaattttctgaagagaagaaataaaatgacgcatttgttttatttccacagtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttaggtaggtaatgccgatcttagctatgcaggaattttcatcttcactgtaaagtttttatttggggtggggggaggcttgggtaagttttgctttgttatataactaatgtatcataaagtcttcaaacagtactcaaataagaatacatttgaacttctccctatcactttcatgaagttactactttcagattatataatagcattattttgaattttgggaaagactgtccattttattttatgaaatccatttttaaatatttttggtccacttttagtctcctgatctctacaaattgtacaccttaaatcttgggacttattcaccagttttttttttttaatcatttttcctttgcagcaccatttattccttcttgaattctaaagttgaactttttaatcagacctatttctatttccaaaatgggatatcaccaaaacttagtaatacttgaagattttaaatgtaaattaaggtctgtaaaatactgatggaattagtccactaaagtgtcatgattggcgatgactctagtatatattacattagcagcttcctgaagcaattacaaaagttctaatcaagagcagtacaatacttagcacatagtaggcactcagtttatatttattgaataagttaagacagtgaataatcagtgaatgaaataaagcaagttcaaaaaatacattaaaagaaaatacttacttgcctcctgaaagttcctggtaattgtgccagattatagttataggaacaaaaagggatggtccttacctctgagaaattcacatcaggaacccttactctgtacacatttattatatactaagccagagacaggaagataaatagatcaaggttcttatcctccaagagttgataatctaagcaaattgcaaagttctcatgttacaggttgataagtggaggcaggaacaaacttgttaggtttgaatagattgtgtttctgtatatgtaactagagccagagcaag

SEQ ID NO: 37724 - DNA, 1050 bp, Homo sapiens
gtacttcaaagggtggtttcccaaatctgcctgatcatcagaatcatttaggaaacttgctttctccccatttaaaattttgttctttcattttagaatgtggctttattttaacggagccatgttatcattttttaaaaattatgagctcattcatattatgaaaggttctacactctagaacagtggttctcaactagtggcaatgtctgcagatattttttattattatgacttggggattattactggcatgttggtggacagaggccgaggatgctgctaaacagcctacaattcccaggacagcttccacaatagagttttctgggcctgaccccagactactcattaggaatgtctaatagctagaatcctgtaatcagtatatttattgttcagttatttgtatcacagacacatttaataatctaattcacacacacacacacacgtgaaatcattcttgagaatgaaatttatcatgcttttacttcttccttcaatcttcccaactactgttgaaatgatctgagattttagatctacattattgttactttttaacattatgtatcttctgtttcaagaaggcttttgatgtttgagttaagtttcataagcttttaaacaagcatttagacatttacacctgcttaactgatttcattgatcacttttatttcatttgcactgtatatccccattatttcaactcatttcacagttgtctttggtacttcttttagtacttttttaaggaacagatgggtgatacagtattatatgttcttgccttcctgaagatacttgtgttcaatagagcgtaacatttttttcccacagtgacttttccctcagaatactaaagtcacagaaagttatcacatcaacttaatgttgcccaagagaagtccaaactctttgcgcttcttttgtaggtacctttgggttatcttcccacaatgatgtttatagattctttattctttcttcttggaacaaagaaatttcattgggatatgtttttaaaaatagatctctttttat

SEQ ID NO: 37725 - DNA, 1051 bp, Homo sapiens
ttttaaaaagggggaaaaaagaaaaagtaacaaacattgccaacggtatggagacattgaaccctcctccccacccccaccctacacacattgatggtgggaatgtaaaatggtattacctctgtggaaaaaacagtttgagcagttcttcaaaaagttaaacatagggttaccatatagcccagcaattctaatcctaggtaaatacccagagaattaaaaacaggtgtgcaaacgaaaacttgacgtaaatattcgtagcagcactattgacaatagccaaaaggaagaaatgacccaaatgcccatcatggataaacaaaatgtggtatagccgtacaataaaatattattcagccataagaagaaaagaagtactaatacttactacaccatgatgaaccttgaaaacattaagctaagtaaaagaagccaatcacaaaaggctaggtattgtatgattctatttatgtggaatagccagaacagacaaatagacagaaaagcagactagtggccgccaggggctggagagagggcagaatgggaagtgaaagcttaatgagtttgaggtttacttttggagtgatgaaaatgttccagaactcagaactagacagtggtgatggttacacagtattgttaaggtactaaattatgaactttaaaatcattaaaatgatgaattttatgtggattctaccacgatttaaaaaaaatgactcatttcttacattgttaggcatgttattcaaatcagcttacattcgttaatttttaacttttctgaagcaaagtaaacgattctgcagtttgaaaatttacagtgtttataatgaaagaagtttcagatttgtaagggtttttgttttgttttttaatttttatagagacagggttttgctatgcccaggctggtctcaaactcctggactcaagggatcctccttgcttcagccacctgagttgctggcattgcaggtgtgagccactgcaccagactcagatttgtttttgttaccgttttggttaaacatgttcttgaccatgg

SEQ ID NO: 37726 - DNA, 1080 bp, Homo sapiens
tgcttcacttatgtagtaagtttttattgtatgctgaacattgtggatattacgttgaaaaaaattcttacctaattattatagaattaaactttctgcccaggaactgcatcttcagaagtatcatgcagtgacttcttgtcctgtggtcataatcatatctacctttctcttaaggacctgactttcctttgtttaatcaaggagttggtctttacatttttaaaaattcattttaagtttaaaaaaatccctttaaatttcttagcatgtttttgaacagtcttattttttattcttaattcctgttttatcaccttatgctcatgtatactcttaatattttaatagtttaatgtattttcttaactaattttattctttttatactactatgtaaaaagtagaggtataagaaaggtagttgtggtttttggggggttttggttttggtttttgagacacgttctcacactgtcacccaggctggagtgcagcagcaagatctcggctcactgcagcctctgcctccaaggcttaagcaatcctcccacctcagcctcctgagtagctgggagtgcaggcatgtgccaccacacccggctaatgccaccacacccggctaatttttgtatttttttgtagagacagggtttctccgtgttgcccaggctggcctcaaactcctaggctcaagcgatctgcatgcctcagcctcccaaagtgctgagattacaggcaggagccattgtgcctggcttagaaagacaaattgtaagggtagattatattctttcctttgcagttggtattaaaaggttcctaaaaaagttcttttagtagccttctctcagtcccaacccatgacttccattcttcctaaagagctatctccttaattgtctttgcttctcatgcagatgataattagccttctctactgtccatataactaaattccatcttgcctttttatgttgtgagccatctatctttttatccaacataatctaaaatatgggaatgagaccagattgaaataatctgggtcaggggatgaaaaccttagattaagatgaa

SEQ ID NO: 37727 - DNA, 1092 bp, Homo sapiens
atatccacatctctaagccaggatagtgcacagattaagattcaaggtcacttggaaagaccaatgctttattgtgaactagaagatggactgtacacagttggtccctacatctttgcaaagatactacaggagctcctataggagcattgcacttatattagcacctgcagattactccccttttagctggacaacctgaggatgagactggagtacacctgctggtgttggttggaggtgttctattgcaggaccatggcatagcctatatcaatatgtagaatatttccatcacctcagaaagtatccatatgaccctttgcagtcaagtaccttctcctgacccctatcctatgccctggcaaccaccaatctcttttctgaccttatagttttgccttttccagaaggtcatataaatggaatcatatagtttaaaaaaatatgatgcaatgaaacttataaattaaccaataaaagtgggaatgaatttagagagcatgaaaagataaaaggaataaagataaaataaataagataaaactctagaaccaaaataggaatgaagaaatttaaagaagaaacttataataatgttaacatcaaatatataaaacctaagataaaattttttaagagtagtcaaagaagataaaaattttcaaactctgctgctgggcacagtggctcaagcctgcagtcccagcactttgggaggcagaggtgggcggatcacctgaggtcgggagttcaagaccagcctgatcaacatggagaaaccctctctctactaaaaataaaaaattagctggggtgatggagcatgcctgtaatcccagctactcaggaggctgaggcaggagaatcacttgaacccaggaggcggaggttgcggtgacccaagatcacgccattgcactccagcctgggcaacaagagtgaaactccgtctccaaaaaaaaaaaaaatttcaaactctgacataacagttaactttaggaccatagccaaaagatagaaacagcataaacgccaaaataaaaagaagccaataaagataaacacaaaaggaaaaaaatcaaaatcata

SEQ ID NO: 37728 - DNA, 1050 bp, Homo sapiens
ctgaggccgcatgtatatgtctgtatattctgagccagaattgtaaacatcttcatttactgtgatttgcttgttaaagtgaacgttttaatttagaacaatactgaaagctcctgatttcagttttaaaaggggtttggagaggctgcctttatataaacactgcagtggtgtatgatttgtaaaaagaaacttaacagaattttatcaccgtactcatcactgtagctctggtttgaaaaggaaactaccctttccagcctaggaaatggcttttcttgttcgctgttatgccaattgtcttcagccatgggcctccaaagtaagtaattgttattttcttagcaattgatttaatccagttattaaattttattttgaactgtaaatgagctttattgcgctcttttctaaactttaaaaataagaactacaaagtagtctttctcattgccatttttttttaatttaaatatctaaaacattctaacgtgacctctaagagatttgaaaggtgcgttttaaatctgtagacttaaaatgcagtgcatttgagatgtactctcttcagactgaattattttttgattatggctattgctgtacttatcagtgatcatactctaacttgcttcattttcttaaatggttgatatatttaggtatgttagtctaattgccagattatatgacatttttcattaatatgatgctgtcataaattatgattgaattgtgctattttacaattgaattgtgctattttacaaagattagttgataattcttgagcagtgaaataatatgaagaaaatactcatgaaaatcaattatatgaaaatatttaaataatgattctaagtattttcaagatagtaaaccattagcagctggagactatttaaggtcatctatcatacttgtcatttttaaataaacataataactcacaaaaaagcaaagtgctatacaaccttccaggctaggttgtaggaaaatatatactctaattcagtgagttttattatacacagtggctatttatatagt

SEQ ID NO: 37729 - DNA, 1049 bp, Homo sapiens
ctaactacttaatatatatgcatgctggcctattttaaactcctaacaaatgttaattttccattttattttcttacttagaagatgccagccttacttgtggctgttgtcatgcattaagttgaaaattaaagaatattgcataaagttttcttgttttactttttaacaattaactaaaaccataaccaggattgtttgctaagtaaaatatgtgtataatcaggcagtttgtaattagaggaactcaagttgtaattattgaatgtgtaggtgtagttaacagccttcatttctggtaagtgactttacttagaggatgtatgtttatgtgcacaagagagactgtttcctggacggaaactgtggtctccagatctttataataacatcacctctaatctttaactcatgagcgttgtgctatacagactgttttcttgaggcagtttcttgtaagaagtaaatgaagcttccttatgagtctgttaagactccatagattgtcaataatatggaaaaatttgatatttcatcaggaatatgaacatgtgtttcaggtagagaatgccaaagataatgaagatagtattctacaaagagaaattcctgccagacaatcccgaagaagatttcggaaaattaactataaaggagagcgccaaaccattactgatgatgtggaggttaacagctatctttctgtgagtatatttaggaacacttcatgaatcttccttaattttcatatctagtatctttaatttacatgtatctttggtaatatcaacatgctgggctctgtatgtgaaaatttggggcaggtaaatatataatctttttaaatgcttctgtttggttgaattggttaggaatgctcttaccagtgggagttctggttttgcttttttgttgttgtttaaatagtgaaaaaagttattaggctgggtgcagtgggtcatgcctgtaatatcagcactttgggagacctaggcgggcggatcacaaggtcaggagttcaagaccagcctggccaatatggtgaaacc

SEQ ID NO: 37730 - DNA, 1570 bp, Homo sapiens
ggttatgactgatcacatgtatgacaatggttccataaaattataatactgtatttttactgtaccttttctgtgtttcgatacacagatacttaacattgtgttataattgcctatggtgttcagtacagtaacatgctttacaggttggtagcttacgaccaataggccatactatatagcctagataagtagtaggctatactgtctatgtgtaagtgcactctatgatgttcacacaatgacgaaattgcctaacaactagtttctcagaacgtatccttatcgttaagtgcacatggctgtatatgtgtgtatatagacgcacgttatatgtaactaattataattaatttaacataacacatatacataaatctatacatatataaatattagtatccaagatgatgtaaccaggatgttagtggtaatgttgattttgttaatttaaagcaattatatatgtataggtaatatttatgtgtatattatgaaaaattctgtatgatacatttaattggaaataattgaaatttataattatagttaatataactaatagatgcataaataaatgtcattagtaatcaagatttttattttagcataagagttgtgtaaaattaaagatgttaagaaaaactccagtctaaaatgtcagtaggaaatgtcagcattgacacgactatttttttcttaaaagtatttaccaaattatttcaccttaagaaaaaaaatgtgtttcctagggttgttcattgcaaaagtttagaagcagcgatatccaagtagttaaagcattcctagtggttatagagctcagattttgatgataatgagtaggtaccatttcccctctaaaaggataacaaaccttcgttaagttaatgatttatagcagatgtggataccaagaaatttattagattgggatttccttcactaggaagcagagaaatatttaaaattattgggcttctctcaaaaatatcaggattctgtgaaccttaatacttggggtctgtttcttctttttctatatttgacatgagattcttttttacctggaaagacttttctatttgtattcattgtgattgctgataggtttgaatttactttcaccacattatgtgctttttatttgttcttgttttttcccctcttttttttattttccctcctttattttaagttcttttttccttcctctcctccccaccatattcttgtagaaatggtgtttggtctcttcttttagtgctaattctgactatttttaaattcctacttaggccaggcacagtggctccctcctgtaatcccagcacttcgggaggccaaggcgggtggatcacctgagatcaggagtgcgagaccagcctggccaacatggtgaaaccccgtctctactgaaaatacaaaaattagccaggtgtggtaggcgcctctaatcccagctacttgggaggctgaggctggagaatcacttgaacccgggaggtggaggttgcagcgagccaagattgtgccactgcactccagcctgggcaacagggtgagatta

SEQ ID NO: 37731 - DNA, 1045 bp, Homo sapiens
agggcttttttttattcttcattaaaaaaaattcaggttatcttttaaaatggaaacctatctttttctctgtggttgctttctttttgatatgctgagaaatctttctgagaccaagaatataaaaatactgtcttttagtactggtccagctttagttttttccaaagagctgtgactccaacactttcttttaagaagtcatctttatatctaactacatttctttatatatagttggcacttcatatccgtgggtttcacatccattaattcaagcaactgctgatcctggaaaaaaaaatggatggttgcatctctactaagcatatatagacttgttttacttgtcattattccctaagcaataaagcataacaactatttatgtagcatttcccgtgtattaggtattattaaaaatctcaagttgatttaaagcatatggaaggatgcacataggttatatgcaaatgctacatcattttatgttaggcgcttgagcactggtagatttttgtatccttggggattctggaaccaatcccagttggataccaagagactactcaagtgtgaatattttttaagtttttttatttttagtatctgttgtcttaacactgctcccaaaagattataataatttacttttattaaattgcctaatcaggttatcacttttattagatttttactaagtgtatttttttctttgtgcaacgtatattgacagatgttagaaatttgagattagacagttatcttttataattaattttagggactagttaaaggcagaagtttaaaaagaattttcatatagtattgagatcagttatatctggacaattaagagaaaggtttttttttttctttcttttttagaaaatcttaacataaatattgtgacaggatcagaatttcttggataatatctcagggcttttttgttgtttgtttgttttcttttcctatattgatatattttattaataacctttgctaaagaaattgtttttctgtttttatagttttggtaagc

SEQ ID NO: 37732 - DNA, 1080 bp, Homo sapiens
tgttctctctatcctgttttattgatctataagttgatcaaataccacattgtcttgagtattctagctttaatagtgtgccagaatctgatattataaatatttcaactttgttcttattttccaaagttgttttagctattttaggctctttacaattccatgtaaattttagggtcattatgtcagtcctccaaggtgactttctgggatttttattgtgattgtattgaatctgtagaacacttcggagagaattgccattttaatccataaacaagatatatctctttttaatcaggtcttcaatttttctcagcaatgtttcatagtttttaaatttgtaactttgtagaagtcttgtgtgtattttgataaatgtatcatttttattctatttttaatggagtcaaaagattttattttctgattgttgctaatatacaataaaacaattgatttttgggtattgcgcttttattattcaatcttgctaaattaatatatttctgaagcttttttgtaggattcactttatatacagtgaattcactttatataaacagtagttctaggaactcaaatagttgagagtttatattagtgcccccagctaataaattcagaaaggatgatcaaaatataaaatacgtattttaatagccctaataatgctttcagtctacgtactgataaaaaaaatgctaaaactaatagatggaaaattgagaggaaactttataaatggtgggtcaagttgacactgtctgaagctactcaccaattttaacattactgataaatggaacaaacagaccttatgtgtctgcatatgtgatttgatagaacattgcattaggtcttttttatatctctctgttgtgttcgtatttatcgttactttctttaacatacaaaacacacatagcaatagctattataatattgttgtctgttgatttctatacttctgatagttctgggtctgtttttattggttgtttttttctcttggttatggattatattttcctgtttctttgcatgcctggtttgttgttgcttgtttctttattgatg

SEQ ID NO: 37733 - DNA, 1029 bp, Homo sapiens
ctcacccatgttttagcacatatcaattctagcatgtccattttttaaattgttgatactgcattttgtctatccattcagaagattttaaaaattgaaaattttagttttaatttggggctgtcacaaaaatgcttctatcaaaatttacataaaagtctttatatggccatgtgttttcacttctttattatagatatgcaggagtagaattgctgtgttatgtaagtacatgtttaacttcttgggaaaagaccaaattgtttataaaatgactgtaccattttacattctgaccaccacttggtattgacagtcttttatattatttgccattctggtgtatatttaacagtgtcttactgtgatgttaatttgtagttcagtagtgatgagtgatgtagggggtctttttatgtgcttactagacattcctgtatcttctttggtgaaatgtctattcagacattttctccatttttaaattgtactgtcttatcaaattgtaagaatgtatctattttggatccaagttctatgtcatatatgtagttttcatataatttctctcagtctctggcttttttttttttttttttttttttttttgagacagagtcttgctctgctccgcaggttggagtacagtggtgtgatctcagctcactgcaacctctgcctcccggggtcaagcaattctcctgcctcagcctcccaagtagctgggattgcaaatgcccactactacgcctggctaatttttctatttttagtagagatgggggttgcaccacgttggccaggctggcctcaaactcctgacctcaagtgatctgcccacctcagcctcccaaagtgctgggattacaggcgtgtgccaccgtgcccagccagtctgtgacttcttaatagtgtcttttgaagcataaaactttaatattgatgatatctactttaaggtttatttttgagaatagagcttttggtgtcatagctaagaaatcttcaacctcacgattatttcatctt

SEQ ID NO: 37734 - DNA, 1038 bp, Homo sapiens
tgagcagaggggtgactttgaatagaatgggaggcagctttgccctaagcagtttccagcttgacttttccctttagcttagtgatttgggaggctcaagatactttgctttcacaaggccatggagatatatatgtatgtatgtatgtatgtatgtatgtatgtatgtatgtatgtatagttttttttttttcttattttctagaacttttcttgttttcctttcacagttaaatctgtagtctacctggaattgagttttgggtatggtataatgttgcgtcgttttccatagggatacctagatgtccttttctcactcatttagtgccaccttttatgtaaatcaaatatccacatatgtgtgtgccagttttaattttcatgtttttgatgaataatgatgttgaacacttttccttatgcccttatgcttattggccattgctttctgttttttctttaataaagtatcccttaaattttgtgtgcctgttgttaaactcctgttattactgtaactgtccagtggattcttcctgcccacctgtacagacaaaaccaattcactgagaccatggcattgtaataaagagtttaattgacacaaggctggccacgccctgtgggagatggagttattactcaaattcatctctcccaaaatttggaggttaggattttttaaggatagtttggtgggccagggaatctggattctgggtgaagccacaggactggttagcaggaggtctgtgggtcctggtggccactgatgaatcatcagaaatgctaaaaacctgaaaagacatctcaataggccaatctcaaattctacaatagcactgttacttgcaggagtaattgagggagttgcaaatcttgtgacttttggaataatgactggtaatcatttatgtctacagcttagcagaattcagctcctcatccttgtaatctggtggtctttctttcattagctttacaaaagcagtttagttatcatttaaactataaatgtttcctaaagttagggtg

SEQ ID NO: 37735 - DNA, 1023 bp, Homo sapiens
ccagtaactgttcttcacactgaggattcagtagtgaatcagacaaatgtatattttttgtaatgaaaacattatttggtgtgaactgacagattttgacagattttgtaatgtacataaagagtattaaggttgatgccactgaatattacctatattattgcattatgtatatatataaaatacacatatatttctaaactctctgtagtttagtgacaacatactggtagatttggtcattttctaacaatcaattagattataataattagttgaggtcaaattataacaattttaaaaacaaaatgtaagataaaatcttcaatttttttttttaatagattaatgtctgcaagagcacgctatgagagatacagtggcaatcaggttctcttttggtaagtatttccataattcacataaactaatgacttttatgtttaaattttaactcttagcattgaaattcatttgattctgggacaatttatgtagagcacactgaaaaatattcatagaccatgaagtatataacatacatagaatccaccaaaagtgtacaaagcaatgaattttaataaatatatactaaatgtgtaatgactactcagatgaaaatagagataccagttttccagaaggctctaatcaactttgaaaggtaatgacaattctgacttgtatcactgtaggttagttttgccacttattgaacttggtatagagagaatcttttggtgatgcttttttacttaataaatatccaaatttttctgtttttgtatgtgttctttttcactgctgtacaatatataattgtgtgcaaataatgatttgtttgtcccttccactgttaatagttgggttatttctagttttctttttgtttgtttgtttgtttgtttttgagatggagtttcgcacttgtcgcccaggctggagtgcaatggcataatcttggctcactgcaacttccgcctcccaggttcaagtgattctggtgcctcaacctcccaagta

SEQ ID NO: 37736 - DNA, 1059 bp, Homo sapiens
ggcagttctggtaacataaactttataaacatttataggaataagaaaaaaatgagaaacctatgaaggagacttagatggagcagatggacccaaaataacaaaaagtaaaaactgaaaaaaagcagccgccgcagaaagctaataatggaaataaaatactgaagacttgcatactgtatggtggttattggatgcctgttgctgttatgaaaactttatatacatttaatccttcaagaaaccctgtgaaagaaggtattattatccacattttacatacggggaaattgaatcacagagagattaattagtctaatgtcacacagctagacccagtgtagtcaggattcaaacctaggcagtctgatttcatagtctgtgcttataatcgttgcttaatgtttctcattaagacgagaatccagaaagaaccatattacagaagggataggagagagaatgacatgtcagcagtcaaatgctgtagagaattcgaagagagataaggattgaaaagtacatgtggaatttagaattaacaagtattaggtgacttcataatgcatggtaggatcagaaaagtgaagtgaaaggctacactttgaacttataaacaattggatgctcaatcttttgatacgttgtaatttcagtggttaattattgaagtcctaaagtttaagcatatcattgagactttcattcttaaaaattaaaattttagggtgtaattttttaaaattatactttaagttctcagatacatgtgcagaacgtgcaggtttgttacataggtatacacatgccatggtggtttgccgtacccatcaacctgtcatctacattaggtattatttatcctaatgctatgcccccccgccctccagccccgccgcaacaggccctggtgtgtgatgttcccctccatgtgtccatgtatcctcattgttcagctgccgcttaagagtgagaacatgcagtgtttggttttctgttcctgtgttagtttgctgagaatgattagtaaatgcgtgagccaccatacctggccatctc

SEQ ID NO: 37737 - DNA, 1033 bp, Homo sapiens
tgatgaataaatattttacaagccaaaatttggaaatacattttgtaaagtcatcatatgttaaaaaggtagcacttcgtattcattggaactgctaactttttgtttcttggacagtcttactcagcagcttggtttcagttagttgttataggctaatgcctcctaggattatgttttccaacttatcccctaaattttatgtgcttcagcttcatatatcaaccatcttgtcctccaggttcttcaaccacttgtcctaaattgagccatcattattcctcttccttcataatctgttggcagctggccgagttgctgtctctaggaatttgtattatttctcttcattcctcatagatgcaacttgccactaaactttgtcccctgaatctttttatttgcccttttcttacaagttttactactctaattcagtctgttttattgtttctacccccaaattattgcttgagtcattgagtcttgctgctagagtgatcttcctctcagatctgattatgttctactcttgctcagaattttatttcctatatttcctaggtatagattaacaatatgttgttcaaatcatttttgtgaattaaaagagaagctgttaatatttatttcagagtaacaggttaaagagggactgtcccgcttaaactgagatatggttacctcacccagatgataacattaatttgtacattcatttaagaaataatatatctgatatattaaaaaccaaggttgtagagaggagttagacatggtccctattcatcaatgacttgggagacataagaaaacataaatgtaataaatgttttagttattagtgacaaaggtatgagtagggctttgggattgcaagatggggaagggaacaagcttcatgggggagcattgaattcccagtgttaaatgtcatgaattgatttctggatgatcaagagaggtcattccaagcagagaggcaggagcaaaagtactgatgatggcaagccatgtatacttgtagaataag

SEQ ID NO: 37738 - DNA, 1018 bp, Homo sapiens
agaatagactgtaggtgtttaagggcaaaagcaggaggttaacggctgttattgcataaaatcaggttagagatgatggtcactctgactaaagtgatagtgatagtaatggaagtggtgagaagtggttaagttttagaaatattttgtagggttagccaacaggatttgctaatagatcagatgtggaccttgaggaaaagagaagaatcaagcatgacttcaaggtttttggcctaaataactggagtgttggagttattgtcagagaggtttgagctgccatcagcgagatgggaaaagctgcaggaggagtaggttttaggggcaagatcagaaattcagttttgaacatgtcaagtttgaaatgtctgttagaaatgagtaagaggttgcatatacaaatttgtattactaagaagcctgagctggagataacaattttatagtcatcagtttatagatattgaaagtcatgagactgggtaaaattaccaagtagtgagtgtacgtagagaatagaagaggaccaaggacagtgagtaccatgggacatgagatcagtataaggtcggggagaagagtagaaatcagcaaaggagaatgagtggaagcaaacagtgcagtaggagaaaaaccgagagagtggtggtgccctagaagccaaattaataagctgtaaaatagaaggggataaaattatttgtttggcttatttttccttgaatacctactgggtgcaaagcgttgtgaaaaatatacaaagggatgagaattagtatgttgaaatcatttgtttgcatcgtgtaattgatgagtaaataatgagtaaagaactccttgtgtttctgggacaaaatgaatggttcctttattttgaaccatctgtcgtccttaggtgaaactatcaactcaggcataatcctagtgagccagacatcaagtacagacacatgttgtaaagtgtgccatttagatatctttctaacacagtgtgtgtgtgagagatttctcctac

SEQ ID NO: 37739 - DNA, 1033 bp, Homo sapiens
caccgcaccatagtcacaaaggaaaattacttttgtgtgtttcattgaaccataggcaaaaacctctcaactttgtaagatgtcacccaataggctgtgtgggggagcgagggagaggggcgagagaccatcaaattaacattctttatctcagcttggtgaagcacacataacaaaacagacactagtcactttgctcagcacctaatactgacttatcaaggctcaatctttttctagtgtgcccctgtcatctttgatcccctcaaggtagggagggatgacctctgactgggaattcactgggtgatgtctggacaacatgaagagcagacagtcaccccaggtcaaacctgttgaacttcctttactgctcagcaaatgtgaccaaataaggttctccgagttaggtctgctggacttccatcaccaattcctttagagatcccctctagatgtacaaacacacacacacacacacacacacacacacacaaaacaaagacaagacggacagaaggtctcccaaagcaagatccctgagcaagaattctaagagtatgcttctattctctgagaaacctccctgaaatcttcctgattgaggagaagtctccccaaccaagactcttcctactgattagggagagccaattgaaaccgccaaaggggccaaacttagatcccttaagaagccaaaccagtcaggagaaggaaggaggcattggcaccacctagaatacccaccagaccagtttagagatgtctttacaggaacaatttctctactgcaattgaatccatgcaccatgggtcagcagtgtgttgctggtagagatagtgccagcgtcagcccccagtccaagagaactacgcagccacttgggctggcctctggatctattgccggtgggggactaccacaccgtgggcaggtagccacaagggtgatcccagatgagcccccaaatttgtaactgcccaggggttcttcctgcccactgcataaagactatggtattgtagtagagaa

SEQ ID NO: 37740 - DNA, 1008 bp, Homo sapiens
tcagctattgtttggttgaattttctatttctcccttcaattgtacatatcactttaatactttgctttaataacaaaatctggccacctctcaatttaaaaagttaataaagaaatagagaggcccggaatggtggctcacgcctataatcccagcactttgggaggccgaggtgggtggattacttgaggtcagtagtttgtgaccaccctggccaacatggtgaaaccctgcctctacaaaaatacaaagattagctgggtgtggtggcatgtgcctgtaatcccagctgcttgggaggctgaggcaggagaatcacttgaatccaggaggtagaggttgcagtgagccgagatcacgccactgcactccagcctgggcaacagagcaagacaaccatttcaaaacaaacaaacaaacaaacaaacaaacaaaaaaacagaagtgaagaaagccaagtgggaaattatggatgagaaaatgtggcttagtgagcaacagtcaattgttagccaataaggtttaaaccttctgtgtctgtagaaagttacctaagttgtaaagtttggtgttttattgtatagtagagaaattatggcaaatatagataaaaacaatttgtgagaaaaacttatcagaacttgtgatcttcatatttaaaggctagtttgcccagcttttgaataccaatcaaataaatatttattgacctactgtgttctgaatatagtgccagtactccaagggatatatgtatgaaaaagaaaaagtttctgacttcaagtttttaacttagcaacagagaaaataaggccaagtgtatgaataaatgtagtataaaacataacaaaagtagtgcctgaggaagatacttgaatgtattattgcttcaaaggacagattttttattagttggtggtatggatgcccttcagggtaaaggaaccgtttctagttttttcaatgcttccctcccaatacctgatgaagtgcctattatttgttga

SEQ ID NO: 37741 - DNA, 1038 bp, Homo sapiens
caacattgccaacttcgggaggtccttgctgggtggctactgctcatcttatgtgcctgactttgttcttcaaggaattgggagtgatgagaggttccgtcagtgtctgatgtcagatttatctcatgctgtgcaggtgagtgaccttcactgtttttgagtttatttagaagaaactctgttaagcagcagaacccaaaattgccttatatttttggtcatactttttacaacacaatcattgttctctgaatccatcattttatattcagtgcccgtatctttgtatctgtcactgtgaaagcaaataaagttccagaaatctatccacatggatatctgaaatacagaaagtactttatgtattcatggatgtccatcaactaggttatttatagtatcaaaaatttgcaagtgcttaagtttgaatggaattattttcttaatttccttttcagattactcattgcttacatatagaagtggggttggcttttgtgtattgatcttatatcctttggtctttctgaaactcttattagtctattcatttttctgtataggttccctaaggttttctacacacaggctcatgttatcagtgaacagatagttttaaatctttcttaacaatctggatgccttttgtccccgctgcccccaacttttttttttttttttgactcattgtactggctagaattttcaatacaatgttgcatggaagtggtgaccatggacatcgttgccttattcctgatcttaggggaaagacattgcatctttcatgattaagtatgttgttagttgtaaggtttttgtgatgccctttattagatggaagaagttccctttttatttttattttgtttaaccgaatacttcttttagagacaggcagttctcttttattcctagttttgagacggtttggttttttttgtccatcccttaatcatgaatgagtgtgggattttgtcatatgctttttctcaatgtctattgagattgtattgtcgtgtcatttttcatctttaa

SEQ ID NO: 37742 - DNA, 1045 bp, Homo sapiens
gaggtagcaggatcacctgagcctaggaggctgaggctgcagtgaaccatgattgtaccactgcactccagccaggattacagtgtgagaccctgtctcaaaaaaaaaaaaaacaaaaaaacgagtaaaacctaaactattactcatacagtaaaagaagtaggtttctgatcattaaaaatagcttacttagctgtgtcagtaaaggacatgtccaataactgattttttccattacaggagacttgtatggcgctattggctctcccgtacggttagcaaggactgtggtagttggcaaacgacaagacatggtccagaggctactttattttcttacttattttataagatgctctgaacttcaagaaacgcatcttttagaaaatggagaagatgaagccatcgttatgccaggcacagtaattactaccactttagagaaaggtgaaatagaagaatcagagtatgtccttgtcacaatgcatagaaacaaaagcagtttgctctttaaagagtcagaagaaattagaactcccaattgtaactgtaaatattgcagtcatccactccttgggcaaaatgtagagaacatttcacaacaagagagagaagatattcaaaacagctctaaggagctgctaggaatttcagatgagtgccagatgatttctccttctgactgccaagaagaaaatgctgttgatgttaaacagtacagagataaattaagaacttgctttgacgccaagttagagacagttgtttgcacaggatctgttccagtagacaaatgtgcattgtcagagtcaggcttagagtcaacagaggaaacatggcagagtgagaagttgctggattcagacagtcacacaggcaaagcaatgagatccacaggaatggttgtggaaaaaaaacctccagataagattgtgcctgcttcattttcttgtgaggctgcccagacaaaggttactttcctgattggggattctatgtcacctgattcagatactgagcttcgaagtcaggcagtggtggatca

SEQ ID NO: 37743 - DNA, 1044 bp, Homo sapiens
ttaggaattctgtgcataatcaggcttttgactggagaccttcacttcagggcagtgtttttcaacctttttttattatcattacctgaagaagcatatttagatatttttcccctaatctctgctccttcaataccaccgccccccacaatcccatgaagatttaacactacaagatatactctatatctgattatatactctgaaagatacaaatgccaggaagagtttggaaaaggtcattcctcggggccattcaactgctatatctgctctctcctatctgtagtcattttctggggaagtggagaggaggtagggagctgccaaccatttatggactttgaattagtctcccaattttcagtactgtatcgtaactcctgtcatgactttcccaaaaatttgtgagtcttgagcctcatcttgctttagtggggcaaattagctctcctttgtccatgtctccctctgtgatactatgaccttataactttctctactctgctacttcaatcacaattccaccatatgtttgtattccagaatttcatgaaatctctaattttaattttcagtaatagttccttggcaatttttttaaaattaagtaatttattttttaaataatagagacagggtctcactgtgttccccaggctggttttgaactctgggcttaagcagtcctcctgccccagtctcccaaagagctgggattacaggtgtgagccaccacacccagctggttcttctctaattctatttgttgcactagtttatctgttttcaaatctttaggtggtgttcatttggggcctcagaaactgaagagaggataaacatttgtcttcaattttccatcgtatctggacacctgtaataagctttaaaaacaaacattttcatatatgcctagtttgtattctagtcatatttgctctataaaataactttttgtttattttaaaattcttagcaatgattatatgttctacagagagctcattaaagtgacctgttcttattgtttctatccattgt

SEQ ID NO: 37744 - DNA, 1088 bp, Homo sapiens
tcagccaacctcggatcaaaatatttgaaaaagaaaaaccaataaaaattaactgcaattaaaaaaatacacattaaaaaaccaatgcggtataacaattattaacatagtatttacactgcatttggtattataagtactctagagatggttttttttttttttttttttgagacggagtcttgctctgtcacccaggctggagtgcagtggcgcagtttcggctcactgcaagctctgcctcccgggttcacaccattctcctgcctcagccttccgagtagctgggactacaggtgcccaccaccacgcctggctaatttttttttttgtatttttagtagcgacagggtttctccgtgttagccaggatggtctcaatctcctgacctcgtgatctgcctgcctcggcctcccaaagtgaggtggttttaagtatacaggaggatgtgcatgggttacatgcaaatagtatgccatttcataagggatttgagcatccacagattttggtaaccatgggaattctggaaccaatcccctgaagacaccaagagataaatgtacttcttaaattaagggattatttaaaattaacaatgacataatctttaaatgattatttgagatcaagtgattagtaaattttgggcagttgagaagaggaaggaaattatttacatgtgtacagaaaccatgaaagctagagaagcaggaagcatgtttagttaacattgctgcctaacaaagacgaagtctttagatttttatatagaccctaggcatatcaaagaaaactaaatcatgcctacagtttcctcccaaccaaaagagtctttcattgtccgggcactgggaaaaataaggggacagactgggaaaaataaggggacagattactgaaagtatttgcttttcttaccattgaatgatagggcacaattattagtggagaagaaagaaatgatttctagaataaaccattacttctagatttttttttttttgagacggagtcttgctctaccgcccaggctgaaatgaagtggtgcaatctcagctcactgtgacctctgcctcccaggttc

SEQ ID NO: 37745 - DNA, 1018 bp, Homo sapiens
gaaaccgcctccgtgattcaaatacctccacatggtcttgatcccttgacatgtggggattatggggattatgggcttacaattcaagatgagatttgggtagggacacaaagcctaaccttatcggttattccagctttcttttggttagtgttaatgtagtatatctttttctataccttaacttttattttattttatcttattttattttattttatttttgagatggagtattgctctgtcacccaggctggagtgcagtggcgtgatcttggctcactgcaagctccgcctcccgggttcacaccattctcctgcctcagcctcctgagtagctgggactccaggcacccgccaccatgcccggctaatttttttttgtatttttagtagagatggggtttcaccgtgttagccaggatggcctcgatctcctgacctcgcgatccaccctcctcggcctcccaaagtgctaggattacaggcgtgagccactgcacccggcttctataccttaacttttaatctatctctgactttatatttaaaatgggtttcttgtagacaacataaagttggttctctgccttttaactggtgtattaagaccactcacatttgaagtgataattgatatagttggattaatatctatcatatttgtaatagttttctatttatttcactttatgtttttatcctcctctttttatgtcttctctggttttaagcagttaaacgcttccatttttctctcctcttttagcatgtcatttatatttcttaaaaacttcactttttagtgtttgtcctatagttggcaatacacatttacaactttcaaataaccatgtactgcttcacagggagtgcacatacttcataacaaaatattccaatttctccctcacatcacatcccttataacattgctgtcattcaatttaattttccattagctatgatcattcaatatattgtcatttttattaccctaaacaattatttttctatt

SEQ ID NO: 37746 - DNA, 2051 bp, Homo sapiens
tttaatgaattctttttttcacattttcctctctttgaaagccacatgaacaaattaaagagtgcaatagaacaggtaagcatagttatttatttatgtattttccttttaaaatcttattctcccaattaagcattatatttattaatttggcagaaaaattaacagacgttgtgcatgtgtcctataaagtgctctggtggatgcaaatagattgaaccctttttaaggtgcttactgtctagtaaaagatataagatcattcatccatttgttctgtaaataaatatttgagggactaaaatgtggtagacaccgttctaccaactaaagagaagtgataaaagcaacacttctgacctcatgggacaaataaacatatgaatatagatgtatgtaataagtcctgtgaagaaaaataaaacggagaacggtatataagggatcctgcaaggaaggattactaatttttataggctagtcaggaatgccccttattaaaggacatgtgaatgtggtccagaaatacggagcaggtgagctacaaccatctggaacgagatattccaggcaggggcaaaggccttattgcaggagtaagcctgatacttaagcagcattacgaggccaaggtgcctaggttgaagtgagactagatcatgtaggaccttataagataccattgtaagaacattagcatttattcttacaaaagtatgaaagatgggaaaccattggagggttttcagtggaggaagaaggacattatttatgaggatcactcttactgctggtggataatagatttctaggagcaaaagtagatgttgtgagaccaattagcatactgttacagtaatccagatgatgaatacgcaaaccactttagtgattgaattggtaagaaagagttggattctagatatattttgaaaacagccagtttgattagctggtagactaatcattaaggttgactctaagatttttttagccaagcagttaaaaggatgaagttgccagcattgaagtgagaaagactgcaagcgaaacagatttgataaaggaagatgggtattttatatttgcatatggacatccttgtgtttttatgagtctggagtttaccagagaagtcatcagtgtatagatggtatttaaagccatgaaactgatggagattggcaagagaggacaggcaatggtaagcctgagttgtggtgcattttaacattaagagtttgacaagatgagaaggaaccagcagaggcgaaggaaaaggattggctattcaattaggagaaaaaacaagagtgtattcttttggggaaagccaagtacagaaagtatttcaaggaaggagtgatcacttttgtcagttgctactgagatagtatatacgatacaaatatgtatagtaaattgtgaaatattagaatctaagctaaaaaggaaggacaaaggttttttagaaatttgggggaaagtgaaatgacttcctattgggaagaagtttcatttggactgcattttgaaggatgtatgggatgttttggaacataaagctctgaaaattggatatagcagaatagcaagaaaatcgacattcttgccacccaaagggaacacagtaactcattgctgaaaaatcttatttaggccttttttatgcatattgtgcttttacttggtagggattgtgctgtgtctacatttttcaaattatatgcccatttaaaaaaactcagattgagcaacatggcaagacccggtctctacaaaaaaaaatttaaaaattagccaggcatgggggagcacactagtagtctcagctactagggaggccgaggtgggaggggtgcttgagctcagaaggtcgaggctgtagtgagttgtgattgtgcctctgcactgtagcaacagagtgagtccctatctcaaatagtaaaataaaaaacatcattgtcacatacacatttctcaagttattgtaaatggttcttacatatattttagtaggtctcctcaatttaagtaacagtttccctgtt

SEQ ID NO: 37747 - DNA, 1026 bp, Homo sapiens
aattaaagcccagagtctgcccttacggaacacagatgtatggagtctactgggagaaaaattaggaaaatcatctgtcataggtcattgtgtgatgcatttagtgataggcctgcgcaaaaagcttcagcgaaagagcaccacacttagcctgggcaaggggcagggatgccaacaatgctttacagaaggatgatgattgagttgtattttgagaaataaatagcagttatccaggcaaaagctcagaaaagcattttagctaaaaggaaaagtgtttgttggggcccagagagcagcataagtaaaaggaggagtaattttaggcttgaattactgttagatatgagaaacttaattcagtgtgatagcatgtgttgttacattatatggctctgctatcgaaattgttttgtaattcagttttgagtataaatgaaaaatctaaacttgctgtatattgcaatccctaggtatgtattagaataacaaagagaagttttataaaaaattcaagtgcctgaactctactttcaaagactctcgtgtaacctagagaaggtatctctaggcatctgtatttgtgaaacaaaacaaaatgcaaaacctaacacttgattctaatggatagctagggttgccgaccactactctaataagagtagcttgtgtttttcaagtaatctcatctttcttttctaattgagtttcttatttttgttttaaagaatctagagtttatttcttttaataaactttgcttcgatgtaatctagatatttagtcttccctggcaggaatttaattctcattattttatttaagatttaagtataatttatttatacttacattctttgtaagttgaagcatctggctagactgatctgttaggctgcttcaagttattggattcatatatgccatttaagttaatgtgtgttttcttttttttctaatagggttatttttaatattagaatgcagtgaaatgtattttttccaaacttaggacagcattttatt

SEQ ID NO: 37748 - DNA, 1029 bp, Homo sapiens
acatgggaaaaaagtttacagtgtaatataatcagcatcaattactgctataaggtaatataaaataatatggactaaattaagcaacaggaaggcttttggtggcctagatgagcagtttcagtggggagaatagacatcagaatgggacgactcagggtttggacttttgtccaagatgcaagcagtcgttctcaaactttttggttttaggaaccctttacacacttagaaattattgaggactgcagagaacttttgtttatgtggattacaactactgataaatactttattagaaattacaaccaaaaaattgaagaatatttagtaaatccttgaaaaattacactaataccccctttcatgttattacaggcctccaaaaaattagtaagaagagtggcattgttttatatttttacaaatctccttaatttgtggatgaggatacagctaaattctcatatctgcgtctgtattcagtcttttgtgatattttcgttgaagtgtatcaagaaaatcctgtctcacacagatatgtagttggaaaatggaggacttcgcagaccccctgaaagtctcggggacccaacgggtccttggatgacattttgagaactgctgaactgctgtaggattagatatatggagggtggtagaagagaattgattgtgtttaagtgttgacagaataaggaagttataaggagcatgaaattaaagactagaagtagtaattgatagaaggaggtttttgaagaagaatgggggattggggtcctagctgacttagagttaactttggaagggaggaaggaacttaggattttttaataagtcactagcacattgtaaggcttgaataacatgacagcttaggcaggaaggaggcaaggatggatgagagagtaagttttgaagcagggtgataggaaaaaaaagggttccaatctggttaattctactgtgtgtatgtgcatatatgcatgtgcatactctaggaaacaaaagttttatgctgagaag

SEQ ID NO: 37749 - DNA, 1042 bp, Homo sapiens
aagacaggactgacctaggtcagccatactgatattgcacatatacactatataatgatagccaccagggtattacaagctattaatgcaaagattagaatagtgaagctgaaacaaaggcaggcctggtgtcaggatcatgggccatgtgccagaacctagtaaattactggggctaaagttaggcagtggaagaccccagagagagattttgcaggtgccatatcagagcaagactcattggctagtcagagcccctgggggtaacccaaggtcaaaggcagcaaggaagctactccagactacagaaattctgtagagcccccattaattgttaatgccttaaaaagacctgtttggaagagttttattagctaagtttctaatacctgtaactctttggaaggaaagtgggaggtagtctttttttttttttttcgagatggagcctcactgtgtcaccacggtggagtgcagtggcgtgatctcagctcactgcaacctctgtcctgggttcaagcgattctcctgactcagcctccagagtaggtgggactacaggcgcaggccaccacgcccggctgacttttttttttttttgtatttttagtagagacagggtttcactatgttggccaggctggtgtcaaactcctgacctcaagtgatctgcctgcctcggcctcccaaagtgctgggattacaggcatgagccaccatgcccggccatggggggtatcctttaaaatattatggatgccttaaaaaatattgaagccaaaaatactgatttttaaaagtagaaattagagatctactaaagtagaaattaaagattccatgttggaatcactgatgttagccataatcaccagagttttttcaccttttctaagttctgataattcctaaaatctctagaaaggatattttgcactaaaagcataaagtacttttatttttcttatcctgaaagagacactaaaagaagtgatataggttatttgtaatatattacagtaaagatagtttttggatattt

SEQ ID NO: 37750 - DNA, 1077 bp, Homo sapiens
tctttgacaaacctgacaaaaacaagcaatggggaaaggattccctgtttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacctcatgttgaactcatatctagttctaaagcttttattctttttactttaaatttttggttagagataactggagactagtacatgtaatttttaacaatgcctttggtgatgttggtaactagaaaacattcagtcttcagtaaatgtgactttagtcagattatttgttctaaaaacctacctgaggtttgttaaatgaaagaatggacatactggtaactgtgataaagcactggaatacttttaggaatatcacagatgttggtggattgtaactttggtagttgtgagcagtgaaagatgtagagaagctgttggggaggaaaaagagaaagaggaattaaaaagaaatacatttttcttctacactagactgcacaaccatctggtcctaagttcattctctcattaaaattttatttattacattagtatattctcatttcgaaagaataaacatatgtatagttaaatctgaaagtctcatttgcatttctcctttcatccctgcatttctccccagaaaaataggttattttttataacagtgttacttacattaacttgggtttattgttgtatttaaatgaatgaataagtattttttacatggtctcagttttgatttctaatatgggaaaatattgataaatataacccatgtacacaaaagactcttgggatcctcgataacttgtaagaacattaagggttgttttgtttgtttgggtttttttttgtttttttttttgaaacagagtctcactctgtcacccaggctggagtgcagtggtgcagtctcagctcacttcccaggttcaaaagattcttgtgcctcatcc

SEQ ID NO: 37751 - DNA, 1028 bp, Homo sapiens
tccctggcctcttcgtccctctcagtcatctttcttggtgtctgttggtgtctctcattttccctttgtctctctatcactcaggctctctagagtgtctcttctcagtctctctgttggtctctccttggtcttctctgtctctcggtgtctcagtagtaatacattgactctcttctcaaactatccagttattactcaactttctgaaatttgcctataaacctactcttctttttattataaaacttttctagaaactcatcagtgtctagaaatcaaacattgttgactacttccagtctcatttattttattatgcctttatcctatatactatctcccttaattgaaaatttatcctccttcagagtttatcacaactttatgaatcctttctgattttctctaggtagatttattttctcctccatcagaattctcataattctttactcatattcatagccttctatatcatagctgtattcgtatgtgtatttgttactagactgggaaaaaaaccttaaagtaaaaaattgtcctgttactcacctttatttcctacactgcacattgccttacatgtggtaagtactcaggacacattttgatcgattgtaattactgttaggaagtttattttcaaaatcctgtaaatactctcctgaagattttatgtcttccttttgaacactactgtacatattgaaatactcattgtttgtcctgggttctatatatggaaagaaggacattgtgctgtaaatttttttaaactttctacattataatttgggttcatacataataaagacattatgtttaagcattagcagtttgctgtatgaaagtaaattattcagctttgctgtatttgtacaatattctattttgctgtggtaaatgttgaagtaacttctcatgttcttctttcttagttttaaaacacttttcttagtttaaaacaatttacaagagagaataaggactataaatattattttgaccatttaatataccaaagc

SEQ ID NO: 37752 - DNA, 1030 bp, Homo sapiens
aaaaaaaaatctgttttaatgagatgtccataatgtaatgtaacttgatgaatatagtattactttttttagtagtctttctcttttaaaaattgagctataatttgcatataataaaatgtataatttattttgaaaaatatatgcatctacttaaccacaatggcaataaagataaaggacattttgatcactctggaaagttccttagtatacatttctcctccatttccctcactccctatccctgatcactgctttgatttctatcattgtccattagttttacctcttctacacataaatagaattatcagtaggtgccccattgtgtctggattctttcatgcaacagtattttttgagttcatctttgttaccgtgggatcagtaattcattccttggtatttctgagtagtatttcaatgtaggaatatatcgtagtttgtttatccattctctgtggcatttgggtttaaataaaactgcagtgaacatttctgtgagagtatttgtgaacatttattttcatttttattggataaatttcctgtgagaggaattgctgaatcatagctgtcaagcaatattccaaaaatggttgtacacttttacactcctactaacaatgtatgggagttccaagggcttcatattattaccaaccactggtgttattagtcgtgtcagttttagccattttaatgcttgtggccattttttttgtttgtttgtatgtttttgttttgttttgaaacgatgtttcactcttgttgcccaggctggagtgcagtgatgcaatcgtggctcactgcaacctccacctcccgagttcaagcaattctcctgcctcagcctcccaagtagctgggattacaggcatgcaccaccacacctggctaattttatatttttttttagtagagttgggatttctcccatgtaggtcagactggtcttgaactcttgacctcaggtgacccacctgccttggcctcccaaagtgctgggattacaggcgtgagccac

SEQ ID NO: 37753 - DNA, 1062 bp, Homo sapiens
tgcaacctttgcctcccaggttcaagcgattctccttcttcagcctcccaagtagctaggactacagacatgtgccactatgcccaactaatttttatatttttagtagagacgagggttcactatgttggccagggtggtctcgaactcctgacctcaggtgatccaccagcctcggcctcccaaagtgctgggattacagacatgagccaccgtgcctggcccatcttccttaacttttgtaacagtgctttaccatgagttttcttttcctctctagtagtctgtctttactgatcttccctggcttctctgcttttcttctctctgttcttaaaatattgatgtatcctaaaattctagtttattagttcttcacattcttttctattttcaattaatatgttctgcctgaagatttcactaccaattgtgtgtcagtaactcctgtgtctggaactctgttcccagccattctcctcagaccatttttctttttctttttcttcttcttcgttttttttttttttaagattgagtcttgctctgtcacctggtctggagtgcagtggcgtgatcttggctcactgtgacctctgcctcccaggttcaagtggttctcctgtcccagcctcccaagcagccagaattacaggcgcccaccatcatgcccggctaatttttgtatttttagtagagatggggttttgccatgttggccaggctgatctcaaactcctcatctcaggagatccacccaccttggcctcccaaagtgctgggattacaggcgtgagccactgtgcccggccaccagaccatttttcatcaatcggttgcacatcttttcttcagctgtctcgcagcccccttgaactcaatctggcaacacccttatcccaaacttactccccctcctgagatattctttatcttggttaatggtatctcctttcatgaaatctgaaagctgagagtcagccattctcatcctttattccccatatagtcttcaggtcctatctctgccttctaaataagatctagctctatccctttcta

SEQ ID NO: 37754 - DNA, 1016 bp, Homo sapiens
ttagggattttgaaaagtggaactgcttaagagaaataggatgccactaatgtagagcttaacttaatgtgatattcaagtgtgttaacatcaaaataatccaaatctagttattaatttggtgatatatttgctttaaaatatctgaaaattttaaatgccaagattttagatacttattttattgaaagttaaattatgataataaccttaattattagaatgacttcttgaaaatgttttaagcaagtattaattattgttttaaaatatgtaattcataaatactgtacagtatgttagtccttggtttatgtttattttatgattctctttctgccatttgttgctcttctttcttggtatgtttacatgggaaccttcactgcagatttttggaaagcagtgtgcttttctgtttgtatcccatatatatatttataagtaaaatgtaaattaaaagcttgacattgtattagtgtattgatcataatccagttatttttatagttaacggtattctctaattttactgacatggacctgaatttatttagaattatttttgatgctttgtgaacaccttaaatgtgtgtccccacttagtcatttgagttaaataatttgaattagtaatggccttatactaatttaggtacattgtttttattttattttattttattattagtttttgagacgaagtcttgctctctcgcccacgctggagtgcagtggcacaattttggctcactgcaacctcagcctcccgggttcaagcaattctcctgcctcaggctcccgagtagctgggattacattacccctggctaatttttgtatctgtagtagagatggggcttcaccatggtggccaggctggtcttgaactcctgacctcaggtggtccaaccgcatcagcctcccaaagtgctgggattacaggcatgagccaccatgctggcctgtttttttattttaaataagtcacattatacaagttcccccctttttaa

SEQ ID NO: 37755 - DNA, 1070 bp, Homo sapiens
tttttatccctacagtttggccttttccagaatgtcttataaatgatatcatacattgtgtagccttttgtatcaggttctttcacttagtataaatgcctttgacattcctctatgcatgttattcctccatgtatcagtagtgtatttttgttgcaaagtagtattcctttgtatgtgtgaaggttttaagaaacacacctacctgggctacaaaccctaatatatctgaattcagaaggatagccaggaaatggtaatttcttggactcccgtctcatggtatgagataatggtactagggagtagagtgcaaggaggtcatagtgtcaaatgtgcgtaggtggaatggaacataagaggctgtgcttaggactgtttttcatgtttggtttagaagggaaggtaaatgtgacagtaacgtaaaactttttaaagataaataggtgaaagaaacaaatcagaggtataaggaatagggaagatttaacaggagactagaagggatggatcaactctgtagacgtggagagggagaggaacgcttttttctttaaggtaaaaggagaactagtatgattgggtgctgttataagtgaattgagaggacttacagatttttgatctgagtgtctggatgagtagacttagtaggttgactttagagaagtaaacttctaattaattcaaatactggttttcctgttttggaacatgttcctttttcatccattgtttcttagttttgtggcactttgctggttttcaagctagtgggcatcaagcttttctctggccagttctttcctatcctgaaacccttcagtggaaaaacaaatcatgttctgccttaagagtatgatggttattaagctattttgtattccttggaggaaaggatatacaatcctggggattcaaagaagtgcttcttgaaatgaatgtgaagttttagtatcagactagaggtacagacaatcataatgtagaaagcatagatgtttccctttctccaattttcttttccttggggttacatcttttaatagttaattctgagtttactagtt

SEQ ID NO: 37756 - DNA, 1062 bp, Homo sapiens
ggccggagaatcacttgagcccaggagttcaaagttgctgtgagctatgatcacgtcactgcactccagcttgttaacagaatgagactctgtctcaaaatgcaaaggaattaaacaattgacttcaaacataattgtttcatttgtttggtaagcacatgttgggcacatcctccccctgctccctctttttaatgccagccactgtactgggccttcatagaagaatgagatcctgtagagaatgagattaagaatgactaatgattcttaatcatttttcctgccacatacccctctagcaacctggtaaaacctatacacaaacctcttcttataaaaatgtttagaaacacttaaaatgaaattcatagaggattataaagtaaacttatgttgagatagttgtcagaatattaaatttctaatatagtagcacatactatattattaactcatgaaataacaagacctagcagtggatctaataagtattgtaattttgaataatgatgtgcataaacacatttttctaggtatctacatcagctgtacaatgatgaaactatctatgattcctattggtgatcaaagttataggaaccttatacctctgaagtttgttgcctgcattttaatagaaggaaacgctaaatggtagttagagattggtggaaatctctaactacaattcattccccatccaagttgacaggcacaccaaaccacagatctgtgtgggtcagcagattgcatgttaagaatccctgatctaggagctttagtttaggctgtgagactgacacttcagtgggtagttatataataattgaaacctgagcaggggttttgtctcatttatctttacatttttataatctcacagtgtccagtaaacattaaacagttagttattaatagagctagataaataatttgggggtatatatgggagattacttctgttagaagaggtagcattgagctgtattctaaatttagtatacattggaattttcaggttggatgaagtaaggaagaggtactcagaattgaggcatg

SEQ ID NO: 37757 - DNA, 1073 bp, Homo sapiens
acgatgcctggctaatttttttggttttacataaggtcttgctatgttgtggaggctgggcttgaactcctggcctcaagcagtcttcccaccttggccttccaaagtgttgggatttacagtcatgagccaccacacctggccctaaaatgtatttcttttttttttctttttcctaaaatgtatttcttaattagtaagacttgaaagtcagaattactccttgatccgtaggctgcagaatggatgttgtgttagcaggcatgataacattaatctccttgtacatcaccattggagctctttggtgacaagatgcattgttaatgagtagtaatattttgaaaggaatgtttttttctgagcggtaggtctcaacagtgggcttaaaatactcagttaaaccatgctgtcagcagatgtgctgtcatccagactttgttgttcatctatagagaataggcaaagtaaatttagcatcattcttaagggctgtaggattttcggaatggcaaatgagctttggcttcaacttaaagtcactagctgcattagcccctaacaggagagtcagcctgtcctttaaagcttggaagccaggcattgatttctcctgtctggctatggaagtcctagatggcatcttcttctgataataaataggctgttttgtctacactgataatctgttatttagtgtagccagtgtcatcagttatcttcgctagatcttctgggtaatttgcctttttaccttgtaattttatgttaatggagatggcttctttccttaaacctcatgaactaacctatactactttcaaacttctcacctctctcagacttcatagagttgagagagttagggccttgccctggattaggctttggcttaagggactattgtgactggtttgatcttccatccagaccattcatattttgtccctatcagcaataaggctgtttcactttcttaccatttttttattcactggggtagcacttctgatttcctctaagaaattttcctttgcattcacaacatggctaactggtgcaagaggcctgtc

SEQ ID NO: 37758 - DNA, 1035 bp, Homo sapiens
tcatggccatctccctccaaaaataattgtccaaagcttcagataaaagcttgggttctgcttctgacttagagagatgagcaattgaggcccaaagcctcatgatgtggtgtgacccattttgcagaagattaaactgagactgtgagaatgggatttgtctgaagtcatagcaagtaaatgagcatgatagatacctacttgggcctcagaacccaatcttgtaccagtgtcctgctttggacctatactccctaaggcaggacaaaatgagcttattaaatatgatgccctacacttcttcaaggaatgtgataccaggagacaattacccaggactaggagtagaaggcctccatcacagcctttagcctcagactgagccaagaagaactcaagattggtagaggcattaacatgccaaccatcatcattccatctgcagttgagcagaaaagctctttcaaatataatgtgctctcctttgtagtctgtcaaatatttttctgtctggactttgccttagggcaggatagataggatttagagatagaaaggaatggaaggctgttagatgtggagccaggcattgcatgagcaaagggtaggactgggaactggctacttaatttgcaaggtccagggcaaactgaaaatgcagaactccttggtcaaaaattattaagaatttcaatacagcaatggcaaagcattgaaaccaagtgtggcgctctgtgtgactgcacagttgcatgcccatgaagctggccctggcaggggatcaaacctggcctccaggaaatgaagcagatgcaggagttctgaatggggacactgggaaggggggtgaggtgagggccatctcccatcattctccttcctgtaggctctgcatcgatggctttcggtcccattccctccctgaagaggggcccaagaagccctgtcagcatcatgcagcacaggaagagccatgcacacgcagtggccgtttgccccaagcccatgaggggtgccatctgcctttggagaccc

SEQ ID NO: 37759 - DNA, 2035 bp, Homo sapiens
gaaaagacattagtgagggccaatatagaaatatgagttttcccaaaagacttttatgtatatatatgacatggcaggaaaattgggtcactagtggtttttacttcttcgttcatttggcaaacatatgaatagactgatgtgtgccaaacactgttccgagttctgggaactgaggaaagaaacaagctatctgttttcatggagctcgtattttacttggaggatggagaggctgacaataaacttgtacaaataaatacaaacttcaagtagtggtaattgccaaggtgaaagaaaagagagtaatggtatagaatgacagtcattgggtagctgctttagatgaatggtaagtgaacatgtttctgagaaagtgatatctgagctgagaggcaaaggacgagaaggaatctgtcatgtgaagatctgggaagcaggtgtactaagcagaagagcagcaagtacaaagactgtgaggtaagggatgtgctcggggtgactaagtaacggagagaagaccagcgtgactagaacatagtgatcaaagtgagtaatgttggaacataagtcagagacattggcaggaggccagtttttatggaagccaaattgtctagtgccttgtagatagtggcaaggagtttggattttattctagatggaacactatcagaatattttttcttttttgagacagggtctcactgtcacccaggctggagtgcagtggcatgatcttgactctctgcaacttctgcctcctgggcttaagtgatcctcacacctcatcttccccagaagctaggactacacgcaccacacctggctaatttttgtattttttgtagagatgggattttgccatgttgcccaggctggtcttgaatgctgcccactttggcctcccaaagtgctaggattataggtgtgggccaccgtgcctggcctatcagagtattttcaggcagagaaaagcataaggtcttacttctagcataaaaggaacattctggctgctatatagagaagggactgtagaggacaagaatgaaagcaggttgactgattagaaagcattgcagcattataggcaagagcttatgatggcctgaactagagtggtaactgtggaagagataaatggatgaattcagaatatttttggaggaaaaaggtgacatgatttactattggatgtgggcatgagggaaggaaattaaggatgactcctggatttttagcctgagcaactttatagcttttcatgtttgtttttgaaatggggagatttgatggggtgggggtttgggaaattaagagttttttatttttattttttgctttttaaaaattgtggtgaaatacacataacataaaatttaccattttaaccactcttaagggcattaagtacattcacattgtgcaaccatcaccatcatccatctgtagagaactcttttcatcttgcaaaattgaaactctgtacctattaaacactaactccccactcccctccttaccctagccccgaaaacccttctataatacagaagtctctatgaatttgaccactctcataagtggaatcacatagtatttgtccttttgtgactcgcttttattgtcacttagcataatgtcttcaaggttcatccatgttgtagcatatgtcagaatttccttcctttttaagactgaataatatgccattatatatgtatactacattttgtttacccattcatccactgatggacacttgggttgcttccatcttttgcctgttgtgactaatgctgctgtgaacatgtatgtacaagtatctatttgagtacttgcttttaattctttgggtatatacccagaagtggaattgctggatcatgtggtaattctatgtttaatttttttaaggaattgccatactgttttccccggtagctgtaccattttacattcccaccaacagtgcacaagagttccagtttctccacgtcctcgccaatacttgttattttctgtggttttg

SEQ ID NO: 37760 - DNA, 1048 bp, Homo sapiens
gtgatgttccttgttagaaacacatagttagatgggctaggcaaaattgcaataaatataatacattaatgtagcatttccataagtccctacatatgcatcaggtattgcctgagatgatttgtttctgatttcctctgaatccacttgcaccttttgagtacctcagaagagataatcaggaagttcaaatctggcaagcatgcagctcacttggcctggccacatgacctagtctagtcttggaaattatcacctgtcctatccttcactatctggcataatggggtgggctgccatcctcttgcatttactttaagttagcttcccgtagcctgaaaaggcgagcattaattgaacacttaccatggtcaaacgtgtcaaattttggcttgtttccagactatacaggccaccccatagtttctatataatgttaaatgtttgcatttcagtcttttaggaaagcattcatgattgctttttttcttctccaaacagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacaca

SEQ ID NO: 37761 - DNA, 1050 bp, Homo sapiens
atggcaaaaattggcaaaatgtctgctggctaaatccagctcaccacctgtttttgtaaataaaattttattaaaacagccatgctcatttatttacatatgctctatggctgctttcacatgaagccgtatggcctgcaaagtctcaaacacttatctgtccttttgcagaaaacgtttgcctgatttagagaaattttttttgttcacacctagtttttcacagagtagattattattttcaaagctaaagctgataacagatttgttaaaaataaaattttaaatagaaaaatgccagtaatatgttaaaatatttaacaataatgtatcttccttccaggcttagaaatttaaaaattttcagtgagccttttgaaagttttgctatcaaaccttaaacatatttgatagtttgatattttgggggagggagagactgaaagtggagatagactaacctattatgaagggtaatttatcactcctataatatttattgtgtatgactttgagttttaaaactccattcctttaacttatcaacctaaatagtttcagtagactaaaatctcaccaaatgacttctttattttttattcttgtcatttcaaccctttgaatgattaggctttaggtgaccagtaggatctgcccacagtagttgcttaaagcagtacactttctaattcctctgtatggctttgtaaagtagagaatattggataaactaccaagattggtttttaggaaagtaaattttggttctttaatacaaagcttgattgtcctttaaaatttttttctctgaaaactgaatttttctctgtgtgtgtgttcattttcttgtttcctctttctttggttcctgttgggctcatttctttgttttccaggcagtagcagcagcagtagttcagactccacatgttctgtcatagagaaacctctggataagttcttgcctagtgagtggtagctcttacattctctaacagagctttggcttttccataacccatgggcttcatttgagcaatgctgcaccac

SEQ ID NO: 37762 - DNA, 1033 bp, Homo sapiens
agttaacatcaggcaaatttaagattgtaatttatgccaataattgatacgtatcacattttttaaacttgattattttactttttttgacttgtggttgtcctttttgtggtacactcgtgtattagcccataatagtgtcctttggaaactcatgtggttgacactctcattttcgagaaggccaagggtgcatatgtgctttaaatgtttttgatgtatttgtaatggtagtattaattttaactctgtcaagtgtaaaatgatttgtttcatatttctaattcaatagtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggtagcttttcctcaaaatattaatctttatgttggctaaaaatacattgttgaaccactaactgttctaacaaaagccctctattaaaccttttttgagcctctaacattggtagttaaatgaatatttctagaaagtgacttggtacttacatactttcgcattttcatattaagcttaagtaaaattacataatatttgtgtatgtggttttttaaaaacatttgcatgatgttttgtagatttcatatgaccactttttaaggaatgaatgtttatttgtctctgtataagagcaaattctgcaatgtatgtatttaggtgaaaatgaccagaattctggcattgcaatcaatatcaactaactattgtttgaagtaaagcaagatattagacagtcatgagtaaaccaagtttgctataaggaaaaatgcattgcatgacctttaaaatatcctttcatacctaaatttgaacatgagattgtattttggaaattcttttctaacaatatcatgctagaaagttggaaaatttgaagatcttatttatgagagtgagacgct

SEQ ID NO: 37763 - DNA, 1038 bp, Homo sapiens
tgtgccaccacacccagctaatttttgtatttttagtagaggtggagattcaccatgttggccaggctggactcaaactcctgacctcaagtgatctgccctccttggcctccccaaagttctgggattacaggcatgagccaccccgcctggccatagtttattatctttaaataatagtaataataataaatagtgcctattttttaggattggggtgaaagttaaataagaatgcaaacatagctgggaggtgcacctgtaatcccagctatttacaggtggattacaggcaggaggattctcctgagcccaggagtttgaggctgcagtgagctatgatcgtgccactgctctctagtctgagtgacagggcaagacctcatctcttaaaaaaaaagcatgtaaagtacatgacctagcacatagcaaatgatcagtaagtgacagctgatgtccttataaagcttattttttatttaataatttaatgtgtctattctgaaatgcagtctatgagctcatgatattttctgcttcaagtgcagtgttatattcctaatagcagagtttgaaatacttagtcagtttgaaaaaattaagacttttttattcccatgtgtaaaaaatggcttctggtatgattcatttattttcacggaaaagtctgaaaagtgtgttatgattattttcacaaaaaaaagtctgagaaaagttgaggttaactgaatagagtagtattagttgaggaaccgttttcatatatgccatcacatccaaggctatcttttcttactacactgtgtcctgaccaactactccagccctctgtttccccacatcgacccttggttttctccaattcttcatccacaatatagccatagtgatcatgatgtcactcctctgattgaaaaatcattctatggcttcatgttgcttttaggataaggtctaaaaagtttaataccgtccttattatactgtgtgattatggcattgtcagtttctctagctctgcctgcatccatcttccct

SEQ ID NO: 37764 - DNA, 1870 bp, Homo sapiens
atcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaag

SEQ ID NO: 37765 - DNA, 1060 bp, Homo sapiens
aagcttcagtcagtttggtccctgggagagaaaacgctcttcccatgacggctctgtggaggccaggaatggggtaggtgggttgactgggagtactccttcctgccgccctggtcaagggactagtgtgagtcgggagtgcatttttggaatgggggcaggggtgtttttcatgaccatttatttgagtggttttgattggttatgcatactctttaaatttgaatccaaattttttgcaaaattacttcccaatcagatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaaccttt

SEQ ID NO: 37766 - DNA, 1031 bp, Homo sapiens
acctgtgtttctgggagctctggcagtggcggattcataggcacttgggctgcactttgaatgacacacttggctttattagattcactagtttttaaaaaattgttgttcgtttcttttcattaaaggtttaatcagacagatcagacagcataattttgtatttaatgacagaaacgttggtacatttcttcatgaatgagcttgcattctgaagcaagagcctacaaaaggcacttgttataaatgaaagttctggctctagaggccagtactctggagtttcagagcagccagtgattgttccagtcagtgatgcctagttatatagaggaggagtacactgtgcactcttctaggtgtaagggtatgcaactttggatcttaaaattctgtacacatacacactttatatatatgtatgtatgtatgaaaacatgaaattagtttgtcaaatatgtgtgtgtttagtattttagcttagtgcaactatttccacattatttattaaattgatctaagacactttcttgttgacaccttgaatattaatgttcaagggtgcaatgtgtattcctttagattgttaaagcttaattactatgatttgtagtaaattaacttttaaaatgtatttgagcccttctgtagtgtcgtagggctcttacagggtgggaaagattttaattttccagttgctaattgaacagtatggcctcattatatattttgatttataggagtttgtgtctgggtcccaggaacatctactggggatgactgttaggcagcttgtgatgatgttttttaaaaaacctaagtaacttggggagacagagcatttcaaacccatatagacacctatcatacctgtatatcccctaatacatggaacataaatttcatttcagctttatgcattaatgtattgaagaggcaggctttttttccagtaataatactgtacatctaaggttgctattcagtaaaactaatagaagagataattattgaataccttggaatatgta

SEQ ID NO: 37767 - DNA, 1574 bp, Homo sapiens
actcctgaggattgccgcctgtgtgtctttaattgattatctttgatagttagagttatttttcagatttttccccctcatactggattgtgatgctctgatatgagcatgcaatgactgatacagaaataggctggagcttcggtgtgtgcttttgctatacagcttacagttctaatgcctgatgtagagatgatgaatttctcctttttaaacctatcttctgtttactccttttgcattatgaaggccctcttcaatgatgtatgtttctgatggaatcagaaaatttcacactagaaaagtgtacctaacttgattcagtgtgagctcttgggacagggagtggagccaggggtagagcttaaagaagctggctctgtaagagttgtatatcaaagtaccttttgctacaaggtgcatatagaagtctaagataagaaatgtaccctctatactttatttttcatgcccctatcatgtttggtgtgccttaaatcttacctttaaatgaagactctatggattgtttacaaatgaagttttacactaggaccagatcgtccatacatgattggtcttctacaataataatgttcaattctttcattttaaatctttctttagggtcatataaagattagttctttcagaaaagctattgctttggtacatgacttagtctaaccagttgggtaatgctgctttgaaaaatagtttgtccctctccccattccaaaaatgaatccattcagtcagaaaaaaagattatcctactatttgtagatgattgctaaggcttgaaataggaaaggggaaagaagggatagaaaagtttcaagtccagtagtgcagtgaatcctttgtgtttgagacttttttacacttatttctgaagttagtgaactttcattgtccctgtggcctcatatttatagagcttcttaactgttttgtacctcagattgtttttagatgtcattgaagattgagatgtacaaattatgttgaatttaacctgtttctcttggagaaattgcctctgatatctttctaacttaatcttagtgtgttctaggaacagttttccataagaggacaacttctcaatgatcatgatagttatttagtaagaaataatggttgttaatcaaatacatgttatgtcttgtccttctctgatttttctgacttggattccttaatttgcagtgatgtcttagaaatggaaaaagtatcctctgggctttcagactttcagcaacaacagccagtgggatacctctgagttcttgtgttctagtctcttgtatgtcctgaaaggcagcaggagcatttttggggtcacactgatattttgttaaagcagagtttcctgcatggtttatggtgctgctctaatattttctctttaaaactgtgtcaatttttggagaatgaatttttcaaccttttcattgtggaggatttttcccacaaggtagtaatgggcaatggatcaaaatcctatcataaatgattgaattttcaatgtcatagtgtgtggaaatactactccctttcctccatgtcta

SEQ ID NO: 37768 - DNA, 1043 bp, Homo sapiens
ccctcacctttacccttactctcttggcctgtcagaagaattctagggaagatagtcttatggtcccaagagattgtggttgtgtagattgagagtggtaagatcaggaaccaatgcaaatgtctgggctttaccgtatacctctgtaacaaaacaggtattctttttgccaagagcagtaacttcttaattaaggtagatttgtactagtcataaggtattttggaaatgaaaatgtggaactttttgatccttagtttatcttcagtgatcttaatgcagggataaaactagaagaatacctcttttgatgttatgctttctttatctgtctatcaatttcttagttccaccttaaaggccgtagcttacaggaaaaagggatttgacattgttaattatgcagaaaatgttaaaatgcagaaaatagctaactataggccagagaatttacattttctctcttctttttgtttccttttttttctcagcttgttttccctagtcgtcatcttttaagaatgcttcatccttctactcttctctcattctcttttctgaaagctgttcacaaatgggatcataagctgcctctactcattatttgtgtttttcactttgttttagagctatttctatatcagcataaagctctagctcattgtttaaccttaaaattatgttataatatgaaaatatcttaatttatttcactagtcccctatcgatggacatttttttccagtttttgccattacaaaccaggctataataaacattcccaagtgtgtgcttgtgtgttcgtgtattcctcaagattatacctgtaatgtaaattcctttcattggaattattaagtcacttagcaatataattacagtactgagaaggtattaccagattgcccttcaagaagatcgtatgagtttatagtcctaccagcaacatatgcacatgcttatttcccctgtagtcaccagtatctcatattattgggcttgaaggtgttaccagtttggtggttgaagaattatatttcatt

SEQ ID NO: 37769 - DNA, 1094 bp, Homo sapiens
aacctccgcttcccaagctcaagtgattctccctgtttcagcctcctgagtagctgggattacaggtgcccgccaccacacccagataattttttagtagagacagggtttcccagtgttgcccaggctggtcctgaactcgtgatccacctgcctcaccctcccaaagtactggggttacagatgtgagccaccacacctggccttaagcaattcttaaacaaaagccttaagtttctaatgtcagaaattctatctataggaacaatggggatgctgatggtcagtatctagtgttagtgacttcctgttacaaagaagtgagtcagccgggcgtagtggctcacttctgtaatcccagcactctgggattacagggtcaggagttcaagaccagcctggccaatatggtgaaacccccatctctactaaaaatacaaaaattagccgagcgtggtggtgggtgcttgtagtcccagctacccaggaggctgaggcaggagaatcgcttgaacctgggaggtggaggttgcagtgatccgagatcgtaccactgcactccagcctgagtgacagaacgagactccatctcaaaaaaaaaaaaaaaaacccaaaaaaaagaagtgggtcaaagtgcagtataattaatgcttaattataattatatttctgtccagaattctgtttaaccctgtgagggtggtttcatatccttgccttgttttggtatctgagtaatgatggccttatagaatggattgggaaataattgcttccccttccattttctggaatagtgtgtatagaaatggtattttttcttttttcttttttcttttgagacagtcttgctctgtcacccaggctggagtgcagtggtgtgatctcggctcactgcaagctccgcctcccgggttcatgccattctcctgcctcagcctcctgagtagctgggactacaggcatgcgccaccacgcccagctaattttttgtatttttagtagagacagggtttcactgtgttagccaggatggtctagaccatctcctgacctcgtgatccgcctgcctcggcctcccaaagtgctgggat

SEQ ID NO: 37770 - DNA, 1025 bp, Homo sapiens
ttattgactaagtatgtagaattttggaggagctgtcatgaaaccagtatttataaatacaaatctggtttttagctgtataatttttatccttgacctggttgaaaacaaactgtaataattacatttcaggagatgacgcattcatggcctccccctctaacggctattcatacaccatgcaaaacagaaccttccaaatttccttttccaactaaggtaagtaaataaaatgtatctttcataatgtaagaaaactctaaatggcttgactaaaatcatatggattaaaaattgtcttgccattcctattctagtgggagacagacagtaaataagtgaataaatagataaattcagatagtgacaactgttatgaagataattagcagggtaatggaactgagagcatcttggatcaagaggtattaagaaagctttgaaggcaatatgcgagagagatttaaaagacattaatacagccggacacggtggctcactcctgtaatcccagcactttggaaggctgagccaagagactctcttgaggccaggagtttgcgaccagcctggtcaacatagcaagaccctgtctctaccaaaaattggaaggaaaaaaaaaaaaaaaaaaaaaaaaaagcttggcatagtggcacaggcccgtggtcccagttactcgggaggctgagatgggaggatcacttgagcctgggaggtcaaggctgcagtgagctgtgattgcaccacagcacgccagcctgggaaacagagcaaaattctatcttaaaaaaaaaaaaaaaagacagtggtatttattgcagactattatggtattgtaggccagaggtggtaagggcttctcaaactgttgttttaagaacctgtttccataagacatagcaaccatacttgtcccgtggaaagaggttcctcagataacagttccaaggttgtttaaaatcagcagattgacttttttttaaacttatacttaacagtattaatttacacttaaaacaaataat

SEQ ID NO: 37771 - DNA, 1035 bp, Homo sapiens
tacctgcattggttgcttccactcttttctttcccattccttcctttagcccactataatctcccttttacctctgccattttgctgaacctgtttctctatggtcattatctttctccctccatccagaggcatcatttgagttcttttttattctttctgctatgtattttttccttctgcaaacattcttctttccttgactgtttttatgcttcattgtttttatttgccttccacctttcttgcctctctttctttgccctttttggaacccttgtgccttctcttgtttcttaagtgcaggtgcattcttctagcctctgctctttgacttgccttttccaccattcttggctttatctcttagacagctatttagtctttctgtcctacactggcctttgggttttggtttgtctcttaattgcttcttagctgagtttccatttggatttatttctctttgcctcttcagactcaacatgtctaaagccatacttatcagacttccttggattagtagtacaccgttttcccatgcttgtaactgtagaatcctaaatatctctaatttcttcctcatgttctatgtagttgcaaaactagatgtagactttaaaatttttgctttttaaatatccattcctttcttcccgtttctgccgccttgagcttcagtaattataacagaggcctcattcagcctttctgcctccagaatctccctactcatatgtcttttgcattgctacctgattctttacttcaggccctgtggtcttcataaattaatttttccctaaaaattttcagtggctctctaagattatagaaagaatagtatccaaatttaatatccgcaggccaatcctaacctctctcattactgactgaccgcttttgctaaactggtttccctaagccacatacattctttctcttttacctccttaaataaagtaagcttggaatgtatttctcctccctcttcagttatatatagattttttttccctgtaatcccaatgaaat

SEQ ID NO: 37772 - DNA, 1052 bp, Homo sapiens
gcacccagcacttctcagtctcagaaacggtcctcaggcttacagagtggacatagtagccagcggaccagcgcaggtagcagtagtggcactaacagtagtggtcagaggcacgaccgtgagtcatataacaatagtgggagcagtagccggaaaaaaggccagcatggatcagaacactccaaatcacgttcttccagccctggaaaaccccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccctcattgatgtcaaagtccaattcaatgttacagaaacccactgcctatgtgcggcccatggacggacaggagtccatggaaccaaagctgtcctctgagcactacagcagccaatcccatggcaacagcatgactgagctgaagcccagcagcaaagcacatctcaccaagctgaaaataccttcccaaccactggatgtaagtcacacatttagagcttttaacattgtgactacgtgaagcaattgactgatcatgaaattacgattgaacttgaacactgcttccttgccttaatagtaaggaatgtaaaagttgaaagatgaaaaaaatgtaaagacagacttgtgagttactcccaagtggatgcgtagatctgttaactcgtcctcttgggaaatggagaaaatgtcattcacagttttcaaatacttagatgacaagtcagttatagaataaaagaatgactaattgatatcttagatttctgcattttgattttatagaacaatatacctttgttgttgtttaaaaacaaaattaacttttctatgcttagattgatactaatgaatgagatgcaggtgatggtttatggttatgataaatgggacttttgggtctgtggaaatagtaatattgtatactttgaatgctatgatccttttctc

SEQ ID NO: 37773 - DNA, 1025 bp, Homo sapiens
atgatgaaacagtcaccagctaagctacgtgaggtttaaatagacccaattgttatactgcagctttattctgacattattccctctgaaatgtaatatagtagatatgcttatcttgaattccatccaagagaattaagttgctgaagtaacaatgccttgtaaagagagggactgtggtttacaacaggcaatctccaaaatatcaaacctaaggataacatgctagcaaagcttcaatatataagcatatatatggaatcatatgaaatcgcttttggctgggcgcggtggctcacgcctgtaatcctagcactttgggaggctgaggcgggcagatcatgaggtcaggagttcgagaccagcctggccaacatggtgaacatgatgaaaccccgtctctactaaaaatacaaaaatcatctgggcgtcggtgtgcgcacctgtaatcctggctacttggaaggctgaggcaagagaatttcttgaacctgggaggcagaggttgcagtgagctgagattgtgccactgcactccacactgggcaacagagcaagactctgtctcgaaaagaaaaaaaaaatgaaattgcttttaacattctattacatgtcaccttcccatgtatataactctgtattgtctaataggtctaagagtgtaaccagttccagtagcagtagcagtgacagttctgccagtgattcttcatcagagagtgaagaaacatctacctcttcctcctcagaggacagtgacactgatgaaagctcctctagttcctcatcctcagcctcctccacaacctcttcctcctcctctgattcagactcagattccagctcttccagtagcagtagcaccagcacagatagcagctctgacgatgaaccaccaaagaagaagaaaaagaaatagagttgctccattcatattggactgatggactgaaaacattgatgtgattcttgaaagggaatttagaatatgttaaggccaagtaggttaactggtgaacatttct

SEQ ID NO: 37774 - DNA, 1082 bp, Homo sapiens
taatccacagacccagtggaaagtacaactccctggggccccagtcgcccgtgtgggacccctccccaaggctgctggcctgctgggaagcagggatgccagatgaagagggaagacccaggctggaagctttgccttatctccatgccacagaggctcaaggactccccgatggccctcacaggagctctgcccccagctccattttcctcattcgcccagtgctggcggcagagggcatcagcagaggtgcaggcattgcgagtgccctctgatgcagctccaaacattctgttcacttagagcagcaaacagtctcacctgtctcctgctcatcatgggtacataaaattccctgttgtttattcactctcctcctcacagtcctggatggcaagacacagtaattaatcatcaggctgcttttgcgaggggccacaccctgctggtgctgcacctgggcagctgcctaacagattggctgccgaaggtttgttctgaggctgaattcttgatcttggccactctctcggggatggagagccatcagcacccactttgcacgcaggcctcactcccggcacactctcagaaaggccctggaatttattttgcccatttgaatacaaatgcaattgagacaagattctttttgtttcagaagtcattgcttcatttctgtttctcgtcaagtgaactgacagccaaagagagttgaaataaacaactctgtgcctggctgagccagatgaaataagtccccccacccatcactgagacatggtaccatcaggttgtgttaccagttaagggcttggtgctggtctttgggcagctctggaggcagaatgtcaggctttgggctacatctgtgccaggacaggctgcaggactagtcccagagttgggcaagctggaagacaggtgcctaccacagcaggacacctgcccctctgccctgtgtcttagaggccttttccttcagcatggatcctggggaagggagacacatgcagtcattcattcaggaaggggagaaagtggcagccaaggccccactctcaggagctcctgacccatct

SEQ ID NO: 37775 - DNA, 1057 bp, Homo sapiens
gcaacctacggaataggagaaaatttttgcaatctacccatctgacaaagggctaatatccagaatctacaaggaacttaaacaaatttataatagaaaaacaaccccatctaaaggtgggcaaaggatatgaacagacacttgccttcacatttctaagggcaaacaattttgtacctagacttctataccaaataaaaacattttcagtatacaagaaatgagatttcttgtatatctttctgatttaaaaagtgggggccctgtagtaccagctacttgggaggctgaggcaggagaatggcgtgaacccgggaggcggagcttgcagtgagtggagatcgttccactgcactccagcctgggagacagagcgagactccgtctcaaaaaaaaaaaaaaaaaagtgggggcatggagggtgaggagtgtaatccagcaagacagaaaaggaacctagaaagaagaagagctggtccaagaaacagaagagctaagccaggtatccagtgaaacaaaaccccggcaggacttgtgggacaactgtgtaagaaacctgggagagaatccattcaagttagaacagaaagtcagaaggttctgaaaagcaagtcttcaagaagaaagttaattccattgaacaaaaataagatgaagaaactggaagacctcagagatatgatgaagaatacgtatgtgctatccctcaataaattttttaaggcagttaaaaattctggagaaggcaaattgctaaaccagaaagacatcataaaatattaagcaaactaaaatatgtcacgattttgagcaattaaaggaagatgaagaaagagaacaatttaactatgaagcttaaaataatctccttcaaacagcacaggtgagtcacctgggctgacatctcccctgccgtgaggttcactgtatctttctgccatggatgagggttacatcatcagaatgttgataatgttctttattcattttcacttttagagtcaatgaatagaaacttacacttattacttatagttacagaatgtaatgaggtaaa

SEQ ID NO: 37776 - DNA, 1030 bp, Homo sapiens
aactcacacaagttgatatctgggtatagagtgtgatttttctcccattagggactccagaagagttcttgaaatagctgcctccccagctccacctctcaccccttgtgcctgcccaatgtttccagaaggcgcaactatagacagcaaaggtcctgtgtgcacctccccagagaaacccaaaccctcacacttctctggagccacatggccagatgaaacctctgagaaggaaccaaagccttgtctgtcctgatggcagaagttgcaaccctgtagggcttctcaacatgtgatctaagaccacagctttgtaacctaactcagccacggtcctagttaaaaaggcacattcctagaccctgcctcagaactactgaacagagtcactgggtgtggagtccaggaatctgcatttttacccctatcgcccccgccattcccgcccttccccccgccattgcgtgcactaattgctggaagcactcatgaggagagccgcctgtgttgtgtagaactcccacccccgcaacacacactcactcaccctttcacttaccaacagtttcctgggcttgggaggtctggagaaggcagtagccctgcaaattgagaaaggcaagcctcggaagtggactcttatatctctactgccaaaaggggctacatcctctcaggcccctgggttcattccttgagaacagggctcagctgtgggagctgataaaacaaggcacccttccagttactgagcaccttctggtggcccacactgtgctgggcattgcacatgagccgtctctcgtccttggggaagatagtagttgttatccatgctctataggtgtggaaactgaggcccagagaggttatgtggctggtccaaggtcacacagctgaagtgagattgtaacccagggctgcctgactccagagcctgtgtgttctccagtggtgacattgctggggtagtcttggggggcagtgtgagctagttcataggatggaagagtactgtgaggaatgttgg

SEQ ID NO: 37777 - DNA, 1070 bp, Homo sapiens
gataaacaacagaaatttaaaatttcggtggctgagaagtctaacatcaaagcactggccaagtcagagtctggtgagggcccactttctggttcatagatggcacctttcagctgtgtcctcacatggcagaaggggcagaggcctctctggggtctcttttatgagggcaccaatcccatccatgagaattccactctcctgacctaatcacctcccaaaggccccacatcctaataccatcaccttgggggttaagatttcaacatatgagttgagggggacacagcattgggaccagagcaatcccttcatgaaccctttaaggttcatgagagtagaagctgattcactcacttatctccagtttctatgcctggcacaaaacagggcgaggatcagagtgaggcaattgaggtgcgtgcctccaacacaaagacgcggtagttaaaacaaataatattttaatgcaatattttacaaatcaaaattaatgcaaaaaaatccatgatgaacaaaataacattaatgtccttgatgttataaaattttgcaatgatgtgtctgactttgtggttccttttgtgggtccttcagcctaaagacatatatccttcctcaaataaaagcaattataattttcttaagcaacttcctcttctcaggtttctgtctttctaaaaatcttaattgcatgtgagacctcctgtatcaatattttctgttacttttctcttaaagtgtctgttctatatattttattctatattctggaaaattctcttggctttatcatctgatctgagtattgaactttttgtttcaagactcatgtttttatttatttatttttattttattttattttattttattttattttattttattttattttattttatttttgaggcagagtttcactcttgttccccaggctggagtgcagtggtgcaatcttggctcactgcaacctccacctcctgggttcaagcgattctcctgcctcagcctcctgagtagctgtgattacaggcacgcgccactactcttgactaagttttgtattt

SEQ ID NO: 37778 - DNA, 1036 bp, Homo sapiens
caggatagtctggattatcagactgggtttatttttcttggcattgcagtctggcttcctgattatctttcaaacacacatttgcatggcatttccttccatactgagcagattccatcaacagtcttgggattccacttttcctttgcaatatggacgtttttgcatcagtttgcattagctgttagtgaaactggcactgcatctgcaggcagacatcgccagaccgcagcacagttcatcttcagatgttttccttttccatgttggtggcagcttcctttgctccttccctccttctcaagataaattccccaaagcttggacccagcactttctgcctattctcatggtttttgttggggtatgaatgccttagatggcacagagaggcattggagatttacagccctttttattatgactgcacttgagctgctgtcccagcagcagacctcttccttttgatgacaggtcaattggtcaattccgggttgctctgttggcttcttcatcagactgtaagctccatgtaggtagggtctatgtctgacttgttcacccttgtgaacccagacagtggtccagagcctggcacatagtgagcactcaataaacatttattgaatgtacaaataaatagaatgttctttcaagctgagcagctgactacctgtgatgagttcccttaaaaaagcttaatagctttttttttttttttttttttgagacagtctcactctgtcacccgggctggagtgcaggggcgcaatcttggctcactgcaacctctgcttcccaggctcaagtgattctcctgcctcagcctctcaagtatctggaactataggtgtgtgccaccatgcccacctaatttttgtatttttagtacagataggtgttttgccatgttggccaggctggtctcaaactcctggcctcaagtgatccacccacctcagcctccccaagtgctgggattacagatgtgaaccaccgtgcctgaccaatgcttgatagctcttgaatgatcagt

SEQ ID NO: 37779 - DNA, 1048 bp, Homo sapiens
agcctgaaccagcaaggtctgcctgcatgggaagctgcgccattacctgcccataaagggttccctcctgctttctctgtgagtctccaggcagatattcttcagcatctgctcccaagagctggctgtgaatgtgaactctgcctccttggttgttcagaagcacatgcttaagagaacaaattttcctacagcagcggctgctgaagtgtcctctttgtggccattgaaagaaactcttagaatgtctcatgaaattattttctggacagagaaatggcactacctggggcagacacatttcatttttaaaccaaaatttatggttactgtcaagggtaatattaatgttttaaaatccttgacaaagaaaaaggagaagagctagaaagttctttggctgaagttacccttcaaaccatgcctgaattgagcttgattctgaactgcatggcacctttccctgcagcaataataagaactgttacctaataaatacaaggtgcttacatttagaaagctctgagctgtcacattcacgatctcaactaattctatgacacctatgcaaagtaagaaggaaggaatccccattttacagaaggggaatatgaagccctcacactgacatcggttgcagaagtgtggctacatttcaagtgtcctgaccctgaccgctgacactaggctcttttcactgtgttatgttgttacttaagagacgatagagaccatgttgctgagcagcgtgtagaaagggcttccaccaagtgcagatacagcagtggaggtctagaaagcaggagaaattctctttatgttttggcaaaggcaggatgagaattctaagatgacctgttttaaaccttatagaatagcatatttctctttgacacatgatgattcttgtaaatgtaagagaataaagcttttctctcatgtgggctagtagatatcttctattcttccttcctcctgggctactgaagaaaaccgagatttcttaaatcttggtttaagaaaaccgagtgaagaaaaactctatttc

SEQ ID NO: 37780 - DNA, 1028 bp, Homo sapiens
cagaagccagggtcaggggcctcctgccagtgtcacatgtcaggtgggacccggattctcccctactggctgcataactttgagcaagttatcctctctgggcctcaatttcctcataggtcaaacagggataacactactttgctctgttttgtggcgcttcaatatgtatgtttgtgcctaagaaggtgtggttcaaagttccttctgctccgcccacccaccgccagctcctgctctgggatcactgacccctgtgagaccatcacttcagaccaggagctggggtttggcagggtgaagagggggccgtttctaggtttttgcagtaacacaactgtaaagggtcaccagggttgttttggctttcttagcacaagagatgagagtagcttgtgtcgggtgatggatttttcatagggaaacacgtttttcttcaacttatctcctcaaatgcgctttcagatgtggttgatgattaagctagttttaaagaaaatgaaggacagaacaggagagggaacgcctgctgcaattatgtccctttctcctgttcctcagagaaatcaatcccccctcctctgccgtctctctttctttcttcctctcccccaacctgtctctcccctcctctccctcccgctcttcatcactctccttcagtctctcactgtctctgtgtatctctcttccttgccctctcttggtctctgtttctccccgcccctcgtaccctgtcctcctctttacgtctctctctgatactctcgtagtgtgtctgtgtgtgtcagtctcttgctcccgatctctctctccttccttcccccaatcctgtctctgtctctcaggcgcctctgcccacaccttgcttattctcctccatgagcccgtgtttttaccgatggtcgcatgaaggccacatgttcatgagtgtgagccattctcaccgtgagtgccattcccccaggagctgggcctttgtacttcctgctcccttgggaatatgcccatttaccaatgggaagaca

SEQ ID NO: 37781 - DNA, 1695 bp, Homo sapiens
tttctaattgcaaacttcattagcaacaatggaagccagaaggcaattgaataatatcttctaaacaatgaggtaaaatagtcaacttagaattctgtttgagagtgaagggcaaagatactctctgataaagatttaagaggttactgaagaggttacataaactcttactgaaagaactaaaggtatatatactttaggaggaaggcaattgaccccagaagaaaataatgtaatacaataattgctagtgagaaagggaataggcaaaaacataggcataattataagtaagtgttgactgaagaaaagcattgataataaaatgactaatttggggtcatttaaaatatgaaacaagagatggtgatgatggtcagtactaaagaattttatgcttcttgtgttatttgagaagatactaggccttaaaaaactttaggcgttaagtcagaatgtatattgaaaatttaagggtaacctgtaaaagaaaagaaatagaatataacctctaacagaagagtctggaaaaaaagagttggataaataacattcagacagctcagtagattgcagttcagtagacagcagagaagtagacaaaatgaagcaaagtaaaggcatcataagtggtaataatatatagcaataaaaataatattaaataaatactcaaattaagttggcaaaaactgaatatatcagtaatatgttttagtggattggatttatctgttagtcaatagcaattttcagattgaatttttaaaatacacggatgtgctatttacaaagatcatgtctaaatataatggcacaaaatttgaaatgaaattaattgaaaatatatgctaacaaatactaaaagaaaaaattaggccaggcgcagtggctcatgcctgtaatcccagcactttgggaggccgaggtgggtggatcacgaggtcaggagattgagaccatcctggttaacatggtgaaaccctgtctctactaaaaaaatacaaaaaaattagccaggcgtggtggcgggcgcctgtagtcccagctactctggaggctgaagcaggagaatggcatgaacctgggaggtggagcttgcagtgagccgagatagttccactgcactccagcctgggcagcagagtgagactccgtctcaaaaaaaaaaaaaaaagaaaaaattgtttgtagtaacattaatatcaaagtattgtttaaggcacaaaagcattattgggtttactgcacagtgacaaaagaaacaattcactgggaacacataataatcataaacctatatgcacttaacacagctcctaaacagacataatgcaaagcctaggaacttatacaataacatcgacaaatttacaatctacaataatgggatattgtgacacatatttttataaaatgatgtcaagcaaacaaaaatttattaaaaacaatttttttttctttccaatttttattttaggttcagaggtacatgtgcaggtttgttatgtgggtaaactgcatgttgcagggttttggtgtacagataattttgtcacccaggtaaacagcatagtaaagatagttgtttttcagtccttacactcctttcatctgaactccaccctcaagtaggctctggtgtctattgttcctttctttgtgtccgtgtatactcaataaaaactggatatt

SEQ ID NO: 37782 - DNA, 1042 bp, Homo sapiens
cataaagacaacatctgaactgtgaaaatacaacaatgaccagtctcttacaggagtcctgaccctactcgagttcatattcacagggggagagcaggcattaaacaaataattgtaccagtaattatttgattgcaattgtgataagagctatgaaggaaaagaacagagggctgtgggcacctgactagtctggggaaatcaggaaggcttccctgaggaagtggcatgaaggccaagagctggtagctgagtaaaagttatctagaaaaagagagcccaggataggagtgggaggaagacgagagctctgggagctgagaagagccagcatgggttagggagtgaggggatacatgggacaaggtaatgcagtagaggtaggcagtgactaggtcgctcagagtcccagtgaagaatgttgagttgatcctaaaagcagtggtaagcatcaataggttgtaatcagggttgtgacttgatgaggtttatagttttaaaggattattctgttgtaaaaaatggggattatggaggctgagttaggaaactactataataacctagaagagcaacacttgtggtttggaatagtacaatggtaggcataggagaaatagatggattctacctatttttccctatgtttgaggagcgttttgatcagatatggtgacttactggatatggaaagtgaaaaaggagcttcagggatacttcctagattcctgcctttttcacctggacagaggcactaaacactaatacagggagtttcggggggaggaccaggtcttttgggggtaaatgattgatacggtttggctgtgttcccacccaaatctcatcttgaattgtagttcccataatccccacgtgtggtaggagggacccgatgggaagtaattgaatcatgggggcagtttcccccatgatattcttgtgatagtaagttctcacgagatccgatggttttataaggggtttccccctttgctcggctctcattcttctcattcctcccaccattgtgaagaaggac

SEQ ID NO: 37783 - DNA, 1035 bp, Homo sapiens
tctaaccaaagggatacataattaatggtagctcttgagacatcaaactgacatatcgactgtgggcctgttttgccagaacagcggaaaggctggggcacccgtctgctgggaagactccatgtaacagggttaaaaaggtaaagtttcagaggactttctgatccatgaagttagtggtgcatgtgtctgttcagggactcctcatctaaagcatttacagacatattagcaagattaggtgactccaaagggctgtgaggaggactgagtacagtgaggccaaattcagtcctgaaacctaacatctgccagtgcatctgagtgggtgcccagtgggtggcctcactcactagctgggccaggcagcgggatggctgccttttgtgtgcagaggcccatgggggctgtctgttggttgtgattttcctggctttagcgctatacgtttgaatcactgcagtattgtacaacccacccaggggcggggtggggggtgcatttctggagggccctctatgcacctgttagtattgcaagtacgggtccaaagagacgcagcttggaagaagcacacgttctgtggtgcccctgtctacagcaggcttctctgcgcgaagttgttttagccctctgttctgcaagttacagcatcttgaatgaggcaaagtgacacacgggcaaatggtgtgtattccctacaaactcctcagagttgacaccgctctcgcctttcttcttgcattgccagaggctgtgactctggctcttcactcttcagtcatcacaaagccttttccctttatcatgtcagaccttggaaaacccacagtcatgaaaatgatttatcttcctaaattgtcagtgatctcccattaggcttaggataaaatccaatttcttcccaggcctccaagggcttgtgtgatctcacctctgcctgcctgtctccgttcaagcccgtccatctctctctccagcttcccatgctccagacacgctgacctgtcctccttctgcccctcaagcaggaca

SEQ ID NO: 37784 - DNA, 1001 bp, Homo sapiens
tgtcctctgaatggtttttctccaggtactcccttgaccaaaggggagactccagggcccttgaccaaaggggagactcaggattggtactctaggactctggctggccagcccatctgtgaccggcctttctgagccaggatggccacaggtgacattgcccctactgatgttgttaaaggaggctctgaccttggttatcagagcaaatccagcgtatgtttaccgtgcaatgtacatttttgtcctgttgtgttcagagaatcagaagtccttatggggtagataaggcctggttctgacgcccagagtcctgtttatgagtggctcatgagaggggcctctgttctgtctagcagggtcttccttgggagctcttaagtaaccagtgtcctgggttaaccggaatacctccctccctggccttgttctacaatagaggctttgccgtgtgcctacacaaccaaaaaggaagctgtttctattcccaatcagatctggagatgatattgaacataattctctatgttaggaatgtagaaaatacacagcatggaggggataatgtggggcattttgtggtgactgtagattcctggaagttatttataatagttggcctatggggctgccaacaagtgcagaggcagttcttctttctacatgctctaagggagaatctatttccttgcactttctagtttctggaggctacctgccttcttggcttgtggccccacatcactctgacgtctacttgtctacttctgtcatcatgtctccttctccgactgtgaccctcctgcctctcttttagaaggacctgtgattgtattgagccctcctggatcttgcaggataatttttccatccaagatccttacctcactcacttctgtaaagtccgttttgcagtgtaagagaacatatgtataggtaccaggcctaggatgtggatatctgtggggccgttattccatctattgtgaggcatgccctgt

SEQ ID NO: 37785 - DNA, 1882 bp, Homo sapiens
catattctctgttttctcttttgcctatttaatgacttctgttttccagatttttcttctggttcaaagcaggaaatggcgtgatggcctttgttccaaaacagtggaataccatcgcctagatcagaatgttaatgaggcaatgccttctttgaagattaccaatgattatattttttaaagcactgtgatttgaatttgcttatgtaattttatttgcttgactttttatatgatattgtgcaaatgtttgccataggcaattggtacttaaatgagaggtgagtctctcttttgccttggtgctttggaaattaaatgtcacaaacgagtatataattttttatctgtacttttagagctgagtttaatcaggtgtccaaaatgtgagttaaacattaccttatatttacactgttagtttttattgttttagatttattatgcttcttctggaagtattagtgatgctacttttaaaagatcccaaacttgtaactaaattctgacatatctgttactgctgactcacattcattctccgccattcaaatactattttttatccacatttttttttgttcccaaactgtaatgtacaaggatatgtgtgataatgctttggatttgagtaatatttttttttcttccaagaaaactgctttggatatttttagataatttaaacataatttaggataatgatattgctcaatctgaccacaattttaggtaaaacattaaatgtgtcaagaaatcttggcaacagagactctgcagcttgcagtggacatagataaaatgttacagagatactatttttttggttggaattactatattaaatttagaagcagaaactggtaaaatgttaaatacatgtacaattgcttttagttagcaattgattgtagcatgggttcctccaaggtttcaagcaatgggcagagtttaaaattatatcagattcgtttacttcgtttattattttacagtaaatttgaataaatcttaggggtcattatcacttaaataatactgtacctaggtctttcaaattaaaattatacctgaatgaagttgtttgtatacataaaggatatttgtgtacaattaccttttttcccccacacttgttttctttgtttttgttttttatggcaactggaaagtatttactatgggattcatttatgtctgtctttctatcataaagaattgatcaatatgtaaatatgtgatttgaaccatggttgacttacaagtgtcactacagctttttagaaaacatagccctaatatatgttaagcaggacccgggtgagccagtgggcttgcgctttatgtagagctggaagaaggccgtccatcctgtctcttgggcggacagtgtactttcctaatagggaagggaagcacaatggaaatacccctgaaccgttttattgcagtaatttttttcatatctgaaactattatttaatattttgaataagattttaaaaaataaatggcaaagatataaatctatgatttcacgagtgtgtttctgtgtttcatttcagtgatgacatttaggtggtgacggggagtagtgtatgtctgggagcaatctaacctgattcacttgcaggtgtccctctcagcagtgcaactctgcctctatgaattccacttacattgctaaattcttctttaggtccaacttactgcgaggtactgaagtttattgaaaactgtagcaaagtaggatggcaaagaaaagcaaagtggctaaatcagtgtgctctttctagcatcctggggtcactatctgggatggaaggctccccgagtgtggaggctcatcccccttagtggattgggggattcttgggtactt

SEQ ID NO: 37786 - DNA, 1275 bp, Homo sapiens
ctctcaggttcccgtttcggatgcttctcctttagaagttttttcttctttgtaaggatccttctttttttttgaatttaggagagggagtcctctagttcaagtatcacttagaattactatctacagcatgcctatagcttcccctgaatttgttatgttgtgttgaaagtatttaggtccaaactccatatcttttttgggacctacttgagtgagaatcagccactttttggtctgttctagggatcaggtaaagtctggacaaggtaactgaaatccacaccctttatgaaatgaaaacagaggggatgggtgagggctgtatgtgaactttgccatcgtgacttaaagtcagccctttttcttttcttttggtggcaggctgtatgatgcagtaggtcttttatgctgcttaaattgttagtatctagcaaagcaattattatctgaagaataactgactaagaagaaatgtaactgaatgctggctattgagacttaataactagttttcgagaaagttataggaatgtagcagagagaaatgcttagtgtaaaatttgggtaaatatgcttttagcttggtggagataaagttggagatttcagtttgatattctttgtttgtttcagttgtatcacggactgattcaccgagcccaaccgtactcaactcacatatttctaccccaaatgtgaatgctttaacacatgaaaaccaaaccaaaccttctatttcccaaatcagcaccaccctccctcccacgacgagtaccaagaaaagtggaggagcatctgtggtccctcatccctcgcctactcctctgtctcaagaggaagctgataacaatgaagatcctagtatagaggaggaggatcttctcatgctgaacagttctccatccacagccaaagacactctagacaatggcgattatggagaaccagactatgactggaccacgggccccagggacgacgacgagtctgatgacaccttggaagaaaacaggggttacatggaaattgaacagtcagtgaaatcttttaagatgccatcctcaaatatagaagaggaagacagccatttcttttttcatcttattatttttgctttttgcattgctgttgtttacattacatatcacaacaaaaggaaggtaggtttgggatttttttagccctttattatttcagtcataatgcttttgatgattcatggttcttttttttttttttttttttttttgcaaaaaaaagtgtagtgggttt

SEQ ID NO: 37787 - DNA, 1108 bp, Homo sapiens
atcgttgaagaatgggctgccgcaaggaatggcggtggtggggtctccaaaatttcttggatcggaaagttaggagactctggaagagagggtggcgacaggggctgaggaggtggccggggctgggggtgtggtgtctggaaagggtcctgagtttgggggactcaggaatcttgcaggaccaaggaaaggtgggggttttccagaatgggagaggtcagtggtaaagaccgaggcgggcaggggcagtaatccagtgactggactgaaccaatggaatatttccgagagggaaagtgaaagggaaagagctgtcttagggtactggtgcatatttgaagactgggaggttctggtgtttgataaagattcagagtactggggcgttgggcccctgaaggcttgggaggcagagaggagtttggagacaagggagatcatgattcctcttccctgtgttccgagttaaccaggataaccctgcctcgttttaatgcatctgtaggatttgattgataaaatatttcatttcttgcaaatgttgcatggtgaaatcaagagattgaaggcttttattgagaaattaggaaatctgtaaaccagtgcctgatacttggtgggaaaaatccactattaagaacttgtaaggattaaacggtattttgtttagtagtcccatttttctttcaggccaagacacagtcctgcgtttctccctaaatttgaattttcagctgcaaaacagtgtgacctggtatagtgttttctttcttgccagcagggcctgtccagccctacattcctctgcgacagtactgtgggtacatacttatgtttcctcagcaacatttcagtgttgctaactggacgccctcccagaagtctttgcagtccctgaggaaggactgctgtccatttcctaaggcccttttatcattagtgaaatgtaatgaggatttccctggttgatgcagatattcccgttcctaaagtacttaagtagcttaattgttttggccatttaatcatctaagaaaaataaaacacaaacatttatatttcctgctggaatgcttaagggatatatatctggcaactgtagtttcag

SEQ ID NO: 37788 - DNA, 1043 bp, Homo sapiens
tctcctaaactagaaccgaatttggctcccttaacagcaagcacttaaaaacaagagaaaaggagcctcattatttatatgagcaaaaggacactggcccctaagaggccttccttctctctgctttgttcttatgaggggtgtcagatctcagcacaccctttgaacagaaaggtatgcacctaaaattgatgtattttgtattgaatttaatgaatctcatgaacaaggtggtcatgaaaaattttgattctaaagtccaaggttggttgactaaaaagctctaattttggagatggaagtgcaaagtattatacttaatgttttctctgttttgtcatttccttgattaggctaaagtgaacaactccagcctgataggtttaggatacactcagactctaaagccaggtatgtgttgcttgtgtgtgaaatcggttctttatcttaaaaaaattgtggtgctggtttgctgatttatgtcattgcttataaaatgtttatataatacagtgggtatatataaatggatatatgtaaagtataattaaatgtttataaaggagtatggggtcattataaaacatttggagaatatgagatgtagcaagcaggaggaaaaaggctgaggctaacacatattctttgctattttcttccatccttttttccagtgtggacataatgcttgatacttatttctggcagattctcaaaactaacttataaatcagccccactgtaaaaagacaaagaaataggaaaagtggtttgcaggtttcctctgcacagttggctaggccagtccacggcgtattatagttctagtgtataaccacttttgaaccctggaaatctaagactaccagctactccctgaatcaggttattccagggaatgtcagtttgttgtgtgcatctgtggatgtacatgcacactacacatgtgtgtacactatgaacatgaacatgtaagaccttaggttggattcaggattgaggtttcatttaaagggatgattgccaaagaagcttactgcatg

SEQ ID NO: 37789 - DNA, 1045 bp, Homo sapiens
actagagtttttgttcttaggtcctgaagccctttgctggattccaaagtacgtgggctctgactcacagttaaccaatgccatttccactggaaatgcccacaatgatgaggcagaactcagacactgattttatgttaaagatgtttgagagggtctaggcaggcttgaagaccatctgatgcaaggaggatggtcattcctttttaaaaaattgcagcattaaaatttttcttaatttttttaatcaaaggagtctgaacccatggttgtaaaatcaaacagtacagatgggcctatgaaaagcagtgattccagcctgcctcagcctgctcatcccagctccgcagtggcagccactttaactgtttttgttttctgtggttccctccatggagaaggttgcttctgaccaggcaccagtatgcactgtgtgtataaacaacaatctgaaagcagtaatgagagacagtctatgatctgtgccgaccccagcccgacagaggacaaagtgtagactctgagctcttcgtatgcctttttaggggtggcagtgactgcagagtttgtataggctgttcagctgggtggggcagactttcaaattctgagagcttaagcagggccccaaaagaggaagaggagaatttgaatgactgaagaagggaaagggatattcccagcaactggagtcattcagtgtgtttgtaagagaggagggagcttggccagctggggtttcattctgaatgtttttgaaagagggagacattttatgatgtagcaaaaagctccctttcaaatcctgccaggcttagatgttgcagcatgggtgaggagtatgcataggtggacgagatgaattgtggattaagctcttttgaagtgctgctcctccaagaggctgggtcagtgccaactgtatctccccagcagtggctgcagcaggttgtgccaagggctctaacttgccttctgaggcatatgtgcagccccacctttcttgccatttctggctgtgttctcttctcattttcttctcttt

SEQ ID NO: 37790 - DNA, 1259 bp, Homo sapiens
tataattcttttttttttttttttgagacggagtcttactctgtcgcccaggctggagtgcagtggcgcgatctcggctcactgcaacctctgcctcccgggttcaagcgtttctcctgcctcagcctcctgagtagctgggattacacacgcccaccaccgcgcccagctaatttttgtgtttttagtagagacggtgtttcaccatgttggccaggctggtctcgaacttctgaccttgtgatccacctgcctcagcctcccaaagtgctggaattactggcatgagccactgcgcctggccccgagtgtcattataatgcctagaataaacatactgtttaatatgtttcagcctattgctaatatttttcttattgaggctcacattgctccattgtcgaagcccttgggagcctcttcaggttaccttgtaagtccttttgcctccaccccagtagtcttcaatagctttgatagatgttttaggttactgtgtacatttcctgcctaagatctgtagttggccatttctccaaggagcactggttccatttaggaggaaatggtctaggtgctgaggatgaagcattaatctcaatgtgaataaagctagaagtgaacagtgctgtgtagtccttgaggctctgagtggatctggttcctcctgtggtctctgctgagaatgcagcttcctgtgggagatgtcgatcttgtaactgaatgatagagacaatcagataaaaatgatccatgttgtatttgttggatgtgatcttgttctccagtgtgtacttttggtaaaagacatggtaataataggtctgcaggtgacactattcacctgctcttcctaagggatgctgggtcttgaggaaccggcagtagagacactgaactgcttatagactcacatctggtatcatcaggttggacctgggatactgtctggctaactaacacttcctggcccccatgactgcagagttccaggttctacatcagtacccggttctctgaaatatgtactcattggggtctcatgaatatggaattgaaatccattttactgttgtactcacttagagggaacatagcctttgtttccttacttaaccatgtgagccacagagtaagaagaaaaccgtctctttaaaagctgctatttaggtagctgccttcatggcagataaatcttttccacaggtttggaaaatatcaaagatgcatctgtttcataattacatggtggctttcta

SEQ ID NO: 37791 - DNA, 1053 bp, Homo sapiens
ttgaggtcaggagtttgagaccagcctgggcaacatggcaaaaccccatctctaataaaaatacaaaaattagccaggcatgatggtgcgtgcctgtagtcccagatacttgggatgctgaggcatgagaatcgcttgaacccaggagacagaggttgcagtgagctgagatcgcaccactgcactccagcctgggctacagagagagactctgtctccaaaaaaaaaaaaaaattgtggtaagatatacatataaaacttaacatctttaagtgtgtagttaaatggcactatgaatttttcagttttgccattcattttttttctttcttccttttttcctttccaacagatatttattagagggaggatctaccaagtgcagacctgtgctgggtgtgcagtgcacacaagtgactgggcacacatggttcctatcctctggagatgtcgtcttatagcttggctatagatgatctgaagagaccattgttacggggctgatttactctcattcctcttcgctgctgtagtttctcctgcaagagcactgcctttttgcagtgctgtgcactctccccccaggaactctgccatggtatcagggagcggttatctggaaagatcctgggataggatgagaggctggaggatgtgcccacatgcttgaatttgctgcctgggactttgcctgctgccctgggatagcacactttggaatttgtaggtgatttccttcccatgaccttagggagctttgcagaggtctccaggccatgcagtataaaacacaaaggaaagttttttggttttttttttttttgggttgagggggacggagtcttgctctgtcgcccaggctggagtgcagtggtgtgatctcagctcactgcaacctcctcctcccgggttcaagtgatccttttgcctcagcctcccaagtagctgggactacagacacgggccaccatgcctggctaatttttgtatttttagtggagacgggggtttcaccgtattggccaggctggtcttgaacttctgacctcgtga

SEQ ID NO: 37792 - DNA, 1031 bp, Homo sapiens
tcaggctggtcttgaactcccgacttcaggtgatccgcccaccttggcctcccaaagtgctggaattataggcatgagccactgcgcctggcttatttttatttttaaaaaagattttagattcagggtgtacatgtgcaggtttgttacatggatgtattgtgtaatggtgaggtttgggcttctagtgtacccattacccaaatagtgaccattgtatggaacgtgggaatttgttgtagatcaacaaataactgtcgtgacctggcccgcaaagccaaaagaaggtacttttttttttttattctggcagtttttgtggttttcacattcattccattttctgcatgatgggtggtccaggggaaccatgccagtaggcccccagttcagcagcgggtaatagaggagaatgggtcaggtctcagttttagttttccttgtgcttcttattttcaaattcacctgcattcaaccacataagtgtttttaaagtaatcttagtagtccctttgaaattatgtgtgcagtaattgttggaagaaagaagttttgggtttgaattaccgctgtgtcagctttagctcagtgctttttctctgtactgccctggagccaggatggaagggagatgctttcctgtccagactgaagagttacagggaggaaggaagctgtctgctgacaacaaattccccataagatttctttacatagcaggctcctttactcccatctgtactttaaatatctatttgaattgtagagttagccttggcccccccacattcagggtcttgcctcttgcagaaaggcaagtatagtgtttaggagtgaagtgaagccaagtgagtgctatggtgcaggctgtgactcttctctctcctttgaaggaatttacaagctcaggctcagccaacactgagaccaccaaagtgacgggcagtctggaaaccaagtacagatggactgagtacggcctgacgtttacagagaaatggaataccgacaatacactaggcaccgagatt

SEQ ID NO: 37793 - DNA, 1034 bp, Homo sapiens
ttcattctctggttttccaagtcccgagggaaacttgttgaactggtgtttctgggcttgcagggagggtgacatgggtgactgggattctacagaaggtgttgggcctgttaccccttccctcatggtgggtggatggacagcttgtgctggggttgtcctgagtagggtgcctgcctgtgggtagtggggactactccttgttgattatttagttttatttttgctattctagagtggggctataggcaggggttattcgtagctcagaaagtgggggaccatacagggatgaggtgcctgtgggcccctggccttgctgaacactaggcaggtgtggacagtgaactccatgctggggaggtgaagggcatccaacctctacccttaccaggaagatgctcctgaagcactgaagtccacttcgcctttgatggaatttcccgtggtgtagtgtcttcggtggtagtgactggaagaggcgcatgtgtggttgaggaccagccgaagcttggaggcagcccctcctggtgctcagagattctgtagtctgcggctttgggttttccatggagtcctgtggtagccactgagaaaagttgaccagtgggctcctcagctgggtctgggcgcatttctccattttaccacgtactcagggggtttgggatgagtgggactttaagttctttactcagaactgtgctggaaagagcactggagagtagcttaggcccataacacaggtctggtgagccatagggtcggtctcatacaggtcaagtcactgtcttgtgcctcagtttctctctctcttttttttttttttttttttagatggagtctcactctgttgcccaggctggagtgcagtggtgcaatctcggctccctgcaatctctacctctcgggttcaagcaagtctctgcctcaccctctcgagtagccgggattacaggcgcctgccaccatgcctggctaatttttttgtattttttagtagagatggggtttcaccatcttggccaggttgg

SEQ ID NO: 37794 - DNA, 1057 bp, Homo sapiens
tctgccctcagaggaaaatggagcctagtggtcatgtgtacctatttcaggttgaattgtcttgtcagcctttatggacggcagttggcaactcatttattcttatatgagcactggggagcaggctggcctgcatcattgtggggttaagagcaaagcttggaatgggagtataggcatagctctcaggtgaggcaggcagggcccacacccctttaggggagatgacaagtgtaatccctggtttctacaggctggaggtttgggaacatatgtaccataggaaacaaactccaagtttcctgactgtggagaaggaaaggaaagaatatcatgctctgttactgaaacagcttattcctcagggtcaggctttgaaaaacaaacccagtaaaaagtatctttattctcatgtttaaaagtttttctatgatgatgcattaacaatacaaaaatattttgaacactacaataatctttttctcaagacttcttgcagtgttacactagaatatgtgatctttggattctgagaaaccagtggctaaagtaggaactaaaggctttttttgaggggtgtgtgaatacatggacagcccttttttttttttttttttttttttgagatgcagtctccctgttacccagactggagtgcaatagcgccatctcggctcactggaacctccgcctcccgggttcaagtgattcttccgcctcagcctcccgagtagctgggattacatgcgcgcaccaccacgtccggctaatttttgtatttttagtagatacagggtttcaccatgttggccaggctggtctcaaactactgacgtcaggtgatccacctgcctcggcctgccaaagtgctgggattacaggcgtgagccaccgcgcctggcccggcagccctttttctttggatttaggcaaaaaacaaaaattaaattaaagacttgtttttcaaggctgagggttgaagcttggctcaaaaatgggttaacgtaggctatggtgaaaacctgttgtccactactggaggttttctgggctcctt

SEQ ID NO: 37795 - DNA, 1245 bp, Homo sapiens
gaagagctcttgttaatgtattaacagttactagttttggcacctgcaactttctgtatagaccatacatatctgacatcagaaaagcaggccctagagagaagtatatactagggtactttagagcaacttaatgaggggaggaaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtgttgttctaattttccatctgttcttctgactcaactcactggctatcgatgaatcagtaggtagtatttataagtcttaggaaagactactcaagttaaggtacttccctatatccatctcttttaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattatt

SEQ ID NO: 37796 - DNA, 1041 bp, Homo sapiens
ttgcagtgagccaagatagcgccattgcactccagcctgggcaacaagagtgaaactcagtctcaaaattaaaacgaaaacaaaaacctttcgctggccaggcacagtggctcatagctgtaatcccaacactttgggagggcaaggtgggtgaattgcttgagttcaggagtttgcaacatgatgaaaccttatctctacaaaaacaaaatacaaaaatgagccaggtgtggtggcatgcacctgtagttgcagctacttgggaggctgaggtgggaggatcgcttaagcacaggaggtcgagtgagccatgatcgcggcactgcattccagcctgggtgacacagtgagatcttgtctcaaaaacaaacaaacaaccctttgcttggcttttccttattgaaattgttctttctttttttttttttggatcctggcaatgtttcttggctctgccattttctctcagcattgtttactcctccaacattttgctatgaaaaagttttagccatacagaaaaatggaaagaattacacagtagacaaccatgtagccactgcctagattctacaactgaaaacactttcagtattgattttggtctttatgctggtatgtatagtctaagtaatcagcttcctgaaactttatggagtaattattctcctattaaggaaattttggggcttttcctgctttgttcctacaccaaatagtctcacacatgtgtctagggtatttggaatttgctggttacaatatatgtacatattcagcttttctgaggagtgctggattagctttcaaaggggttataccaatttatactctctagaagagtttgtgtttcctttccactattgcccaacaattagtatcagtttcttgattttttttcaatctagagaagtatctgtagtgttagttttgcttctagtaaagttgagcgttccttatgtttggctattcagatttcatttattggctgtacatattaacccatttctctttaatgatttttgaaagattttatattct

SEQ ID NO: 37797 - DNA, 1026 bp, Homo sapiens
agctacttgggaggctgaggcaggagaatcacttgaactcaggaggaggaggttacagtgagcccagatcgtgccattgcactccagcctgggcaaaaagagcaaaactccatctcaaaaaacaaaaacacctcactgctgtttcctaagtacatacttaagaaaattgggatacatggtggtggttcatggatgttgataaggaattaaaatgtaccgtgcgactctctgtttcagtggtgacttttacctgtttagtataaatattcctttgcttccaaccataaatgtgttcttagaaatgggcctatagtttagtaacctatagtttggtaataggcttgtttgttttcagatggattttggttctgtgagctaaagctattttgcattaaagccttcgtcctcacacattgttttgacatatttctagtcttcataaacttttttaatttagatttttttcccttcacaagtatacatctgttttagcaaatagccttatgaaggttgtagatgtattattttgggcatgcctggtgatttctatattttttccaattacatttaaagctttatgttttaggaatataagtacattttatttctactttttattatatatatttaattgcacaagtactactgtctagaaaaaaatgggatgttgctaacacagcattgttggcttgtaggcagtgctgtcctgtaaatagattgaaatgtatttttatcagctggtatataaatttgaggaaagaaaaatgtggactgtgtttgaattgtttaaaagttgaacatacaaagatcagtggtaaccaagtaagtgatataggcaacagaccccagtttgttttgtatttgctgtcatgcctggaccagaattcctcattcccaagagtgaaagaggaaataattatagctaatgagtgaatgctggaaaaagtcacacttttttgttttttaaggaaaagcacaaaccctcatgtctgaggttgaatttaattaagtgcagtcggccctcca

SEQ ID NO: 37798 - DNA, 1005 bp, Homo sapiens
ctttcagaatgttgaatgagccttggcttcaactgaaagtcaccagctacattagcctctaacaagagtcagcctgtccgttgagggtttgagggcaggcattgacttctctagctagtaaagtcctaagtggcatcttcttccactagaaggctatttcgtctacattgaaaacctgttgtttagtgcaaccaccttcatcacttatcttaggtagatcgtctgggaaacttgttgtagtttttatattggtacttgatgccttatcttgcccttttatgttatggaaatgggttcttaaatctcatgaaccagtctgctagctttaagcttaacttctgcagcttcctcacctctattagcctttatagaattgaagaattaggacctacctctgaattaggctttggcttttaagcgaatgttgtggctgatttgatctatccagaccactaaaactttgtccgtatctgcaataagactgtttggcttacttactatttgtgtgttcactgaagtagcatttctaatttccttaaagaacttttcctttgcatttataccttagcagtttggtgcaagaagcctacctttaggcctgtctggagtttccatatgccctctcctaagtttaataatttctaacttttcatttaaagtgagagatatgcaactcttcctttcacttgagcatttggaggccattgtagggttattaattggcctaatttcaatattgtgtctcaggggatagggaggcccaaggagagggagagacagaatggccagtcagcagcagtaagaatatatacgacatttattaagttcattgtcttatgggcacggttggtagtgccccacagcaattacaatagtaacatcaaagatcactgatcacatatcaccataacagatacaatagtaatgaaaaagtttgaaataattttagaagtaccaagatgtgacaaagacaagaagtgagcacatgctggtgggaaaatggtg

SEQ ID NO: 37799 - DNA, 1029 bp, Homo sapiens
aatgggcatagaaaatttctggctatatatttaaaaaataagagaaacaaaatgccaaaaagttacttaaaataacagtttaaaatagtttatacaaatacttcagaacatcatctagctcttaatgatcagatgttcaaaaatattcatggacaacttgtataagaggagaaataactgatggtaaataaacatggaataaaaagtttgtactcagaaatgaaaaatgccaattaaattagtgataccacattgtatatctgaaatagctgagaatgagtatattctttcatttattattgtataacaaattggcataattgagttttatagtacatatgaaacaaaaaaagttaatgctattttgccctgtaatcccacaattaaagctttttgaaaggaaataattcaaatgagcaataatactgtacacgtataggtctatttagaagggcattatgtagttttaaaaaatcactataatgtagaaacgagttagtatgaaactttaggacacaaaatgagatgccagtcaattataagtaagaggtctgtgtgggtaaaaactgaaaggtaatagaaatgagaagagttctggttggtaagaataagatagttatatatcttaaagctttcagtgaaatcttaaccttttaattttttttttagcctttttttgttagttttgagagagagtcttactgtgttgcataggctggagtgcagtggcacgatctcagctcactgcaacctctgcctcctgggttccaataattctcatgccacagcctcccaagtagctgggattacaggcctgtgccatcttacctggctgatttttgtatttttagtagagatggggttttaccgtgttggccaggctggtcccaaactcttgacctaaagtcatccacctgctttggctcccaaagtgatagaattacaggcgtgagccactgtgcctgggcttttcagcctttttttaatgcaaagaattgtgacatggttgtaatcattttgtgcttttat

SEQ ID NO: 37800 - DNA, 1051 bp, Homo sapiens
actctgttgcccaggctggaatgcagtggcacaatctcagcccactgcaacctccgcctcatgggttcaagtgattctccagcttcagcctcctgagtagctggcattacaggcatgcaccaccatgcccagctaatttttgtatttttagtaggggagggggtgtttcgccatgttgcccaggctgttctcaaactcctgacctcaagcgatccacccaccctggcctcccgaagtgctgggattacaggcatgatccaccgtgcccacccgaaaccacttgtaatatacctttaggagaatgcttttagttacatcatgatccctttcatgtagctaacaacaaaaatgaatattaaccccaaatattggaactcgtattttgaagcaagttatttcttggtatactttagtgccagaattggtactgttatgtgattaactgtttttgagactaagaaaatattttgctggacatctgatgaaattatcttaaaaacagtgcttgggtgttttccctggagtgtagtggcaagagtactctgttgtccatcagagccacttgctgctctcagctggccttgctgttgaatggcataatctgatttcgttggagtacccaagtcctaagatttgaagaataagggttattatctcagtctcatcttttctctgagatagcatttgttcaggaaatgttatctgttttcaatggtgaagggagtgagagtctgcttaggagttactgtatacattaaacattggtgaccggactttaaagaattagaggctaggcctggtgacttacacctataatcccagcagattgggaggccagggcaggaggatatcttgagcccgggagttcaagaccagcctaggcagcatagtgagaccctgtctctacaacaaaatttttacttttttatttttatttttatttttattttttgagatggagttttgctctgtcacccaggctggagtgcagtggcatgatcttggctcactgcaacctccacctcctgggttcaagcgattctcctgcctc

SEQ ID NO: 37801 - DNA, 1085 bp, Homo sapiens
tgcagtggcacaatctcggctcactgcaagctccgcctcccaggttcacgccattctcctgcctcagcctcccgagtagctgggactacaagcgtccgccactacgtctggctaattttttgtatttttttagtagagatggggtttcaccgtgttagccaggatggtctcgatcttctgacctcatgatccacctgcctcggcctcccaaagtgctgggattacaggcgtgagccaccgcacccggcttccataattttttcaacaatgttttgtagttttcaaagcatacattttgcacttgttttgtaaaatttattcttaagtatcttattctttttgatgctatcatgaatggagttttcttaatttgatttcaaattgttcattgcacgggcataaaaatacaacttatttttgtatattgagttcatattgaagtggtgtcattgtctggagtaaatacccagggttcgtcatctcgtgccaaggagatgaaggacatggacatgcatgaggagtgagtttaggagcagaggtttaataggcaaaagaaagagaaaggagaacagctttctccctagtgagaaagaggggcctcctaaagcaaaatctggcccgcagcagactgcattagattttataggcaggtttgaggagatggtgtctgatttatgtagggcccacagattggttcgaccaggtgtgacagttacatactgcaaggggaaggctggttgccccactctaatcttattatgcaaattggatctttgcctggctggggccatattgtcttcttactctacatgtggtttggcaaagagaagggaagatggagccaccattttgaacatgcttagtcccaggtagccttttcctgttggcacaactgctggcattcacctgtgcaagcttacagcttgcgtgtctgtgtctgcagcacaattttacaggctgctttttgttagaaaagaaaatgatttggggctgcttttcattaaaaggaaaaccttactgaggatcccgtaccctcactgcctgcctaaataatttcttcttaactcatatcattatcatgcaac

SEQ ID NO: 37802 - DNA, 1039 bp, Homo sapiens
tgttgcagtaggaactgccgagtttcccatttcctggaaaaatggtaccctctttgtgaagactggcaaataattttaaattgtactgttttaggtgcaaaatttagccaggcgtggtggcatgcgcctgtagtcccagctactcgggaggctgaaacaggagaattacttcaaaagtagcatgatctcggtctaacataaaacagcagcctaaaatataaataatcaatcttgagcataaagagataaaagtatgtaatttaatacctgatttaatagaatacatggaggaggataattcttgtgcctttcctagaaattattattgtgttattataataatatgtaatattaatgggtacttactttctgccagaaactgttctaaatgctttagatacatcaaataatttaatccttacaacaaccctatgatgaagttgctactattagcattctcattttaaacagtagaacactaagacacagaggtcaagtaatttgcctgaagtcacatagctgcttaatagcagaactgaaccaggattctaacccaggtggtcaggattcacaatccattcccctgggtaccttttcaactgtacctaccgttgataccctgtacagactgtctctgtacctcaattacttcatctataaaatggaaataataataggactcacttcataggtttgtgatgaggattaaatgatttgatatatgctcaataaatatctactcttactcaaagtcctcaaaaattttttctttatttcttttttgcctctggacataatgtagcctgcataagatctctctgtctcagttttaccctcatttgatgatgtagcttaaattccttttctgatatactccctagccccccaatcctagttgacatcttttagtacattatctgtaaattttgtgtcagttaatatttaacatgggctagttctttctctagctcttttttttttaacctcccactaaaagttaagttcctcaaggataggcataatctcttgtattctgcat

SEQ ID NO: 37803 - DNA, 1009 bp, Homo sapiens
tattgattataaaatggattacattttcttaaaataggaatggaagcacattggttgagaaatttcagttgaaatgcatggaacataggctgggcatgatggtgcacacctacaattccaggagttggggaggctgaggcaggaggatcacctgaggtcaggagttcaagaccagcctggccaacatggtgaaaccctgtttctactaaaagtacaaaaatgagctgggcatggtggtgcacgcttgtaatcccagctgttcaggaggctgaggcaggaggattgattgaaatagggtggtggaggttgcactgagccaagattgtgctactgcactccagcctggcgacagagcaagactccatctcaaaaaaaagaaaaaagaaatgcatggaacaaagctaagaatatgactgtttctttacaaaatttacacgttatatgtacaaattgttaggcttgaaataattaaaaatttgtgttgtttcttttgtcaatagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatgtaagtgcttcagaataagccaatttgtaggatgaatatgaatcataagtgctccttatacattgttttatttttatgaaggtggctaacattctttttctatacaataataatagacatcctgaaaatggggatagggaatagggggcactaccttttagttgcagaaccaaaaaatattgagcactcagtaattccaactataaggcagaccaagtatgggatggtaaaggcagtatcagtaattttgtttagtagaatcagtagtcagctggagcactattattagagaaagtatattaaaacattgaaag

SEQ ID NO: 37804 - DNA, 1041 bp, Homo sapiens
attatggagaaacaagtgtaatactctatcttatctacattttgtaattttatagtgatacaagatatatgtgttttggggtatgtaacaaaagctacaccaatattgtttaataattattcagaaatattcaagtataatacttaataaaaatttctgctatgtgcaaggcatggtgctaggtactgagactataaggaggtaaaagatagttcctgcccttaaagacttctataatttaatcagaaaggagagtatatgaaaatcatactgaataaaaagtggctcataataaatgccaaggaatcaacacaaagtcctttccctggtagggaaagtttttttgaggaaatgggacatgaatttggctttgaaggatgtggagggtttagataagagggagaaactgttgtgttctaggttagaggaacaacataaactcaaaagagactaaagaaggacaaaggataaagggcaaagtggaaaggacaaagagcaaagacatgtgcctgtagagttttctgagcagaattggaaagaggtatattagaacagtaaattggaggtagattttaaagtcttttaggctaaggagtcaaaacttgattttgtaagaggtggaaagtcgtgaaggttttgaattcagtgtaaagaaatgtaaattttaatctaccactattgtgcagaatagattggaggactaagagtaaaaataggtctgttaggagttcaattaaggaattttggaaaatgtctgaggacccttgctaaaatgcagcaatgtgaatgaaaagtaaagttagaacatgctgtattgtaaaaaacaaaaaaaaaagacatgaggccgggtgcggtggctcacgcttgtaatcccagcactttgagaggccgaggcgggtggatcacctgaggtcaggggttcaagaccgtcctggacaacatagtgaaaccccgtctctactaaaaattaaacaaaaaaaattaaggccgggtgcggtggctcacgctcccagcgctttgggaggctgaggcgggtggatc

SEQ ID NO: 37805 - DNA, 1056 bp, Homo sapiens
aatttagctcattttattgaatttagatacacacataatttcaactagactatctgatgtttgtatcaactagactatccaacatttgtaactaatagtgtacaagtaatgtaggtgtcacagctcccagcagagttgaaaggcactttgttgggaatagggaaaattcctaggaaacaatggaaatgaagccctctgggtggtgaccaccatcctcctaattgaaaggtggggacaaaagtttagtagcctgttgattaaaaacaaagattctaaaacaaagatcctaaaataggctctatttctgcagagtcccttatacagggttcaactgggggtttagttaattgacaaaagtcaagacctatgtttataaagcctcttaatttatttaaaattagacattaaggctcaacacttttcttgcttctacttagtaaacaaattaagccttgccttggaatgtggatttttattctgggggcaatatggagaacaatttgagatttttttttttttttccaagacagactctctgtcacccaggctggactgcagctgcaatcatagctgcaatcatagctaactgtggcctcaacctcctggagtaaagggatcagcccacctcaacctcctaaatagctgggactgcaggcacacacaccacatctggttaatatttttattttttttgttgttgagacagggtctcgctatgttgcccagactggtttcaaactcctagccccaagcagtcctcctgccttggcctcccaaagtgctagaattacagtatgagccatggcatctggcctaagatgtgtattaaagtcactgagacttcagtgatggcaatatactactacaaacaagctgataatgttataaaaagaaactgaatagtttttttgcttgattgtattgaagaggtttgggataatgggtaacagattcctttagtcaaaaaactttgcatgaagcatgtcatatggatgtcatggtgaaagatcactggaggttaggtaaggatgaaagagagagaagcacttgttgggg

SEQ ID NO: 37806 - DNA, 1026 bp, Homo sapiens
attgagtagataaaattgtctgcaaaaacagcgtaatttccaacctggccaacatcgtgaaacccgttctgtactaaaaatacaaaaattagccggacacggtggcacgtgcctgtaattccacctactcgggaggcagagacaggagaattgcttgaacccgggaggcggaggttgcagtgagccaagatggcgccactgcattccagcctgggcgacagagggagactctgtctcgaaaaaaacaaaaaacacagaaaaaaaacccaacaaaaaccagcataactggaagagactacagagtggtcttaaatattaggtgtaagtcattttttaattttttgacgttgctctatttcatttattcaaatatttattgagcacctactttatgtcagacattgttctggatactaggggaaaacagatgctatctcaacctttcctgcagctcacattcatttcaactcatattttttaattaatcaaaagcatatgtgatctattctggtgtggaaaagaaaacatttttgaaaaggaaaaaaaagcatatgtgaaaacctacatatatcctatgatctggcagttctactcctagttacttacccgagagaaatgagaaaatacatttaccaaaaaccttgtacaaaaatgtttatactagctttatttgttggtggtgagttattattattttttttttttgagtcagtgtctcactctgtggcccaggctggagtgcaatggcacaatcgcggctcactgcagcctcaacctcccaggttcaagtgttcctcccacctcagtctcccaagtagctcgaactacaggcacatgctaccacatctggctaattttttaatttatttgtagagatagggtttcaccatgttgcttaggctggtcttgaactcctgggctcaagcgatcctcccatccagcctcccaaagtgctgggattacaagtgtgagccaccatacccagcctatactaattttatttgtaatagccaaaaactggaaaca

SEQ ID NO: 37807 - DNA, 1068 bp, Homo sapiens
catcacctcaacccaaaaaggcataatcaaactttatttcctctctttcttcttcccactcatcctaaccctactcctaatcacataatctattcccccgagcaatctctagtacaatatacacaccaacaaacaatgttcaaccagtaactactactaatcaacgcccataatcatacaaagcccccgcaccaataggatcctcccgaatcagccctgacccttctccttcataaattattcaacttcccacactattaaaatttaccacaaccaccaccccatcatactctttcacccataacactaatcctacttccatcaccaaccccactaaaacacttaccaagacctcaacccctgacccccatgcctcaggatactcctcaatagccaccgctgtagtatatccaaaaacaaccatcattccccccaaataaattaaaaaaaccattaaacccatgtaacctcccccgtaattcagaataataacacacccaatcacaccactaacaatcaatactaaacccccataaataggagaaggcttagaagaaaaccccacaaaccccattactaaacccacactcaacagaaataaagcatacatcattattcttgcacgggctacaaccacgaccaatgatatgaaaaaccatcattgtatttcaactacaagaacactaatgaccccaatacgcaaaattaaccccttgataaaattaattaaccgctcatttatcgacctccccaccccatccaatatctccgcatgatgaaacttcggctcacttcttggtgcctgcctaatcctccaaatcaccacaggactattcctagccatacactactcaccagacgcttcaaccgccttctcatcgatcgcccatatcacccgagacgtaaattatggctgaatcatccgctaccttcacgccaatggcgcctcaatattcttcatctgcctcttcctacacatcggccgaggcctatattacggctcatttctttacctagaaacctgaaacattggcatcatcctcctacttacaactatagcaacagcct

SEQ ID NO: 37808 - DNA, 1070 bp, Homo sapiens
tacatacttcctattctacaccctagtaggctccctccccctactcatcgcactaatctacacccacaacaccctaggctcactgaatattctattactcactcttactgcccaagaactatcaaactcctgagccaataacttaatatggctagcgtacacaatagcttttatagtaaaaatacctctttacggtctccacctatggctccctaaagcccatgtcgaagcccccatcgctgggtcaatagtacttgctgcagtactcttaaaattaggcggctatggtataatacgcctcacactcattctcaaccccctgacaaaacatatagcctaccccttccttgtactatccctgtgaggcataattataacaagctccatctgcctgcgacaaacagacctaaaatcgctcattgcatactcttcaatcagccacatagccctcgtagtaacagccatcctcatccaaaccccctgaagcttcaccggcgcagtcattctcatagtcgcccacggacttacatcctcattactattctgcctagcaaactcaaactacgaacgtacccacagtcgcatcataattctctctcaaggacttcaaaccctactcccactaatagccttttgatgacttctagcaagcctcactaatctcgccttaccccccactattaacctactaggagaactctctgtgctagtaaccacattctcctgatcaaatatcactctcctacttacaggactcaacatactaatcacagccctatactccctctacatatttaccacaacacaatgaggctcgctcagccaccacattaacaacataaaaccctcattcacacgagaaaacactctcatgttcatacacctatcccctatcctcctcctatccctcaaccccgatatcattaccgggttttcctcctgtaaatatagtttaaccaaaacatcagattgtgaatctgacaacagaggctcacgaccccttatttaccgagaaagcgcataagaactgctaactcatatccccatgtctaacaacatggctttctcaa

SEQ ID NO: 37809 - DNA, 1055 bp, Homo sapiens
ttttaagcattaattgtggtatcccaccacctcgactgcctctgataccacattatgtttatgctaaccttttcacccccaagaaggaaatgtgttatttatcctaaagataagaagagtatatttttaacctttttattgcaaaataaacacacatatagaaccacatgaacaaatatatagtgtaataaattatttcaaggccaatatccctgtaactaccacctaggtcaagaaatagaactctgccatcccagaagcccctcacatgtcccacatcccaattacaactccctccctccacccaaaattaaccactatccaaatttttatagtaattaataccttgcatttctttatagataaaaattcatgcatccatccctagaactaataagtcgtcttgccattttataaatttttaaacttttggtgtatcttttaagtctcccattcctttttctttccttacaatttatctgttaaagaacctggggagtttgacttgtaaaatctcccagtctggattttgctgagtgcacgctcatggtacagttcagcatatccctctggcctccatatttcctgatctctttggcaagattagaggtgctgttcttttatagacggcacataatttctggttgtctctcttttcattgatgctcagtgcctagatcaataacttctttgggcattgaaaaactgtgatattctatcatttctttttcatttattaagggggacacatctataaaaagatgtttcccctcacctactatatgcttactcagtattgcagttcacataaggtcagtaatgcttgactctttcccttaatttactaattatcaagataaaggattagctccttatcatcctccaaaagtggacagtttgttttggggtatcattaaaacctcatagattatttggtgaatttcaatacattgcaattattattcttactggagcccaaactgtcccatctttggccagtagtaaaacctcacagattatttaatgagtttcaatacatggcaattattcttctt

SEQ ID NO: 37810 - DNA, 1061 bp, Homo sapiens
agcagctgcagagcactcacgagagagggccactggagccctggctggaggggctgcaattccatgaatcagaccactgctgaggagcaggtcagggtgcaggaagctgcttgtggagcagggaggaggcagagggcaggctggccctcacaggggatgaaagctgctgtggctggctgaggcatatgtctcactctgtgctgtcccccactgcacttgacatgtttcatttctcttattagcttcattttataaatgggaaatggggagctcaaagaggtcatgtaacctgtcctaagctgtaccacaccactttagggactcaatccctagcctgactgcagagtcaatgggctgtgactataagcactgcctcccagaggctggccctggcagctgaacaggatcagtgtagtcagacagccagcatggtgaactgagtcaaacaggtatagacagcaacccctcagaagtgtctgcacatagtagatgctcaataaatatttgttgaataaaagaattgaggcactttaggaggctgaggcgggtggatcacgaggtcaggagatcgagaccattctggctaacacggtgaaactccgtctctactaaaaatacaaaaaaaaaatattagctgggtgtggtcacaggtgcctgtagtcccagctactcagcaggctgaggcaggagaatggcgtgaacccgggatgcggagcttgcagtgagccaagatagtgccactgcactccagcctgggcgacagtgcaagacgccatctaaaaaagaaaaaaaaaaaaaaaagaattgagggaaggccctccctcacccccacattccacaaaacaaatcttgaccctttccccctctctgcactcctttgtgtcctctctcttgcatcttcccttctgccactcactcgctcactccttttcagcacaggcagctcttggcaccgcttttaaaagtgtttctgaacaataaaaaaaacaaattcaaaaatgggcaaagggcttgaatagacatttctccaaacaagatatacaaatgaccaataagcacat

SEQ ID NO: 37811 - DNA, 1095 bp, Homo sapiens
acctgccccacaaggcacagctttgttggagactgggttcacagatgatttcagctgcaggaacaatacaggcacatggactgagtgacaaccaagaccatctccatgcactctgaagagcagacagacacatatgcctgtgcacaggtcaccacccccactcccctgacccccgccaatctgtctccatgtcagaagcacacttgttcctgaaaatggccttaaagcctcaggtgcacaaggaggaccctttccaaatgcttgcccacacttagggttctcagacttcaggtacatgaaaatcacctcaatctgacatggtatccttagaccactcatgagaaacatcatcctagacccagaaagcaccttcctttcccttggcagctgataaggcattgttggttgattcctggtgtgctaaatagctgagggtggccaagaaagagggcacttgagatgccatatcctgaggctgcagattcctggcaggagtatcaaatagtgtcctgctttaagaacacactgagggacctgagggggaggcacccatgtgtgatagaaaaaaagcacagctttagagctaggtggaaggaactggaatcctactgtcaccatttactgatcatagggcctggtcaagtcacttaactcctcagtgcttcaggttccctatctattaagtaatggtaatgatgggaattacattaaatgtaagcaaagcaccttgttttgtaaagcctggctcatgattggtgcctgctgtaaggtatcactcatgtgtatatataatttttatagtaaatgtactggtcctgagagcagccctctgagtgtggattcaaataccagcttccaaagagaatggttacatttccagtcagcagacagtgaagtcatctggaaggatgaggagatcaggattttcacaagcgtcctggatgctagatgtgcagtagctcacaatctctggctgcctggctctgcttggcatcactagcaaagactgctgttcagtcttccccagccactgcaatttggactaatcactctcctgggcactttggattttggacatggatggaaagacaaact

SEQ ID NO: 37812 - DNA, 1058 bp, Homo sapiens
aaacagaagggcaatatctccaagtgagttcttatggaggaaaactgccccagagccatggtgtctccctgttcaagatggcagatggttcagggcagactgagaggtgcccctcaagtgtcctgcctctatggctttatctttgcatatgtggcactgtcagctcaatggcacgacagggctgctctgctgctcttcgatgtagaggcttgccaggggaaataggcacacagatgcagcctccttcctaaccctcaactgcaatctattttgtatcccttgagctctcagcttctgctgtttttgtcagatagcagacttccttactgggagatacactcattccatgggcccaggcctgacccacacgaactgggtgcaacagtgggctgaaaacatgaggactggactcaagagtgtccagcttgaacttgttttccaactgccttatacagatacttaaaaaaaaaaaggccacaagctagaaaaagcaaggattctatccaaagcacattttatactaaaatacaaaggccaggtgcagtggctcacacctgtaactccagcgttttgggaggctgaggcaggaggattgagtgaggccaggagttggagaccaacctgggcaagatagtgagacctcatctctacaaaaaataaaaaacttagctgggcttggtgacacgtgcctgtagtctcagctactcaggaggctgaggcaggaggattgcttgagcccaggagttcgaagctgcagtgagctatgattgtgccactgcactccagcctaggcaacagcaagatcctatctgtaaaaaaaaaaaaaaaaaaaaaaaaaaaaaaaaaaaaaattaaaccataaaaataagataggctagagtaagagatgggcctggaaaaatattgatagagatcggcccatatgttgaggggaaaaaataaaggcagtcctctacatatatcaatactgttctctgggttttcaagagaaatcccttgaaggtagacaaaatggtaaatgtcacaagaataaaaatcaaagcctgcaagttgactgc

SEQ ID NO: 37813 - DNA, 1032 bp, Homo sapiens
cagcagtcaggccccagcccccatgctgtctcttttctgtgcctctgtcctggtgccagggctctgagctgctgagagcttcgctttgtgagatcacccccatggcttccttcagcttcaagggtgtgggtggcctctaaatcactctatagtgcgaggagcaataacccagaaagtccatatgaataatacttggtcctcttctctgagtctttaaccaaaaatgaagtccactgccctggccagaattcttccttggctgtttgacaaaacttaattccacaactgtttcctcccagaggatgactcttagtgtaagcacatccctctttgagaatctgactgtttctgggaatcaaaaatgtgggtttatatttccgatacttctggagtgccaggttgtttggttttgttttcaacaaaatgtttggccctagaaatgcagcaacttgctctgttgccaggagcttccctgccaagtgtcttgtgcacagccctctcctgggtgagctcctggacaaagcctcatgccctggtaaaccctgcagactgcagccactattctggcctaggtcatagtcttgagcaccagctctgctagggctactcaggcattgcacttgtctgcaggtgttaggaatttatgttactgaagagtgagcaatgtcattgtgagagcatgtgcaagagcaagctttcctgcaatacctaaagaaaagcaaggggaatagtaggacctgggacagcagtcctaggcccattaattccccttgcccctctgacagaatttcgaactcagtattcttcgaatactcagatgccagggttgccattgtaacagaataacagtggctgggggacacccattcagtggctcttcagaaagaacaaattcactgggtggatataacacttaaggaaaatgctcaataagccacccattgagtctcagagcaacctgaccaacaaggtgaaaaccatttaaaagacacattgtcttgctggagaaccttcctcccctgggtttcacca

SEQ ID NO: 37814 - DNA, 1046 bp, Homo sapiens
cccaatgttcacacacattgttgaattgttttaaaaaagaaatcagtgctgtgaatctgagtcaactaaatgcttttgctttgtgttcagccaagatttgcagccttttttcagaggttttaaaattttcagaaaaaacatttctaatgtgtctaatgtgtcagtggtaacactgacttaatggtaaatggtaaatgatttaagtttccttgtcagagtcagtattatttgaaggagttaggaaggcagtctgaggctgtgatgagtctccttacctcccaaatgatcaagatggcaaccccagctcgcaagccattcaaggcgggcataacgtaccatgggttttctccctttgatccacatacccttctcccgggagctggaagaactgtgaggagaaagggagctcttgaagttgaagcatcagtgaggagaaaaaccattcaccccttccccccactatggctgaggactggcttctgagacagtttaggaaactgacaaagccatgaaggaatggctcagctatcgaccatctggacatccagcagtatctatccatgtccttatctttgtggggctctttctagctggacacactagattctgcccggcccaaggcctctggagaaatccagcttgggcatgcatgcatgcagggagagccacacagcacagctgtgagggcaggagccagccctggagtgtgccccagggaagacacagctctcaggaggagactggaaagggtcctatggaagacattgcccttcccattcccctcgttgaagtgaactttggggacaggaaaataactgcattttaggtggtcagccaggcttccttccttatctgttatgagaaaatgagagacaccaaaatctgacagttacaggctagatttaacatactactcaggcactatctttaacagccactttcattaactaaaattgggtttctaatcatatttttttaaaagaaccaagaaggaatgtactatttcctgtagccaagtaggtcaggtcaggcagtctgcatgtcca

SEQ ID NO: 37815 - DNA, 1361 bp, Homo sapiens
cttggccacatcttacagataattacaggagctgggatccaaaccccgacggtctgtcagcagaccccgggctctcaccacagtgccatttgcgattgctgccctcccctgcagacagagcgggcagctgaaacagcaccagaggtgaggaaggcagaggaaaacttcctgacaaggaagatattcgggcactgagttgggttggtgggttagattaaggtaatgtttgctaagaatcatagctcccctgtgttattatgtataatgtaaacttatttattttttactttgaaatagggctgaaagttccagtcagtggaacttactttacagattcccaaattaagctgcatttccatcttattgggagactttgtgggaaggcagaagactggaccaaatgctgtctctgagacccctggctcctcctggacttttcggaggagtctgcagtgggcttaacaacagtagaggagtttgtgtcaggcttggaaccatctttggaatactactttcaatcactgctgtaggttttattttctctatggaattctggttcctttgaggcccctgggacaagcagatggagagctttgctgtggcccagagctcccagctgatggctgggcaagcttcagaccctgccactcaacctcctgaaaaggtgggatgggggcaatggattctgggatgcggctgcaaacactcagagccaccaagggaattggaggaggttgtggtgtggtcagaatgcaggaagctcttagcagtcaccttccgattggggttgattgggttaaggccttctgggatggtgtaaaacagttctgaactcaaaggactgctgatggaaggatgatgaatcgaaagaaatacaataaacagattccttgtcatgttgttggccttgtagcaaacatgttttctccttgggattacgtgaacatttgcttttctttgatttctggttgttattttcagtatttcttttgttaaatgagctctgttttacagagcttcagacagctccgttaaagcccctgactctttcctattgcaagggttgtgtttagagtttggctcagcctcaacacatcacctgttagctgttaggagtctaattctgcaaaccatgacttcatcttgctgaaggaagatagacaaaatgcttcaatacaacagatatgttttagttcaagacatttggaaaaaagaaaaaggaccctaagcctttcgtctctgggtggacttgcaaagtagacctgtcaaaggtattcatgttcagacggctggtctgtagtcaaaaaggctgccaaaccatgctgttatccaaggatgtgggaattttgtcaagcggcctt

SEQ ID NO: 37816 - DNA, 1082 bp, Homo sapiens
tatctggttcttcatggtcctcctaaagagtccatgaaattgttcaggagagcgtaaacatgatctgggcctactttgtgaagcaatgggcccattttcctctgctctcccaaggccagcggtcagactataatacttggatctgagaggggaaagacctcattgcttcttgatgcaaatattttcttccaatctgtggcttgtcttctcattcccctaacaatgtcctttacagagtagaaatgcttgattttcataaagaccagcttagtaattatttatggtatagattgtacccttggtgttgtgtccaggaagttactgccaaacctgaagtcatctagattttctcctatgttatctaggatttttatgggtttgcattctacatttaggtctatgatccattttgagttaatttttgtaaagcttgtaaagcctgtgtctagacttggcttttttgcatgtggatgtctagttgttctagcaccatttgttgaaaatctcattgctatcttgaagataagccatggtgcctggaaatcttcaaaagtcaaaggagtgtcactgctgtctcatgatatcactttgaagggcaaaatgcaactgttatttttaccatcagggtctgcagataggtagacaagttccacgtggagggttctgcttttgcttgggccaacggacaagcacacaacaccacaaaacctgtttctggtagacaagttccatatgaagggttcttcttttgcttgggccaacagacaagcacacagcaccacaaaacctgtttctggaatcaggcaaggaaaaaggtgtgaccaaaactaagtgtgccttcttttcatctagaccttccatttgggatctatttacttcttattgaagtatatcctctagaattttatttattgagggtcttttggtgataagtgtcctccacttcggtttttgaacatgtctgtcacatctataaagttttcagccatcatttcttcaaacagtttatactagtcacttcttatggaacacagattaagcatacgttagtattttactctgtcttctgtatctgttaatct

SEQ ID NO: 37817 - DNA, 1030 bp, Homo sapiens
atagagagatgtgttggaggtcaacagggcctgtgcacaaggttggagtctggacatgcagctgccccaaactagactgtgactgacagaaggcatggccatggcaggaatgcagaagagggagcacattgatggatcattgccagggaaggtattgggaccagtaggcaggattactccagacaaagggctagagagatgttcagactgagcatgctgggtgtgctgaaggtgccagtgggaatgaaggtggtttgcagtgcagggagcagcctgttaggatgcctgctgggaagggataggagggtgtggcagggcctccatggcactttggttctttgcccctactgcccctcctagtagtacacagcttgttgttctcatgtccaccttattcatggggtctacatagccagccttctaattagtcctgtgctaaaagaactgactgcgttgctccagtcgcatctcgattgctgaggggcctgtggtcagactctgttgcttctcactgtagcctgactcatctctccatccagctcctctataaaagtttgtctttgggtaagctttgaggttttataaacaaagttaatgtttattgtgatttataattggaagagttgcagaaataaagaccacagagatcccttcaagatcaatcacagaaccttcattttctaggccaataacagccaaaagggcagtcaagctaatgtgcaatgatgaacagacacagttgcctgaggacctatcattgttttcaaagcatgcagagccatgagtgaagcctcctggtttactgaaggaaggaagaacacatctttgtcaagtttgaccagatagtatagctgttctcctgtgaccagcttcactgccctgcagaggtgatgagtgcttaggaagctgctttgtctatgatgtagggctgtctgtttctcaaacaaggctggatgcagaacatgggtcaaacagggcccaacaggttttgggtggtaactcattctggggttagggtcagcgttcagat

SEQ ID NO: 37818 - DNA, 1050 bp, Homo sapiens
atggttctataggcagggaagttcaagatcagggggttagcatctagtgaggccttcttgctgtgccatcccatggctgaagggcaaaaggggtgacagagagcaagagataaaacttaaagactggaatccttttataattgacattcatcattcatgagggtggagctctcatgacataagcatcttccactgggctccacctcccaacactgttgcattggggattaaatttccaatacatgatttttaggggacacatccaaaccatagcagtcagtatttgggaataattgtttccaaccagccttggcagtaagtatgtctattcatgtcctttgcccatctttcagatgggtccttggtctttcatttgttaacttctggaagctctttatatagagagatattagccttttacctatagtttgaatcagtttcctgtggtggtgtttgtcttttgactttgcttatgtgtactactaagtaaaagtttcattgttatgtgtttgtatttattaacctcgaattttatggcttctggattttcaggcatgtcttaaaggccttttccactttgaggttaataagagatttttctagtttttctcccattattttttaaatttaactttgctcccaccacccctcaatttaataggattttcctatcaatctcattatccatttggaatttattttggtacgtgatgtaggatatagaaccaactttattctttagatgctatccagttgtccttgtgtcactagttgaatatacatttttttgtccactgatttgagatgccatcttcacttacactgaagtatttccatttgtatttggattagtttctggactttgtatttagatctatttgtttgtcttatagtcacattccagtaccagtcccacactattttaatcattgttcgataatgttatactgtctgatatgcttgtccttcctcatgacttttctctttcagagtctctctttttttttatagtcctatatttttctaaatgtatttaaggataaacttgta

SEQ ID NO: 37819 - DNA, 1034 bp, Homo sapiens
ggagtgaagaacaattcaaggtcagttttcttcctgactgttggggcattttcagctcactacctggggcattgggggtgtctgaggtacaatcttgctggcttcaatatatgtgtgtcctaagaagcatgttcctgagagaactaatctcagtatctataacaagtcagggtttagaattcaaaagcaattattttagaatcttgttctcttgccaagtcttcttgaagctctaatacctagtttcttcacaggtaagatggaaattagtgacaacattagtaataataatgagaattcacatttattgaatactatgagccagacactgcgctaggcactttgcataaattacctcatttgatcctcatatgaacccaaaaagagaggtgctaattgtgttcctttttaatagatgagagaatctgggcaaagaggaagtaatcaattagcttactcagggacacatggacagtgagaggcagggctggagtgatcatcgtgtaatgaataagccttggattgggagcagagacttggatttcagcctcgattatctccttctaattctgtgactgtggaagtcacccaacttctctgtgtttcagggtctgtttttgggttgtttttgttgttgtttgcttgtaaatggaaaacatgcttggaaaaaatggacttaagtgctattttagctctgacattctggaatactgagaaattctactgagaataaaaagggccactaaagcgaactgaatagaattctctcccatgcagaacactccagatggccttgatttctagcagtgacacctctatgccagtgcctgtgattactttgcagcaaagttcctagcaggctccgagcagttctcagccatctcacactccaagccccttgaacattgccctcagttttgcagtttctcctcatgtgccctgaagcccagactgcacgtaaacaaccagtccaagaacaataattctgcttcttgggattgaggagtgtatcaattttctgtaattctttgtag

SEQ ID NO: 37820 - DNA, 1083 bp, Homo sapiens
attaagctggttgatggggaagaatgtgatcaataaatgctacccgcttaaggacttgtagttcattcttcagctaagctttgccaatcagttaccttgtgttgtgctaggcagcattgggagatggcgtgcagagacagagctggtacacttctcactctgcataggctcacagtctataaagggaagtagaaagaggtgtggctaaccaaccacatacaaggcagaatggggttgtggctgcccatcacctaacctggcaaaggcagactatctgcctttgactctgccttacccactaagattccaaccccttgttccccagccctgctctctgctccagcctgggcagcttccacacatctccttccatgcttattctgaactcattttccattcattcacttaaaaaatatttgagtttgtgttatgtgccagcaaataagacaaggtctctcatggatcttaagggctagtggaagaaacatagtcgttcaaacaatgctgtgaggatgagggacatagctcgataagagttcctaataaaaaatgaactagacagggatttctatggtgtatgtgcttatgtttgtacacatataggttatttgatatagaaataggagcaaactatacatacatactactcctttccttttctgctcccttcccttcctttccctttcccttcccctttccccttccctttcctttccttgccaaattcaagttatgtccagcctgacttaagtatataattagaaaacagggccaagtgttttaggggaaaagcacattaacatatttgcacaaaaaaaatgtacttaggttaagaaaaattggagtccttttttcctcctggcagataaagctttcatttcaactttctgccatcctataaattttgttgtagtttttttccttagaatttcttttcttctctcttacactgcttattctgaaaaattaaaaacctactgtaggtttgaaagaatgaacattcatgtagtctttacctaaactcaccattaacattttgcttcatttactttatctctctagacttaatctttcattttgctt

SEQ ID NO: 37821 - DNA, 2211 bp, Homo sapiens
caacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaaaagaaaatttaaaatgcctgggagtggctataggggtagctctttccaacagcccaagtggggtcaactcctaagccccaccccctcacacacaccgccttccctgttttgcccttgggggagccacttctaaggctgcttacccttgggggtgttcctctatttgcctgccacctctcttgtctctccctctgaagatggactcggccccacatacacatttttgtgttacagtcattgatggactctatttttttattattacttggaccttggtcgtttttatactagcaaaatgtcttgttttaatttgtgttttttggggggagggagggagtgaacttgctgattctgtagcaaaacctgggtgggggttggggtggggggtagtttactttgttgtaaggacttgataacctggctacagcgttttctatgaaatctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgtggtttttttcccctctcctgttgccctgctagttgcgtgttgaattatatcccttacaggcaaaacttttgaagtggtggatgtggctttttaaactcttaagtttctgtgcatccatctcttgtactaagcgaattgtttatcatcttgacatggttggtcatttctatgacaatttacttcaaactgtgtactgtgtagttctatatagtttgtgttaagcatgtcattcatataaactgtttaaaatttttcagatggcctagtttcatccctcttactggtttgtctgtaatgaatggttaaaaataagggttatattttaccctcaaatgcgtttttgtactttcagagcaggtttaaacgttttttttttttttttcctatatccgaactgttggcctcatggaaatccctttcccgatctttgtagcaccatctactggcagaatggcagagtagctgcgaaacaatttgtttaaaaacttgcttaagacaattgcatcagatttggaagttttgccatcaaaattctttgcagaattggaagttaacacatttgcttgtaactgagatgggcttcacaggaatgtagttgccagttcatatcacaatagccctttctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaatagcattcaagttgttgtttataagagaagaacaaaagtgataataggtgaaaattgcctttctggatagaaatagagaatagcaacgtttatggatatcacaaataaagaattcaattctttacatgattgagtgagagtatgtataacctggtgggtgggttcagagtaccttttaatctagtatgcttaacttgatgttaatatttaacttaaatatttgacttacatgttgacgttgaaggctcaaagctatactaagaagctttctgaaagattgggctttaaaataaaataatattttaatattgaaccattttttaacttcttgtcactgttcaattcctaaggtctagttcttgccagttttttttttttttttcctgattggcagggcttttaaagaagtaagaagaaaggttaagattattaggctaggttatagctgctcagtagtcattttgacaaagggtagcggatggttggtacaa

SEQ ID NO: 37822 - DNA, 1084 bp, Homo sapiens
attattccactgtagtcagagaagatgcttggtattatttcaatttttttgaatgcagacttaatctgcactacagaccaaatggacctaagaaatatttatggaacatttcatccaatggctgcagaatttacattcttctcatcaacatatggattattctcaaggacagaccatatgttaggtcacaaaaacaagtcttaaaacattaaaaaaaaatggaaaatataccaagcatcttctctaactacaatggagtaacacaaaaagtcaataatcatcacactgagggttttaatcataaagggatgctgaattttgtcaagtgttattctgtgtctattgagatggtcatatgatttttgttttatttttctttcttcttctccttcttcttcctttctttcctctttctttctctttctctctctctccctctccctctctctctgtctctccctccctcccttccttctatttttttttttttatggagtttcgcttttgttgcccaggctgtaatgaagtggtgcaatcttggcttactgcaacttctacctcccaggttcaagccactctcccgcctcagcttcctgagtagctgggattacaggcatgtgccaccatacctgactaatttttgtattattagtagagacggggttctgttggctgggctggtctcgaactcctgacctcaggtgatccacccaccttggcctctcaaagtgctgggattacaggcatgagccactgtgcctggccgatttttgttttcaattctgtttacgtatcacagttgttgacttgcatattttaaagtaaccctgcatccctggtatgaaacccacttgatcatggtgtattgtctttttgatatgctgttggatttggttagctaatattttgttgaggatttttgcatctatgttcatcagggatattggtctgtagttttgtttttttatgtcctttcttggttttggtattagagtaatactggcttcatagaatgatttagggaggattccctctttatcttttgaaataatttcagtaagattggtaccaattcttctctaaa

SEQ ID NO: 37823 - DNA, 1068 bp, Homo sapiens
ctatatccattcatcggtcgatggacacttaggttgcttccacgtcttggctattgtggagagtgctgtaataaacatgatagtccagatgtctctttgatatactgattttctttctttcggtttatacctaatagtgatattgctggatcgtatagtagctttatttttagttttttgaagaacctccatagtggtcgtactaatttacatttctacccacagtgtacgagggttccctttactccacatccttgccaacatttgttattgcctatcttttggataaaagccatcttaaatggggtgagttatctcattgtagttttgatttgcattctctgatgatcacagatgttgagcaccttttcatatacctgtttgtcatttttatgtcttcttttgagaaatgtctattcagatcttttgtccatttattaattggattattagattttttcgtatagagctgtttgatctccttatatattctagttattaatctcttgtcagatgagtagtttgtaaatattttttcccattctctgtgttgtctcttcactttgttgattgtttcccttgctgtgcagaagctttttaacttgatgtgattccatttgaccattttcactttgttcacctctgcttgtggggtattactcaagaaatctttgcccacttcaatgtcctggagggttttcacaatgttttctttcagtagtttcatagtttgaagtcttagatttaaatctttaatccattttgatttgatttttgtatatggtgagagatagggtctagtttcattctagaaaactgcatatggatatccagttttcccagcaccatttgttgaatactctgtcctttccccactgtgtgttcctggtatctttgtcgcaatgaattcactgtagatgtatggatttgtttttggcttcttttttctgctccattggtctatgtgtctgtttttatgccagtaccatgctgttttggttactttgactctgtagtataatttgaagtcaggtaatgcaattcctccagttttgttctttttgctga

SEQ ID NO: 37824 - DNA, 1031 bp, Homo sapiens
aaaagctgagagaattcatctctagctcattacaggaaattctaaaggatgcatacttcagacagaaggaaagtgatcccagaggcaagacctgagatccaagaaggaaagaagagcagagaaagtggaaaacatatgggcaaacctaaacaaagacctattgtataaaacagtgacaataatgtcctggtaggtgtaaaaaattaaaatgcacagcacaacaacaatataatccaagagggggataaatggattttaaatgatcctcgcgtcatctaggatcaggataaagatgtttagtaatttcagttttgataaatatgcatgtggtaattcctaatataactactaaaagaataaaaacagtatattatttcaaaaccaatagatgaaggaaaagagatgataaaatactcattctttacaagttgagaattagggacacaacaaggaggatgttaggttttctggatttagcaaccaagtggggatactattcataattgatttgggaacaggaaaaagagaaagtgtggaaggaagatactgagttatgtttgggacaggttgaatttgaggtgcttgagggacagccattaagtttcctcttggaactagggcagcaagttttctttttaaaaccattttttgtacctttttgagctaaagtgattcttagctctttctggatttatgaatttgcctaacaattctgagctccattaggctgtgctttagtgaagtatatttttaacaggtttcccaacagtaagttaggggaaaattgtgaacttgatgtctctggaagcctttaaaaataagatgcttttctattttaaaagatttaggtttgccttccttcaagagggctggacttctccaggtgtcagtctttcttttgatatttaggaatttattctctgctcttctctgccatctggtggcagatgaatggaacactgcatttggaaggaaaagagggaatttgagctttttattataatttatttatttatttaggggggacaagt

SEQ ID NO: 37825 - DNA, 1051 bp, Homo sapiens
cctctaggtctttgaagaattgctacactgtcttccacagtggttgaacaatttacacttccactaacagtgtaaaagcattcttttttctccacaacctcgctagcaggttctctattctgttccattggtatatctgtctgttcttgtaccataccatgctgttttggttactgtagccttgtagtgtaattggaagttgggtagtgtgatacctccagctttattcttcttgcttaggattgtctttggtatttgggctctttttgggtttcatatgaatttttaaattttttttttctaattttgtgaagaatgtcaatggtagtttaatgggaatagcattgaatctataaattgctttgggcagtatggccatttttacatattgattcttcctatccatgagaatggaatatttttccattcgtttgtgtcctttctgatttctttgagcagtggtttggagttctccttgaatacgcccttcacttcccattagttgtcttcctaggtattttattctttttgtggcagtcgtgaataggatttcattcatgatttggctcttacagagccaataattcaatagacattagagttaggatctcctaaacttgtggcctgatactttttttacactatgatgatttatttcctcaaaccaacatttaggtcacatggccccacaaagaacttttatattatttccatgtaggagaggtcgattggaagatgtagattagcctaaataacaaaatatggtaatttccagaaagtcattggtttatggaaatagaatatctaaaactaactattcgagaaaatttaggtcataagtttgcattacacaacaatgctttaatgaaaaaaaattggttcccacttaaaagtcttttatatatagtgtttgataccattattagaactagatttatctaatctcctcctaatctcaatatataatctcttaatacttggtggctcttttcagtctttaaaaaccctttatcatcttgaagttgtattaccgtatcaggcttaatttgct

SEQ ID NO: 37826 - DNA, 1135 bp, Homo sapiens
ttcagcttttaagcccttaaagtacagtgcactaacatactaccactctagcaagaagcccagaattaatgggactattcaacaagtattatttatgaaaattagctagacttggaattgatggtggttcatttttcagatgactattttatgacaaagggtgatgtgtctccctggtgcatttgaaatgggagcacagagtacagattgtcctttagtaaaacaggaatagacatgaagtcacttgtattggcagtagctgcagggtattatgcctgctgctcaaaagtggcaccaacagcagtaaacacatattagactggaaaattcttctctttttagctcgtggcacaaaatcctgatggactccacgaaaggtatgtgtaaggctttgaaaaagctttgtaaaatagcattaattcctgtttaataaagttgtatttaagcagacatcttttaggatttatatccgaacagcagaaaattatttctatttgagaataaaatcagggatttatgaaaattataagagaactaattgattaagtagtgtgtattttgcgtttcactgtgcttagcacagtgggagatacaaagtggaaaacacagtccctacccaaagctctgtaggagcacacaagatctgagtacaaataatttgctttgggatgaatctatttagctaatgtattttgtcatttttaaggcaaaagtcttacaactctgtaacaatttttggctagccttaaggttctctaagcaaaatatcaagacaactggtcaattcagtgatcaaacaaatcaactaattttttggtaaagtaaaagtaatccaattaaaaatatccaggctgggcacagtggctcacgcctgtaatcctagcactttgggaggccgaggcaggtggatcatgaggtcaggagatcgagaccatcctgggtaacaaggtgaaatcctgtctctactaaaaatacaaaaaaaaaaaaaaaaaaaaagccgggtgtggtggcaggtgcctgtagtcccagctactcgggaggctgaggcaggagaacggcatggacccgggaggcggagcttgcagtgagccgagatcgcgccattgtactccagcctgggtgacagagcaagact

SEQ ID NO: 37827 - DNA, 1056 bp, Homo sapiens
aaaaaaagctttagaatagttttaacaaaaggatttgggctttcctgtactgggactctcagctgttcacaaaattatgctttctaaagtaacagattatctgaaattgaaattattagaggaaaaacacccatatataggtaatcaaatttacataatttttttttttttagagatggagtctcgctatatttcccagtctggcctcaaactcctgatcttaagggatccccagctcaacctctcccagcagctgggactaccgggctgtcaaatttacattaactatgagaattaagcaggtaatctctagagactattcttattcctttgagcataacagactgaaaaatcctgaagaattagaaacctgtttggttaaaacaaaatcacaaattcagtagattcagtcatgatttaagttcttgtgattgcctttgaagtgcaaaccatggcaagtctagcttagtttctagaggaattggctgagctgtaagtgagcttcacactgttctagaatataacattgctcttttggaacttgttattcataggttttgctgagtggagttttattttacagatctagacttttgtgaagaggagacagtccgttttaaatatttgaattttattttcttttgacatacaactgtggaacactcagataatctataccatgttagtattcctacaagagaaaacgggtaaaacagtatttagaaagcagtaccagtaaacgttattacaagcattagatgtgtttaaaaagttgatactaatttataacctgtaattgttaaatgtgcatgacttaaatgttaaaatcctgtattttaagatagtcttctgcagttacaaatccatatacccagatttcctgtaggcttcacaaatcggaggggtacatagaatgtgcaagagtcaaaggataaataatattataaatatatattaactatattacctaattaaaaccataatctgttaatacagctatggattaatttcaaaaaaatgtaatcaaatatattactaatggtgtagttggctgtt

SEQ ID NO: 37828 - DNA, 1461 bp, Homo sapiens
aagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagct

SEQ ID NO: 37829 - DNA, 1019 bp, Homo sapiens
gggatggggttttgccatgttgcccaggctggtctcgaactcttgggctcaagcgatccccctgcctcagcctcccaaagtgctgggattataggtgtgagccactgcacctggcctataaaaataaaaaaatatatattttttatttttttgagacagaatcttgctctgtcatcgaggttgaagtgtggtagcatggtcatggctcactgcagccttgaactggtgagctcaagtgatccttccacctcagcctcaagagtagctaggactacagacatgcactgccacacccaggtaattttttaaaattttgtatagagttggggtcttgctttgtgcctggattggtctcaaacttctggccttcagcagttctcccacctcggtcttgcaaagtgtggggattacaagtatgagccaccgtgcccagcccagtaaagtgttaagtatttctgaggtactaaatactttgtagacaactagggatatagcagtgaacaagacagacagagtccctgctgtcatggagtttatattcttgtggttaagataatgtttgcctctctctctctccttttttttttttttttttttttttgtttgagacagggttttactctgttgccctggagtgcagtggcacgatcttagctcattgcagcttccacctcccgggctgaagcgatcctcccacctcagcatcccgagtagctgggactacaggcacatgccaccatgcccagctaatttttttgtattcttagtagagatggcattgcaccatgttgcccaggctggtctcaaaactcctgggctcaagccatctgtctgccttggcctcccacagtgctgggattacaggcgtgagccacctcacccggccaagataatgtctcttaactcctctttagagtatcacttaattttcccctatacttctgttaaagatttccttgtttaatgccaatttccagtcatcagtgaaaattattaccttgattttattagtagttgat

SEQ ID NO: 37830 - DNA, 1029 bp, Homo sapiens
ttgagggaagataaattactctctgtaaaaagagatgctaagtactacagactattataaatgatagctaattaggggtgtttgactaatctgtattctaatatcctaatttagattggcaacttctcttatctgagtattgggagctccattaatacatggtagtgttctttttgtcagtctgtaggtatattgttagagccatgcagtgaccgtggtgatagtgaagatggctgtcttgagaggtaagcattttttcttgttgctaattaatcattttgagaattggagctcttcacagatttttgaggtgatttttttagatgaatgtccattataaatatatagtttagataatcttaaacagccttcttgttataatggtaggcataaaggatattaaatacccataaatgtttggatttgtacaggttcagacagtagttataacttggaaaacattcagagggaaaaacagcctttttggagacatttaaatctttcagttgattgtggaacaattgggaatttactgatattctgagtatacctgtcagtgagttaattcatgatcttgtaactgtgtataactaactgagagatactgtatttgattcaacaaatatgtataggatgtttttcttcctctttgaatttatccttggtgtgtctcagtacactcttaggcagctggtgcttttttaacctctttggctggctgtaatggtagagaaatactggaggcaatgagtatttcgactaatgtagagtctcaatagatagcctctttgaatagaagctttctagaatgttttaaatcacagagtaagatttgggttcttgttaccctttgcatcagtcttcaagatgctgccaaaaagtataactttcttaggaaggtgatttgagattctgaaaacacttcagtaatgaagttgcaggctagattgtaaatattgagagatcccagacagtatactaatttgctgacagcctgttggccaggacatatttgtattctattgtttc

SEQ ID NO: 37831 - DNA, 1050 bp, Homo sapiens
gggcaatacacaataatacctgtttacttggacagtataagcaaaaatacctgatttaagttttctttcttttttttttttttcttgagacggagtttcattcttgtcgccccggctagagtgcagtcgtgtgatgtgggctcagtgcaacctccgtctcctaggttcaagtgattctcctgcctcagcctcttgtgtacctgggattacaggcatgtgccaccacgcccggctaattttttttttttttttttttttttagtagagacaggatttctccttattgatcaggctagtctcaaactcctgacctcaggtgatcctcgcgccttggcctcccaaagtgctgggattataggcgtgagccaccgtgcctggtcgatttaagttttcaatgacttgataatctaggttgtacatgcacatactttctaatacagaatatgactagtgctattagggcactatagtcttgcagaagagaggaaagaacttctggccagggtagttatggaaggtcttggaatgagggggattttgaacttggctttttatagggctggatttggttcaagatttgtgaaagaaactaaaatgaatagtataagtaaagattacagggtaatgttgaatgttaatgaaacagagctacttgtagaactcagggtattgtgggaggatatatagtagaagataattctggaatattggtagatttgggtcatacgtagagcctggaatactatcttaagaattgtagattttctcagtagaagaaaaatatagaaaactttgaagcagagggaatgatgtacccagatctgtattttaggaagaaggttttttgtagtagtcataaaaagtttgtgggaaagactgggggtaaggacaacaacaatcagtaggctttttgcactgtatttggcgagcacttaaaatatctgagctggtgggcatggtggctcatgcctgtaatccttgcactttgggaggccaaggtgggcagatcacctgaggtcaggagttcgagaccagcctggccaacatggt

SEQ ID NO: 37832 - DNA, 1060 bp, Homo sapiens
agcagttatttttcttgtgtctttattttagctctcacatccctgtgatatctatatattttagctgcagatgcataactatattgatatatcttttttatttctattggtgtgtgtgagccctggctgatatatcagggctttttacccacaggatttgactaaagtatgaaaataaagaataattaaaatctgtgaaatctgaaagctaagtcagtcctttttgtccttcagaagctcagagaacaaagttgtacaattcattttgtatgtagccttgtgggtgacaacctgactcttaaagtagaaaatctatttatttgatttgtttactatggctggtgggaggctccttattaaaaggagctgtttatttgattgtcccagcatattcttcagggctaaagaatctttactcttgcagtaataatcgagcttgctgatcactacttttatatatacttgtagttttcagtagcaattaaaagggttaggaagcaaaaaagatcaactaccttgtgatctattcaatttaaggccactggaacttttgcctctttttgtctcctttgaataactggaaattttattaaactttattctttttggaggctggatatagacctaggccagtgtttctcaaacttactactatggataagaatcatcattggcatttgttaaaaatgtagactcttgggccctactttagagatttggagtgggaacttggaatctacctttttaaaaagcttttttccttgttttattttattctatttatttatttattttgaggcggagtcttgctctgtcacccaggctggagtgcagtcgtgggatctcagctcactgcgacctccgcctcctgggttcaagcgattctcctgcctcagcctcccgagtaactggaactacaggcgcacaccaccatgcctagctaatttttttgtatttttttttagtagatacgaggtttcatcttgtaggcccggctgctctcgaactcttgacctcaagtgatctgcccgcctcagcctcccaaagtgctggttatagg

SEQ ID NO: 37833 - DNA, 1022 bp, Homo sapiens
ttatatgttaggtgctcccactctttcccggcttttagaagctggtcctacacagttcaccacacctcttgcttccttcactactgttgccagtgagcctccagttaaacttgtgccaccccctgtagagtctgtgtcccaagctaccattgtcatgatgcctgcgctgccagcaccatcctctgctccggctgtctccactactgaaagtgtagctccaggtgcgtccctgagcagccactagatctaaaatttcattttgagctttagttagagaaaaatgaccaagagcatcagctccgattcagatgcttcttctctgttctacatagacatgtgccatctttatccttagaaataaatatccttagaaatagatgtgagaagaggtgggtgggcatttatgtattgcaggaagaggctaagtatacagatatgagcaggcttgaaaatatgttctcacctttctagataaaactggggagaagaaaacataggcacatgttgatgactctttctgaccttaagtgtttggatatttgacatctgtctgtagcgcttatgtgatctcaaggtggtcgctttgtacccaataagcttctgagatgcttttctctttctgttactcagtgagtcaacccgacaactgtgttcccatggaggctgtgggggatccacatactgtgactgtttccatggacagcagtgaaatatccatgatcatcaattctatcaaagaagagtgttttcgatcaggggtagcagaggctcctgttggatcaaaggctcccagcatagatgggaaggaagaattagatctggctgagaagatggatattgctgtgtcttacacaggtgaagagctggattttgagactgttggagacatcattgccatcattgaggacaaggtaactattcagcgaagccccagagaatctcatgggtcctacataggcttctcttttcagcctcactttggtgctgctgctgcttttttttttttttttttggagacagag

SEQ ID NO: 37834 - DNA, 1043 bp, Homo sapiens
cgtgagccatcactcccagcctagaactatcatcattttacctttctcggtatcagcccctcaccccctttcttttgaatcatccattatgaatttaactctcttgccacatttataaacaattcagtactttgctgattgtcatgcttcctagcattttttttgtttgttttttaaatctaatttttgaagtaatatgtggccaccataaaaacaaaaacactatatagaaagcaatagcaacaaagaaatgggttaaaaacttaagtttaaggccgggcgcagtggctcacgcctgtaatcccagcactttgggaggccgaggtgggcggatcacaaggtcaggagattgagaccatcctggctaacacggtgaaaccccgtctctactaaaaatacaaaaatcaggtgtggcggcgtgcgcctgtagtcccagctactcaggaggctgaggcaggagaatggtgtgaacccaggaggcggggcttgcagtgatttgagatcgtgccactgcactccagcctgggcaacagagcaagacgccatctcaaaaaaaaaaaaaaaaaacttgagtttattttttgtcacacatacaggaagtctaggcagtccacagctctcatagcaacttcacagtgacattagaggctcaggatattctctttctgttccaccttcctcagtgcatagtttatcttctggttatcttatggttcacggtggctgcttgaccttcagctatcacatccttgttccatgcaacaagaaggaagggggttggtaagaaaagtcacatctcttcccttttaacaacttttttgtgatataattgatgtgcagtaaactgcaccttttttttttttttgagatggagtctctgttgcgcaggctggagtgcagtggtgcaatcttggctcactggaacctctgcttcccaggttcaagtgattctcccacctcagcctcccgtgtagctgggactacaggcctttgccaccatgcctggctaatttttgtattttttggtagagatagggttttac

SEQ ID NO: 37835 - DNA, 1035 bp, Homo sapiens
tgcccagcttttttttttttttttctttttttggagtcagagtctcattctgtggcccaggctggagtgtagtggtatgatcttggctcactgcaacctccaccttccaagttaaagcaattctcctgctccagcttcctgagtaggtgggattacaggcatgtgtcacaacgcccggctaatttttctacttttagtagagatgaggtttcaccttgttggccatgctggtctcaaactcctgacctcaagtgatctgccctccttggcctcccaaagtgctgggattacaggcatgagccactttactctgggtattactagataatttttgcaaggatggtttatctagcttagatattaatatttactgactctccttccatcattagcagagtaatgattctaagctttgataacagtaactatcacatctaatactattctagttccaagagtgtcatttatgtcaaaattgatacttacctatgtattgttttttttggtcttatgtacttttactttttttatcactaagttgctttgggatatcattggtatttaaagatcagtttcttttgtaggcttcatgaacagttgactgagtcagaacaggctgcccagtgttacatcaaatatatccaagatatctattcctgtggggtatgtatcataccatgagaattgtactgctgatattattactgtcacctcagtaattttgctttccctttctaggaaatagtagaacacttggaggaaagcactgcctttcgctatctggcccagtactattttaagtgcaaactgtgggatgaagcttcaacttgtgcacaaaagtgttgtgcatttaatgatgtgagtatcagttctttaataaaaggtttgaattttaggctagaacataagatatttaagtggaaagcctaccttggccaggcaagcggctcacacctataatcccaacactttgggaggctgaggcaggaggatcgcttgtgtccaggagttcaagaccagcctggacaaaaaagg

SEQ ID NO: 37836 - DNA, 1052 bp, Homo sapiens
aaggaataaaaacttgcagtgtttaagaatacttttttttttaaccggaatgtgtgacagatgaaatatatttcccaagggaatatttcccttttgtacaatttgggtgttttgccaggactttagagggaatgggttatggtttcacgcccatttggtggaatgctatctattttaatggacttttatttttacctttctgattattcatttttttgtttgatttttaatcaggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttataggtgattatctataggtggtgaggtagagcagattgctgtggttaggagcctctaagcctgcaagttgccaaccttgattctgccttcttaacaacctgtcttttccatttcttagacatgccattgaggtcaacaaacgggactacagagcttggtatggcctcgggcagacctatgaaatccttaagatgccattttactgcctttattattatagacgggcccaccagcttcggtaagcctggtcacttgacaatgcgtctgatatgggaagggctaataacttttttttcctcttttgatagctattgacaaatcacagtggatggttttggctcttggggatctgaggttaaagttgctgaaggctgtttggttattttcatttagtatatttcactaatgggttaatagtataattatgaacacaaagtaatctattatatggagcatcaggttaaagaccagttgttgcatagatttgaaatagtggtgtactggttcctcaaaagagaacttcagtttctgtaaagtctttgctcagactgcctgttcttctttctcagacccaatgattctcgcatgctggttgctttaggagaatgttacgagaaactcaatcaactagtggaagccaaaaaggtaccttaaattgggtcctgaa

SEQ ID NO: 37837 - DNA, 1051 bp, Homo sapiens
acctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagaggtgagtgaataaagacaatgaaatactatcagaccctgacaggtgcattgtgctgttttctgaactatcttctttctgcagatattgacaaagccctctccatttttaatgagctaaggaaacaagacccttacaggattgaaaatatggacacattctccaaccttctttatgtcagggtgagctgcttcccttgcttggatttgattaagctcttttgtgcactaatctgggttggattgtcacccacttgtattagctacaggaaaaataatttagggagttcttttttcatgcttatattgtctttttcttttatcccagagcatgaaatcggagttgagttatctggctcataacctctgtgagattgataaatatcgtgtagaaacgtgctgtgtaattggtaagaattaactacattttttcttttaagatttatatttattataagtaacacatgtgaaaataaccacaattagctagggatggtggtgcgtgcctttagtttcctctactcaggagactgaggcgggaggatcgcttgagagcccagatgtcagggcagcagtcagctgtgatcatgtcactgcactccagggctgggcaacagagtgagagcccatctcttaaacaaacaaacaaacaaaccaacaagcaaacaaaaactcaataatacaaaagtgccaaaggtaacaaatacataccatagaatgtgaaagctcactgattaatcctactctgaagattgtttggtgaacatgattccaggatatttttctgtgcaaatagtaaaaatgtatgtgtaggggctgggcgcggtggctcatgcctgtaatcccagcactttgggatgccagggcaggcagatcatgaggtgaggtattcgagaccagc

SEQ ID NO: 37838 - DNA, 1026 bp, Homo sapiens
gatcataccactatactccagcctgggcggcagagtgagactccgtctccaaaaaaagaaaaaagagagtctgaatgtttactttgctttttaaccttttatttgaaaatgattccaaattgacaagttgcgagaataagaatagtacaaagaatacttatgtactttttttttttttttttgaaatggagtctttctctgtcacccaggctggagtgcagtggtgcgatctcaactcactgcaacctctgcctcccgggttcaagcctttctcttacctcagcctcccaagtagctgggactacaggtgcatgccagcatgtccagttaatttttgtaattttagtagagatggggtttcatcatattggtcaggctggtctcgaactcctgacctcaggtgatccacctgccttggcctcccaaagtgctgggattacaggcgtgagccactgtgcctggcacttctgtactctttatagttttgcctattgtgaacattaatcctatttgctttatcatttctctctactttatctctacacaacgtgtgcatacacatggaattgttttactctgaaccatttgagaataagttgcagatatcatcattctttaccccaaatgctttaatttgttctctttagaataaggacattttcttaaataaccacaacatagttatcaactttagtaaatttcacaccatattgttaaatatggcatttgatactatattcaatctattattgaattccaattttttttttatttgagatggagtctagctctgtcacccaggctggagtgcagtgttgtgatctcagctcactgcaacctccgcctcccaggttcaagcgattctctagcctcagcctcctgggtagctgggattacaggtgctcactaccatgcccggctaatttttgtattttttagtagggacggggtttcgccacgttgaccaggctgctctggaactcctgacctcaggtgattggcgtgcctcggcctcccaaagtgcta

SEQ ID NO: 37839 - DNA, 1005 bp, Homo sapiens
gtaatcccagctactcaggaggctgacacaggagaattgcctgaacccaggaggcagaggttgcagtaagctgagattgtgccgctgcactccagcctgggtgcgacagagcaagactccatctcaaaaaaaaaaaaaaaagaaagaaagaaagaaagaaagaaagaaagaaaaagggacataggtgtttgggaggatattatttttgactttaccctgagtaactggagaaatggtgacaacagtataatgaatttgaaaagaagggtggattcagcgggaatagatgtgttctgttttggacattgagttatagatgctaaggaggaaatttagatggaaatactaaatgaggagttgaagctatcaggatgagaaatgtacatttctggggcagctgtatagaggagaaaatggaagctaatgactctaagtttaaagtgaagagaaaggctgggaagaaagagcagtagccactgtgggactgataatgaagtagacacatataggaataatattagccaggaatcagaaaggagagatctaggacacaaatacaggtggcacatttatatattaattctttttatacattttttgttatggtaaaacaaaatttacaattttaatcatttttaagcatacagtttagtggtattaagtgccttcattttattgtgagtgtacttacccatctctaggatttttttattaccccaagcagaaattctctctttttttttttttttttttttttgtgagatatagtcttgctctgtcgcccaagctggagtgcagtggcgcaattttgtctcactgcacctccacctcctgggttcaagtgattctcctgcctcagcctcccgcgtagctgggattccaggcatgccccaccgtggccggctaattttttttgtatttttagtagagacaaggtttcaccatgttggccaggctggtcttgaatatctgacctcaggtgatctgccctcctcagcctcccaa

SEQ ID NO: 37840 - DNA, 1067 bp, Homo sapiens
gctaattttttgtattttttgtagcgatgtggtttcacaatattgcccaggctagtctcaaactcctggactcaagtgattcacacaccttggcctcccaaagtgctgggattacaggcatgagctaccatgcctggcctacatttagcatttctaaatcagctttgttgctttgaaacaagtagggctatgggtttgtctttaaaatttattcatttcacaaggccagtatggtatagtggagttagaacagttgcattctagtcctcatgcttttattttttttaattatttaattaattagatagggtcttgctctgctctgtcacccagactggagtgcagtgttgaactcctgggctcaagtaatcctcccacctcagcctcctgagtagctaggactataggtgcataccaccatgcccagctaatttttaaaattttttgtagagatggggtcttgatgtgttgcccaagctggtttggaactcctgcgctccagcaatcctcttgcctttgttgcgggatctttagggtgttgcttttctggccagaaacctttctgcccagtggtgcctttgcctgagttgttgtcctgcgtcgaggtaagcagacaagtagagggttagcaagacgaagagaagctttattgagtgttagaacagctcagaggagacccacagggggcagctcctctctgtaggcagtttgtcttatcccgtattcagctctcagcagagaggaggccctggagtgggtggctcctctctgcaggcaggtcctccctgttgatttcccagctttcagcagacagcatagctcctctctcctctttggttgtctgatcttttctccatcctctaccctgctctggctgagcctgggccttttatggacctcagaggggagaaagtgcttcctgattggttcatggactgtgagaaaaggcagcacaaatccccatccagtgggtgggactagcagcccggtccccagcctttaagccctccccgtcctgaaggtggggacttacaggaacctcccttctacccaggagcctgtctgtc

SEQ ID NO: 37841 - DNA, 1044 bp, Homo sapiens
ttgaccaggatggtcttgatctcctgacctcgtagtctgccctcctctgccccccaaagtgctgggattacagccgtgagccaccatgcccgacagcatcaatatttttaaagtttttttttttcctctccctagaaataagggtctcactatgttgcctaggcaaatcttgaactcctgggctcaagccttaaggttttgatactttctccgattcatttctaaaaaagttacaagaatttacattttcattagcaatccaaatctcatagaatttacttatttatttatttatttattttgagacagagtctcactctgtcacccaggctggagtgcagtggcgcagtctcagctcactgcaaccgctgcctccctggttcaagcaattctcctgtctcagcctcctgagtagctggaactacaggcgcatgctgccacgcccagctaattttttgtattttagtagagatggggtttcaccatcttgcccaggctggtcttgaacttctgagctcaggcaatccacttgcctcagcctcccaaaatgctaggattacaggtgtgagccaccctgcccagtcttctcatggaatttgttttttttttttttttgagatggaatcttgctctgttgtccaggctggagtgcagtgggacaatctcagctcactgcaacctctgcctcccgggttcaagagattctcttgcctcagcctcctgagcagctgggactacaggcgtgtggcaccacgcccagctaatttttgtatttttagtagagacggggtttcaccatattggccaggctgatttgaactcctgaccttgtgatccacccacctcggcctcccaaagtgctgggattacaggcatgagccaccatacctggacttctcatggaattttttaaaaaattactttctgctgagcagtctagtttgagggaaaatgctaattaggccagatgttgtggctcatccctgtaatcccagcactctgggaggctgaggtgagaggattgcttgagtccaggactttgag

SEQ ID NO: 37842 - DNA, 1035 bp, Homo sapiens
ttaagaatttttttcgttgtaaaaaatacataacatgaagtttaccatcttaaccatttacaagtgtatagttcagcagtattaagtacattcacactgttgtgcagccagtctctaggacttttcgtcttgtaaaactaaaacaactattaaacaactgcctagttccaccttactccagttgctggcaactgcatttctactctctgtctctatgaactttaatattctaggttacctcatgtaagcagaatcatacagtatttgtccttttctgtctggcttatttttcttagcataatgtgttcaaggttcatccattttgtgtgtcagaatttccttcctttaagactgaataatatttcattgtgcacacacaccacttttttttatttgttcatccaccagtggatgtttgggttgcttccacctctaggctattgtgaataatgctgctatgaacattggtgtgtaagtccccgctctcactcttgggtatgtaattgaaagtagaatggctagatcatatggtaattaggtgttaaaaaaaaatttttttttttggaagagctaccacacttatcccacatggctgtaccattttatattcccactggcaatgcacaagggttccaatttctccacatcctcaccaacactttgtttccttccttccttttttgagacagtcttatactgttgcccaggctggagtgcagtggcaaatcatagctcactgcagtttctaactcctgggcttgagtgatattcctgcctcagcctcctgaatagctagggctacaggcctgcatcacgtgacacccagctgattatttattttttgtacagatgggggcctcattatgttgcccaggctgttctcaaactcctggactcaagtgatcctcctaccttagcctcccaaagtgctgggattacaggtgtgagccactgtgtttgctttgcatagaagtaggaattttccgatgagatatttcttgactggtagtgatgataagtgtctttggaagttgt

SEQ ID NO: 37843 - DNA, 1881 bp, Homo sapiens
ctttgagggatacattgctgtatgttgtctcttgttttgcccagtttttacaacctgcatgtgacacattgctgtaccccatgattcactagttctttgatttcggaagaggagtatagggatagtagaaaaacgaaggaaaactattacagttaaagaaggttgtagtttgcctgtgtagccagcatctccttagtgagagctttatttttcattttcccctgaagggtgttcactttaaaagacatggaagtattcagcttccttaattttattttgggtgtttacacaaactggtctaacaactttgattgacttgcaggagtgagggtaaatgaatgtttatcttgtttggaaactttactggaaaaacgttaatctgcttgttttttttgtttgtttgtttgtttggttttggtttttgttggttttgtttttgttttttgagatggagtctcgctctgtcacccaggctgtagtgcaatggcgggatcttggctcactgcaacctctgcctcccaggctcaagccgattctcctgctgggattacaagcatgcactaccacgcccagctagtttttgtatttttagtagagatgggtttcctcatgttggccaggctggtctcaaactcctgaccacaggtgatccacctgtctcggcttcccaaagtcctgggattacagacatgagccaccatgcctggcccagtctgcttgtattaaacctaacatacaaaacatcagaagttattaaagtaccctttaaatttttaaagtgaaagccatccatttaataatctgcatttcccctccctagtcaggtgtcttattttaaaggtaaattcagaaacttaatgtttcccccatagaaggtagggggagggggcatgcagggaaactagtgaaaggtaattttttgcacctaattcaaaaggaataagaagccaagaccaagtttcaagttttgtttcatttatcaactttgtagaaatctaccaaacaaaaaacaattcttaggcaagctacacttttgagccattttttaaagtggaatcctataacaagattacattcttaggtgtatttgctccttggtcctctggaatgttacatggatatggaatgtaaggttgcccaactgggctatacagtagggttgcttaatgaatgtttatcttcttaaactatcagcagtggaaagtaagtagctgcttatcttaaggtcattgctttgccctccacatcattatcttatttgaagggttgctgtaaggcattttgagttctctcagttaatttgtcccaaatttctcccctctttagccttaaacgttccaaatctttggggtttgttgcctgttcttcctcagctctgagactttacctttgccatccgttttcattccattccctgccgactgcatcttaggaaactattctctgtaagtcagagcatgtcggctttttaaaaaaccaacaccttttaagaaaaaacttccagccgggcatggtggctcacgcctgtaatcctagcactttgggaggctgaggcgggcggatcacctgaggtcgggagttcgagaccagcctgaccaacatagagaaaccccgtctctactaaaaatacaaaattagtcaggcgtagtggcacatacctgaaaccccagctactcaggaggctgaggcaggagaatggcttgaacccaggaggcggaggttgcagtgaggtgacatcgtgccactgcactcctgcctggggaacaaaagggaaaccccctctcaaaaaaaaaaagaaaagaaagaacttcctacaaacccctagggttgtaggccccttgagaattggcttaccaagcataagccagtaaaattggtact

SEQ ID NO: 37844 - DNA, 2980 bp, Homo sapiens
ctggaccagacttaggggagtgttcttatcttatggatgaatgaagggggtggtatgagggtgccgagataccaagcagggctacttggacatggcttgttcttgaagtaggaattatttctggctgggcaccgtggctcatgcctgtaatcccagcactttgggaggctgtggcgagaggattacttgagctgaggagtttgagaccagcctgggtaacatggtgaagctccctctctccaaaaagttaaattagccaggcatggtgctgtgtacctgtagtcccagctactcaggaggctgaggtgggtggatcacttgagcatgggaggcagaggttgcaatgagctgaggtcatgccactgcactccagcctgggcgacagtatgaagtgaggtcttgtctcaaaaaaaaaaaaaaaattatttcctgacttacccaatcttgtgatgtttttccataaaactatggttgttggtatatttgtgccgtgatgtatttgtcaacacatcactctgaagaaaagtatgtggtgactttctgtgactgagcatgatacatcttctttctctgatcccgtttccccagatgagcatgtttcaacattttagttccttttgaggacttctgtcctaatgctgcgtctttgtacaatgcatttgcttagctgaaacagttgctattgtatgcccatttgctgtactaatcctacttctattccctataaagacatcagcctttgttctgaacataccgtaaattaggagtcttccagtcttggaatgtaaacctttggctttcattttttctatagaaatggagtaggttaatcacattgacaacccaggagggtttcttcttccctaggtattctctactgccgctgatggtcaaacgcaagtggaaattaaagtgtgtcagggtgaaagagagatggctggagacaacaaactccttggacagtttactttggtaggttattgtgaatcctgaatactatgcctccttcactgtaaagtgagataatattctaagccataaaaatattagtataaactgctggcatacacatacatactgagtagtcttgagaagaagggatgcaactagatacccatggcatcagtttttacctgaaagccttgctttttccttgtgccttaggaatttcctcagaaataaactcctgattactcatttaaaagacatttgatattgttactggtttctgatcagcattgcttattggttattggtgaggtgaataataggagatttgctatctgtcatttagtgtgtccacaggtacatacagccattatggttacttgctatagctaaacttcactggtataaaaccagttgatttcaggcagcgaactactactgttgcttataaactttgtgttttgtacattaaatcacttgtttctcccaggaaccaagtgacttgtttactagaaaaccatatagatttggaaataatagcactggacccctctgtaagaggaccttactctggatattatttattttagattggaattccaccagcccctcgtggagttcctcagattgaagttacatttgacattgatgccaatgggatagtacatgtttctgctaaagataaaggcacaggacgtgagcagcagagtaagtcaccttgtttatcagaccctaagagtgaggtgagggaggtcttgggaatagaccctcttagaatgatgagtcctctttgcccctcagttatcagatttacttgtacaagtgtaatgtttattccccacaaacaggcactgagcctgtggattgctgaagttttgatgggcaaacaggccagttggtgtttgtgtatatattgggtccttggtttcattttgctttataggactatagggtatttctcctcttcataatttgtatcaagattggctgctatgagcaggagtactcttaatgcaatggaggaagaagaggcatataactttacctgggaattaatgaaatgccttctgtttactacagttgtaatccagtcttctggtggattaagcaaagatgatattgaaaatatggttaaaaatgcagagaaatatgctgaagaagaccggcgaaagaaggtgattacttcttgtcttctgaactttaatcttagtaaagctcagtcttgacagtgggagtttggggctgggcgcagtgtctcactcctgtaatcccagcactgtaagcccactgccaaggtgggcagatcgtttgaagccgggcgtggtggtgcacgcctgcagtcccagctacttgggaggctcaggcaggagaatcgcttgaacaagaaagtgggagagtttggacatgtcataggttgtgggtaagagaaaacctaagataatctattcttccttccccgttgtttataccttatgtttgcagtgcctttattatttcttctgttttccctgtcacaattctgatgttacaaaatctagcccaaatctctctcaaagccatcccagactctttcatgccactctgatttctccctcttactctatttttatctgtaactgtatgtaacacatagcttattgtctgagtatagacattcagcaaactttggttgattggaaagtcttcgtttaaacttctaatttctctaaggaacgagttgaagcagttaatatggctgaaggaatcattcacgacacagaaaccaagatggaagaattcaaggaccaattacctgctgatgaggtgagttctattttaaagtaactcaagaggttgaacacatttttaccaatgccagtgaagtttatttttctgtgggttttgataggggtttaattattttaaaatgtttctaaatagtacttctacttgtaatggtacaggagacctggaaaagtaaggatttttgttttctttttttaagtgcaacaagctgaaagaagagatttccaaaatgagggagctcctggct

SEQ ID NO: 37845 - DNA, 1078 bp, Homo sapiens
ttcttgtgggtggcatgactaggatgcccaaggtatggaccagtggaattctgtcgtggagagagagggctggcgcatagtgtattcttgggacaggtggcacaaatatatggcccattctgctggggtgacctaaaagggagatgagattatatactcactaaagaattcttttctgtttgttttgttaaaattgaaaaataggctgggcatggtggttcacgcctataatcccaacacttcgggaggctgaggcgggcagatcacatgagtctaatttatatatatatatgtatgtatgtatgtatgaaaaattagggaggggcagaatttctttaggggcagtagcagggaggatcccgaactcagtcatagaatttttaggattgaaacaaagtttgaggtcagaggggaacataaaaccttggtaataccccgcccccggccaccatctttgtacatgtgtctttgcagcttagtgcatctctttgacaaagatttgtgcaatgatgtattttattcaacacatcattctgaaagaacgtgtggaaaactaatgactgagcacaaacctgttgaagatgcagttcttcttggtagcctaaataggattatcttggacctaagatagtgaccttgttttttttcttaatttttccattgaaatacatggccttaaggaaatatgcaaaaaaaaaaaaaatgaacctggaaaaaaaaggtcctggaccaggtggatgcctcatatattaagaaatccccgaggccgggtacagtggcttacgcctgtaatcccagcactttgggaggccaaggcgggcggatcacgaggtcaagagatcgagaccatcctggctaacacggtgaaaccctgtctctactaaaaatataaaaaatttggtgggcgcctgtagtcccagctacttgggaggctgaggtaggagaatggcgtgaacgcaggaggtggagcttgcggtgagtggagattgcgccaccgcactccagcctgagcgacacagcgagactccgtctcaaaaaaaaaaaaaagaagaagaaaaagtatccccgatactattca

SEQ ID NO: 37846 - DNA, 1027 bp, Homo sapiens
tttctgcaagcttttccttgactggagggctggaatatctgggccgtgaaggtcattgttttttctcatatagtgttctaagaccttaggggcttagtcagggcctttggtggcctctggccctgacaccaggtttggttcttctatggatacgtcacacttctggaaacaatgctgtgaagcagctcttttccctcttgtccagtttattagctatgtgttgttgtataacaaattattctcagatgtagtgggttaaaacaacagtaatagtttattatttttctgtttctttgggtcaggaatttggaaatgtaggcagggtgttgactgggtatgagaatctgcttccagtttacacgcctggctggttggtgccagttgttggtgagaggcctcggtttctctctctgtgagtttctccacagggctgtgcaggtctccccatggcttcccccagagtgaacaacataggacagcaagatggaaacttcagttctttttgtggcctagccttagaattcgacatcatcacttcctctttattcttttggtcacatagatcatctatagttaatgtgggaggcaccaacacaaaggctgggatcgctggtggggatcgccggtgaccgtgctggagactggcaccacacctagtatctggggactctgtcctaggcactgtggaaggagaccccacacatgcagggacagtcagtcacctcatggacccttgtctgaggcaggtgttccttgcagctcactgagcctatgcccttcccccatgctctggcctcacggtgctgagctgcccagctcagtagctgcctcttggctgaagtggtggcgtgtcagggggaggacagtggtttcatttttgagtctttgatcatgagagaaggctgagctcttctggaagtctgccagtggcttgtgcttccagacactggatttctcgaaatggattgaccagctgaccagccccttcctataggcttcttgccaaccttcagaggagggagccatt

SEQ ID NO: 37847 - DNA, 1078 bp, Homo sapiens
atcaacccaaatgcccatcagtgatagactggataaagaaaatgtggtacatatgcagctgtaaaaaggaacaagatcatgtcctttgcaggacatgaatggagctcgaagccattatcctcagcaaactaatgcaaaaacagaaaaccaaacaccacatattatcacttataagtgggagctgaacaatgagaacacatggacacaggaagaggaacaacatacactggaacctgttggggtggttggctggggggcaagaggtgggagagcatcaggataaatagttaatgcatgcagggcttaatacctaggtgatgggctgataggtgcagcaaaccaccatggcacatgtttacatgtaacaaacttgcatgtcctgtacgtgtgtcccggaaattaaatttattaaaaatttattacacgtatccccaaaatatgtacatctattatttattaatttaaaaattgccttggatatttttggcgctttactcttccatatggattttaggcatactctgtgaggctcaacaaaacactggatatttaagctagaatgcagtaaatgtatagattaatttatgagaattaacatatttataaaatgtgtttctgttcatgaacatgatatgtctttccagttagatggtctcacatcttttaataaaacatcataattttttccatataggtagtgaatcaatctcttttgttatgcctaattacctcatagtatttgttattgtaaagaggttaattttcaagtttttattttataattgtttgttgctggtatatgactttatagccaacaaacttgctgatgtcttattagttctaatagtttacattttttcttggatgttatttgtagataatcgtatcatttaatataaaaataattttgtttcttttcaatctttatcctccatttctctttcttattgcaatgtctagcacctttaatacagtgtttattgaaatactagtagacatccttatccttttcctgtctttaaagggaatgattctaatattttaccactaaatatgatatcttccataggttgatgaa

SEQ ID NO: 37848 - DNA, 1044 bp, Homo sapiens
gatagtacttaggggataagatctcttttctatctttattctgctgtctctctaatatatagcataggacctagtattgggtgggtgctcaggaaataattattgaatgaatacatgaaaaacaaaggaataaattgataccttggacatgaattgtttttcagagaacgttggaggctgagtggacggtgctgtttttattattaatgatgtaatcatggatgattcagataccgcaccttgaccctttaaaatctaaggccatggaaatgagtgtatagccccactggctgaaggcccagaaaatagaaggttggagattgggatgaggtcacacactggagatgccagtgtttgaataaaagttcaaatgtgacccctaggacttgtctgacctcttgtctctagtagctcatttttccacactcttatagtgacaggagaggtgctcaagccttttgcatctgataaactgattagcatattaaccgagattggcctaggaaattggatagtcatagctctcttaagctacattcaaagtctgattacttttttcaaatggcaaataatgacgaatggaaaatgacctctgactctgaccagctatcctgagtactgcagaaactaagccttcattctggggagggaggcaccactttgcttaataaacttgtcccttcagcatttcgcttgaatttgtctttgtgatgtacctctgccttctccacatcctctatgtggctgtcttcagattttttcactactatccccttcttaatttcttccttacataactctcagcacacaaagttctttgttttatcatcatctttattagcatttgttgttggactcctaaactgactcttttttttttttttttgagacgaagtttcactcttgttgcccaggctggggtgcaaagacgcgatcttggctcactgtaacttctgcttcctgggttcaagtaattttcctgcctcagcctcccgagtagctgggattacaggtgtgtgccaccatgcccggctaattttgtat

SEQ ID NO: 37849 - DNA, 1142 bp, Homo sapiens
aaattagctgggcatggtagcatgtgcctgtggtcccagctatgctactcgagaggctgaagtgggaggattgcttgaacttggaaagtcaaggctgcagtgagccatgatcacaccattgcactccagcctaggtgacagagtgaggccctgtcaggggggaaaaaaaaaagagtagacagaaaggaatacaaatgagtgcacatgggcattaaattaatgtacttgaaactactattcctacaatctggtttctgtccctgaaatttttcaagagtactatccctgaaatttttcaagagtactttgtcatcattggcatctttgtggcagtcaaactgttggctgccactttccttagggaactttacctcttggctgccatgtcattatagtcccttggtttggggatgattgtaattaatcactcactccccttttccttttttggcaacatcatcatcttactatcttctgttaataattgtagctattcacaaagattcctccagccttgtcctccttctctcttttcattttctcccataatggtactatctattcctgtggtttcgaatccaacctcactgtggatgactctagtgtctacatttaagtccagcctttctcctgtggtcttctacgtttctaccacactgtctcatcgcacctcaaactcaagaaagtggaactcattattgtttcacaaactagatttttcctcccacattctctttttatctgttcttggcattgtgactattgtagttctccaagcttgaaacttttgagtgatatttgagtctacttccttcttcactttctcattaacttagtgaacaagtcctgtggattttaatttctactattgttgtctactagacaatcattccccatttttctggtttttaaggtttttttttagagacagggtctcactgtgttgcccaggctggagtgcaggggctcttcacaggtgtgatcatagcatactacagcttgaactcctgggctcaagcagtcttcttgccccagctttctgagtggctgggattacaggtatgcatcactgtgcctggcctccccctttttcatctactaaggaacctcgataatgtgagggcagcaacatgtttaggcag

SEQ ID NO: 37850 - DNA, 1031 bp, Homo sapiens
ataattcccataattgaaggcttggctttgggctaggctcccaaagtgttgacatttccggaggactcacgccagcaccagaccttccccgcagcccacgttctagcttgttactgctattgaataggctccctgagtgcctctcttcaaccgaagaagaaagtggcttttattgagagcctttaggaggggttcaggagactggatattgggtattccagaaaccctgagttgagcaaatgagagattcgtcaaagccatgtgcctttggcttcctcattttgctgctctgcttgggtctggcttgattgacagcttgcgacggttgctcctacctgagaagtggggagtggctataataatttgggcatgagaacaggagcatagggggagggacatatttagtagataaaattgacaatagttgatgatggctgagtaggggatagaagacagggaagggagaggagggattgagagctcttgggtttccagcgtgtgcagtagaactaggcagtcctggaggaggatgagacgtgtggagggaagagcaggagctgagctttggacttcttaagtgtggaacatacaagaggagagtacagcaggcatatcacccagaagagatggcaggaagactacctaaaatctcaggctgcttttctgttgaagttatccgctggggtttaggccactatgggtagataatacagtccaaatcaaattctgtttactggctccttctattaagtgaagtagaagttgagagtttgcaagagctaacaaaccactgagctgccaggaatgaattcataatcagaggtcacaaactgtggtgactgtgttatgcaagttgcaggcttatagcaggcttccttctcccttctcttatctctcattcaccatggggaagttctaaaaaggagagatttgctaagacagtgcagtgagctatgtgtttgaactctatctaacctgtctggcaaggaggtcttgtatatcatcatgctactctccataagccctttgct

SEQ ID NO: 37851 - DNA, 1442 bp, Homo sapiens
gcacacacacacaagcacaactgtgttataaagaataggcacttctctaagaggaacttgtcctgcttcatgcaaataccctccattgcagcaaaattctggaaactttgaaagaggtacaattagtgattttttttttccccaagaagcctcaaagctcttaaaataaatcttaaaaaatctggtactcagagcttcagctcagaaagcagacaaattgcaaacctggtgcaataagactcttctctcctctgatctttttccgttttctctcaatttattttaacatcccctttcatggtcttacgtttcagaaacttgattcagtccttccttgccagctcctggcaggacaagcagcagggcttccggccctaatttatggtttatatttcttctccatcccctctttgctgccccagttctttacctcctcacatcctgctggcctttcttccatcagaaaggacagtgtcatgtgtgacatgttgctttggaattggatggcatcagtgttagcctagtgatttgggtagaatttgggaaactgttttgcgcatgtgctgctaaatgaggagatggggcctttttttttttccctctctctcttttagtaccatctttctttccccttgtcccctgtagcctccattagccctgttgccagggggaatgggaaattctttaccatgattagttctagggtattatcctataaagttacaaaatagcatttcagagcaagatgtcagagagtctccctgcagttcccatggaaccagttgacctttcagttacattttttcaacatctttaggggcccatttgaagagagctaaagcaataactaggactaagcaaagaaagctaatttggagccagaatatcttaagaagcttaaaaaattagaacctgcggatacataataaataggagcttgagctttgttcttttctttttttaaaaaattattttacctttttttctcatctgccattaactgaaaggctttgttctcttcttactccttatctttttacattactttttggttttctcccccacacttggggactctccattatttccctcatggtgcgatgaatgaggatcttgctggtgacagcctgctgagatcaggcaggtggagggagcaggggtgggctcccttcaggtactgctaaatccgaggggtttggttcatctggggaaggggtaagcttgctgtcatttctagattcatttgcctcccacaaggattcttagggactaactgcattttcaagatgattctctctgaggatgcaggaatggaagaaattttctagacagaattctaagaacatttttgtgagtctttctgagcacttcagaggctcacccaaagatgtgtaatttgtctcttttagttcttctctagcttacactattaactttccccc

SEQ ID NO: 37852 - DNA, 1038 bp, Homo sapiens
agaatcgcttgaaagcaggaggcggaggttgcagtgagccgagatggtgccactgcactccagcctgggtgacagagccagtctcaaataaataaataaataaataaataaaataaaggccaggcgtggtggctcacgcctataatcccagcactttgggaggccaaggcaggtggatcacaaggtcaggagatcgagaccatcccggctaacatggtgaaaccccatctctactaaaaatacaaaaaattagccggctgtggtggcgggcgcctgtagttccagctactcgggaggctgaggcaggagaatggcatgaacccagaaagcggagcttgcagtgagcgaagcttgcgtcactgcactccagcctgggcgacagagtgagactctgtctcaaaaaaaaaaaaaaaaaaaaaaagaatctcagcttctccacttggaagctatgtgaccttggactatttactttgctttcctgcccattaattttctcagctctaaatagggaataatgatagtgccatggtctgaatgtgtgtcccctccaaattcatatgttgaaacctaaccctcgaggtggttcctctgggaggtgattaggtcatgagggctccaccctcatgaataggattagtgcccttataaaagaggcccgaggagcttccttgcctcttctgcatgtgaggacccagtaagaaggtgccatctatgaagcagagatccctcacctgacgttgaatctgttggcatcttgttcttggacttccaagcctttagaattgttagcaataaatttctgttatatataaattatccagtctaaaatatttttattttatagcagcctgagtggactaagatagaaattggttctgagaagtagggtgttgctataacagatacctaaaatgtggaagcagctttggaactgggtaatgggtagaaggctagaggagttttgaggtgcattgccatgaaaggagccttaagggtaattccgacgaaggttcagaagagagctgtagagaaagcctc

SEQ ID NO: 37853 - DNA, 1139 bp, Homo sapiens
aggtgatatctttttagactgtttctggctgtaggccagcttatcactatggctaccaccagcttaaagaatgtcaggacagaaagtaacttctgtaagaaatttgggagagaaagggggaaggggagagaattgtttggcttaaggtcatgtagggaggagaacagctctaagtagaactctttgatttggatacagcttcgttttccttctctctgaaattttattttttcagtcaacaaatgtatataaaacatctgttacattccagagactgttaggccctgagatacagtgtcagatagggttccagcttagagtgtactgatgaatatgtcaaagttagtaaaattacacttggaataagtgtattgaaagaaagagttaagaacatctgagagggatttgacttggtcctagggctaagagggtatcatagaaggcttctttgaggaagtgatgttcgagtaaatattgtgaagaccaaacaagtatttaccaagcagagtgacaggacgttgaggaaaatttcaggctgagggcctggatttgcaaaggctctggaagcaggcagtgggtggggagttttatgaggaactgaaagtatggttggagcacagagagtgagaggagccagctgaggttggaggggttggtgagggcaggccttgtcagctgtggcatggcatttcatatttacctggagaacaggggaagcctttggagagttggtggtggttttggtggttttggatttgcaaatgagcagcacccttttggacactggatggattttgttgagggagtgaaaatgaagatcagaaaaggaacattactgtaataggttgttttccttcagtcagctaaatggcaatcttgagactaatctcctttagtgtggccttgttcctcctgattcatgtgctctctcagtgccagtagtcagtgtgttgttggggcacctggccactcagcagacatggtggcccagggtgccagcacttggcatctttccatctgcacagaaaaaggcctggaggtttcaggcttgtcacatgttaacggctgacagctacagagtcctttgtaacctgctgtgtcaccatccctctcttggctgtcactactgggtaagggct

SEQ ID NO: 37854 - DNA, 1029 bp, Homo sapiens
aactgagataaatgtgagctatacattcctttaagaaggattaacaaaaacaagtgagataattactaccctattagttcagggtcttgggtggccagagcccatcccggcagctcagggcaccaggcaggaaccagccttggacaggatgccatcccatttcaaggtacactcacacaccctgacactcatgcagactggaccccttacacgcaacagtgaacctaacaggcacgtcttcgggatgtggaaggtgactgaggacttggagaaaacccacacagacatggggagaataagcagactccacacaagcagtggccctggctgggaaacaattatttttttctcgtcggtgttataaggaaataatgttgatcgaagcaatgttatttggagacctgctgtattgttattttttaaatgtagctgagcagacccatgtgtggtcttctcttcaaattttactctgtcctcactttattcctgacatatggatttctctgtaaacaactggacccagtcgctgtagactgcctctcagatgtgacagcttggcctctctgctccctagaaatgtcctagggtttctcatgcaggggtctttggaataacaatcaggtgtaaagtatgtgcaatattttactgttttcaaattttactgttttcagtctgattcttatgacatccccatttatttattttttagttgtagtttttttagagacaacatctcactcacacccaggctggagtaacagtggtgtgatcgtagctcactgcaacctcaaaatcttgggctcaagatatcctcccacctcagcctcctgagctgggactataggcatgtgccaccatgcctggctaattttttaaaatttttttgtagagatggggttttgctatgtttccgaggctggtcttgaactcctggcctcaagcgatccttccaccttgacctcccaaagtgctgggattataagaatgagccactgtgcctggccacacaacacccccattttatggtgg

SEQ ID NO: 37855 - DNA, 1180 bp, Homo sapiens
gtttaaagttcagttggctttcccacctcaataaacctaaataaaaacatgatctgagagatggggcgggggttaagttaacccaaactaagtagacaggaggagaatgaaacttacatatttgctaagagaagaaagtgatgtgtttataaacagttttttttttttttttttttttttgaggcggagtttcgctcttgtttctcaggctggagtgcaatggtgccatctcgactcacagcaacctccgcctcccaggttcaagcgattctcctgcctcaccttcccgattagcagggattacaggcatgcgccatcgtgcccggctaattttctatttttaatagagacagggtttctccatgttgatcaggctggtctcgaactcctgacctcaggtgatctgtctacctcggcctcccaaagtgctgggattacaggcatgagccacctcgcctggcatataaacaggtttttttttgacattgtgaaagatattttgttgtgtgtgtgtgtcttttctgctctcaccccacccaagtttttttcttttctgataaaagtatagccagatttggggattgggtaggattttgatgggagccagagtgtaacgatattgggattgatatttgtataacatgggtcagaacttggtctgtggttttgagaacatggctctcgggtttttaagatggtgttaccacaccacatttatttcccctttctttcatttgtttagtgaatttaatctgctcatgaatacatgtgctgttttaatgaaattggcaatagaagagacgttctgctcccattttacaggtgatggaaatgttagtagggatgcggcagtccaggaatgaaaagttgcctagtactttgattcccacttacttccccttccctgctgttttctgaaggccagctattacttctctactgaggccaactgtgagccctggtgtgtttcattggcaggagaagaggctaattaagtgaaactgaaaggtaacaaaatggattttaaaataactgacatgtgggaacttgatccaccaatgaatgttctcctttagagtgatgtgtgcaggtgtaggtggtgggagttgaggatggcgtgcctaagtgatttggctgttgtccaaggcagttttgaaaatccacctctggaattgttttc

SEQ ID NO: 37856 - DNA, 1028 bp, Homo sapiens
ctggaggttgttggtgcctgtaaccagggtagtctcagaggagtgatggagacacatgcctggctgaactggatgaggcatgtgaagggggcgtgagagctggagccagggctgtgggcacagagccaagagatggggacctagggtggaggtctggttgtttacaactccatccaactgtgtgtcagtgggcatgggcgtgtgtgtgcacctgttgctggagtgtgtggttaactctgtgtgtgtgcatatgttgtgtgtgcaggtgtgtgtgcgtgaatgaaggggtctgcctgtgaatcagataggcatagttagaaatctctgtgtgtctggagggtttgtagccctgggtgtttcctggtgtgtacacctttgccacaggatatgctgcaagcccaagaggttagggacatttcccagggctctgccaaggcattgaggtccagcctccactttaccctgagctgggaggaggggccagccagcaggtgtggtgggcacgggtggggtctccgggctgtagccttgactacagctagcgctgtcaccttttactttttcttcctcctggctttctctgttttagaaggatgggggttgccccagcagcagcagcagagggtaaagaggacagtcggcctttgggagggctttgaggcccagcctagctcagctcctcagcaacggtgggggctgttccttgcacaccagcactttcctagatgccaggggtccatggtgccactggcgggcttctcacaagcagagatagcaggcctggagggggccagggccactccctgaccaggctgcaggggtaaacaaaggcattcccatgatcactgccaggaagaacaactcctcttggcccaccaaggttctttgcagctaccaggccactgtggagcagggcagggtcaccggccagactgagctgtcctcccctgctctacagcctcgggagctttgcctccactccatcccttcccattcccctgcattttccactcatgtgctctgggcag

SEQ ID NO: 37857 - DNA, 1006 bp, Homo sapiens
gccgagaggaatgaggttaagctgctggcagcagcggcaccccctggtctcagggctgggatgtgggaagagagcagtcctggttgttgttgctgttgtcgctatctttaatgaggagcttcctggggatggcctgtcaaacagatacaggccagaagccctggcttggcaccaggagataggaagcagaagccaccggataccctgtggcccaactcatggcaaccatggggaggtgtcctaaagttttatggagcccgtcctggaggaaaatctttttgtggaggcctgggccatccttgagagagcttcttgttcttataaagctgccaagggagacctccccacatccccacacctcaactccagtgaacccttgtcccaggaggaagagaatggatgaagtagcctctgggcttcccccaaaacccaaggagtatgggagctcagcagagggtgcttggtctgaggaggaaaccttaggggaaggaagagctgcccaatacccaaaaacctgtgtaggccatcagcttgccacctgcccctttcgtctctggggaaggagctgctgcagggatcagggtgtcagtaatggccatgggtgcagagtgctgggaactttctcccctttcttgtgcacacagaacttcctcttgcttttgctagatgcctctcatctgtccactcttctgtgtgctggacctttgagggtcccctttctgcatgagaaaatatgcatgaacccccaggactgctgctcctcccttcagccacaaagctgaatttatggagaaattcattgcaatattgttattattagcagaacgttggagacaacctaatatgctcatctgaacaatgaaatattatgcagctactgaaatgattctagacttggaaaaatgttttgaatgtatattgactgagaaaaatgggatataaagcattttggagagaaaagtcttttggcagacatttgaaaatgcctacagtggctttctctctg

SEQ ID NO: 37858 - DNA, 1050 bp, Homo sapiens
tctgctccatgactcactgagagtttgtgggtctgaggcttggtatccctaaccgggaactgggtctcccccatcccccatttccccttctccccagctcatagtcttgccagccttggcagcggtgctgggggtgttgggtaataagcccactcatggtatagtggaatggcacagctggaagccaggcacctggggttcatccctgttggacctctgtgtgacctcagacactgtcctccctttctgtgggtctctggatatgcagtctacgctcagccctcaccttctatatgagaagggcagagcgtaagcctgcatacccagcatctctgagaacccctagaggagagccatgagattggaggagtggggaaaattggccttaaagaaaatcagaatccctgtagttgctgtgttgttttaaagaatgactttggaaggggattctaagttaccagccttttctgtgtgccccagttggtcagggtttcatttaaaaaaagtctcctctgctggaggtccctgtgaactgagagtctgaagctgcccacaggcagacatggagcagactttggtcttcaccagagtgtcctggagtgtgaaggcagattagcatcactagctgagggctctggacacatctcatttcaattccctggacacagataaatctttgcaaagcctttctttcccatctttgctatctcctgcctctgataaagatgctgccctgacttctaaaacaaactcccttctttaggctgtccaggaccaggtcagaggtgggatatgctcatgtgcatgtatcggagccacatctgggggttgcttctggcagcctccacctctggtcttggcccctggctgaccctgctgagccaggcaccttgagctgtcctcctgccactctggagctcagcctatgcctcatgctctgctctggctccctggcacctcgaggttcattacaaacaataacaacaagcagagtaactttgtacttcccaacagtctttcatcctgagagctcaaagcaatttacagacc

SEQ ID NO: 37859 - DNA, 1085 bp, Homo sapiens
gacttttaactcacgggcaaacataccgtgggcttggagatggctcagggatgtcttcaactgggatggagagagtgggttcaaggaactgcttaaggctctccctaatctgaggccactgaagctctcccccaataattcccatgacatagtgagtccaaggggagtgggaaaacttcagcatggttcccaagacccccttgcaggagaattgtataggtaagactcggagtcccaaagtctcaggtaggggaagaggtagtatggggttttttcccctttcactgaaaggcatttttgcacatgactcaaacaagtctaaactttcctaaacttcaaagtttgccatggcacagcctcaaagtggaagggaaaatgttaaaaaggaaaaaagtttgtaagccagttaaatattgtgttttttcttcttaaaggaattgaattaacttgttatgttactattagcgtcccattgtgaaaatagggtgggtctttttggggtgatgtggtctctgggcccatccccaagccctgctcactctgcatgaggttgtacagggcattgcacaacctgtggtaagaggaaagagttcccatggcaacaggcctggctcacagggtcattttcaagctcctggcaagagccctggtccaggccagaggtgctccagatgcctggctgtcctccctcccctgagaaacctttgctctggaaactgggaggctggggaagtgggagcccagctggcatgccccagggtgcctcgtgactctctccacctgcccatgacccaggaactaagcatcagtcatagggctgtggagactgtgcaggtcttgcgaccagtggttaggcttgaggggtgagggctttctctactctctctcatctcctatcttcttgagcaacaccatagagctgtgcttaagagtgagctctggatacccaactgcaagggttcctaaccttgctctgccacttactaggtattgacttagacaaaaattacctcacctctctgcacttcagtttcttcaactgcaaaatgggaataatagtagacctactccatagtggtgttgtg

SEQ ID NO: 37860 - DNA, 1101 bp, Homo sapiens
atcttaaatcctcagttgagcccatctagtgattttttaattttacatttaatttgtacaccttagctctgtaatccattttaaaatgtgtttccatttccttgttgagattccctacttgtttgtttcttgatggcatattttcctataattatttgaacatatttataataaatcctttgaattctttatcttctaaatccaatatctggatccagttggagttccttcaaaattaacttggttgtacttggcctttgggcttcactctttaaccttggccccagcattttccttgtagcctcggaccaggggaagggcctcctttctgtttcatctcttcctaccctactctcaggaacctactgtcatcccacctgctctatgttgacttccctgatgattgggaccctcagagatcttgttactctctgaactactatgtttaaatttatatcccataatccagtgctggaccatgtcctgttgtttgctaatgtttatgtactttgtattcctaactagattataaactctttcaggattgggaatatgtcttttcctctagaatatcagtacattgagttccctctgtatgacaggtcttggcctgagcactttatactacctttcatttagtcttcagaacacccttgtatgataggtatcattatcctcattttccatatgaggaaactaagacccagaaaggttaaatgatgaagccaaagttagtgccaaagttagtgagagagaatgactaggcgagcattcaaactcagatctatctcactcaaagctcatgtggccatggctttttattctagttggacttgtaacctcttattctttctggccactagtctgactgttaccgtgtgaaacagacccagataaatctgtggattctttgaatggggtctggtggcccaatgttccctgcacagcgtcttgttacttcagacagcatcccatggcctgcctgtctgctttagccctggctgtgctcttcatcaggatccacccatgggctgctgcactcagaacccctgcttggtagcccaaaatagcctttgttttctcctggtggctggtggattt

SEQ ID NO: 37861 - DNA, 1107 bp, Homo sapiens
aaattgaaaggaaggtacagagatttcccatatggcctctgccctcatacatgttcaggctcccaattacaatatcccccacgagagtggtacatacattacaacagataaacctacattgacacatcattatcacccaaagtctataccttacattagggttcactcttggtggtgtacattctatgggtttggacatgtgtataaggacatacattcgctatagtatcatatagtattttcactgccctgaaaatcctctgtgctccatctattcatccttcccttgccccaacctctggcaactactgatccttttactctctccatagttttgccttttccagaatgtgatacagttggaatcatataatacgtaaccttttcaattggcttctttcctttagcaatatggatttaaggttcctccagatcttttcatggcttgatagcttttttctttttagcactgaatatttcatttactggtttaccacagtttattcattcctctaatgaaggccaactcggttgctttcaagttttggcaattatagaagatgatatgaacatctgtgtgcatgtttttgtatggacgtaagttttcaactcctttgggtaaataccagagagctcaattgctggattatatggtaagagtatgtttagttttgtaagaaactgtcaaactatcttccaaagtggctgtgcccttttgcattcccaccagcaatgaaccagaattcctgttgctccacatcctcaccagcatttggtgttgtcatgttctggactttggccattctaatagatatgtatcttgaattagtttctgaaaatcaacctgcagaggctgggcgtggtggctcacgcctgtaatcccagcactttgggaggccgaggcaggcggatcacaaggtcaggagatcaagaccatcctgtctaacacggtgaaaccccatctctactgaaaatacaaaaaattagccaggcatggcggtgtgcgcctatagtcccagctactcgggaggctgaggcaggaggatggcgtgaacccgggaggtggagcttgcagtgagccgagatcgcactactgcactccagcct

SEQ ID NO: 37862 - DNA, 1079 bp, Homo sapiens
tgcccacagctcactctggtcctcagtttctgaagacaagttggcttgcttgagacaggaggtactggggagcctgcccgctcctggtctaaagagcaatgcctgggaggaagcctctaagtgcttcttccttctagttgtgggaacctgcatatttctcaggcatgcagcatctggggctgaactgcccgtctgcgtctgtggcggctctatttttttttaaatccactttcttcatactttgcattttagtcaggaaatcactgctgcccactgtctatctaattagagtgccaggaagaaaaaggtgcttttgccattctgagcctctctgggaaaaggttatgagacaagagtgatagaattcatcttcttgcgttagtgatggggggcagggtctctgttccctgaaaagcttattcagatgacctatttggtctagactctgtctgtctcagcaatagctgtcatctgaatgtcactttagaaggtttgggtgcttccttttccttctctttcagcagtactatattacaattcgaatgctaattagtatgttttaaaagtaccccttttatcacacatttcccaaatctaaaaccttttatctctcctcattgcctctaggctgaagttcagactcctcagcctggcctccaaggcctttcacattttgacccaacctcccttcacaacctccttccatctcctcatcttcttaaaacccttgtagttcatcagagccaatccatcctttcattggccccaaatacatttacaggctggcttctgcatacccctctctgaatcaccctccttccttttgtggaacccaattctactcttctttcctaggccagctcagtccttcctcttgaagtctacccagacctcttgagtgcacagtgatttctcttgagctcaactcttttagcactatcttctatacaagtctataccacttcatttggcattaaaaaaagtgatagtgaagaacacaacacaaaatttgccatcttaactatttctaagtatacaattcagtagtattatgtgtttatattgttgtgtaacagatc

SEQ ID NO: 37863 - DNA, 1051 bp, Homo sapiens
tccctaacttgaggacgtggcaagtaggagccagcctatcccataacttcggcataaggagccattttactcccttcctccccagtgtagaatgaatgatgggctacaaaggtgtctgagccaatgccagccatacctattgagatgtggcgccttgaaagaaaaacacaagggatgtgtttgttgaagtaacttgattttccagtttctgggttactagaatttggggcctggaaacctgacgtaacagctaaagcatctgggagcctgttttgcatctgttacttttgagatcaccgtgtgcccacctggaaactctacctgtgcagtcagatgctgaagccttggttaaagcctgcagggaagccctccctgagtgaggcatcccttcctccattgtgtttactggaccacttctttctagtaattgagaattatatcctgaaagatccagaaatggaaagctccaggctgggagtggccatgcaggaaacaggatacttagacgtggaccctagaatgctggtaccgcacagatccagtcctacctcattcattttcaggtttttttcttttaattaaccaacacttatggaatctccgttaatgtcttgggtactggggacacaaagatgaatatgtcacatccctgcccatgggacactcacagtctagtgataaatagaccatttatttctccattcattcatatataagatattttgtaggcatctatcatgtgctaggcattacattgggcttatccattcattgagtaatatttgagttcctcctatatattaaaacttcttccaggtgcttggaatattgagaagacagaaatctctgccctcatggaatttactttctggtagtaagcgaccaataatatacataataaataagcaaattagataatatttagaaagttataaatattataagaaaaaaaaatggagggaggtaatgggagtgcagaggggtggattgcaattttaaatagagtggttatggtagacctaaattacaacgtgacattagagcagagaac

SEQ ID NO: 37864 - DNA, 1054 bp, Homo sapiens
ttcccataacatgtagcctgtgtttgcagctaagcagttttctcagcctgcttcctacttgtagatgtcccttttcatccaagctggtgatgttcctgctagtatagtagtccccccaatccatgcgggatatgttccacccccagtggatgtgcgaaaccacagatagtactaggccttatatgtactatgtttttcctacacatacatacatatgataaagtttaatttataaattaggcacagtaagagattaacaacacataataataacagaacaattataacaatatatactgtaataaaagttatgtgaatgtggtctctctctcaaaatatcctattgtattaaaccgtggaaagtgaaaccatagataaggggggactactatatacttcttttaaaaagtgtatggtttttccggtgaatcctattggggtttactgccttagacaaaagccacgcccacgaatcttcttaacataagctcttctctactttgagttccctctgaagctgcagtgggataatgctctttaagatttgtagaattcctattatttaatagaaaggatctgtggggcacattcttaagatctatggagaggcctggtgcagtggctcatgcctgtagtcccagtactttgggaggccagggcaggtggattgcttgaacccaggagtttgagaccagcttgggcaacatatggagacctcatctctacaatttttttttttgaaattagccaggcatagtggagcatgcctgtggtctcagctactctagaggctgaggcaggaggctcacttgagtctgggaggttgaggctgcagtgagctgtgattgcaccactgcactctagcctgggggacagagtgaaaccctgtctcaaaaacaaaaacaaaaaagacccacggaaggacttttgtttgtctcaaacattcttcgaggcattgcctttgatctttccggggtcttaacaaaagatataattcaaaaattctcaaactgagctcaatatcttcttgccataccctgttatgtttaggaca

SEQ ID NO: 37865 - DNA, 1044 bp, Homo sapiens
gaaaaaagtaaatatgcaaatatcaaagcagcagaagtcttaaccctctaagcgctgtttgcttagtggcatttggcaattttgaaaatttgtgaaaggaatggtgatatcagtatcattgaagtttccccagtgcagttttcaacaacttgttcttagatctttctttgcaagatctgaagtgctgttagtataatttgcactaaaagtaaaagaaatttcccccaaattttgtgtttggatggatgggtgtatatggtgtggggatttctgtcttacttgttgctagcaaattaaccctctcctcccacttactttttcgaatttgtacatagaaataagtccagtttatgaatttcaagagatgatacaggcaactctttaggaaactagggaaagtagatgaattaatcggtagaagtgctaaattatgacaagtttgaacaatgacttttatatttaattaaagtagacttctttaaaaacagtaatacacgcagatgaatcttgctgaactagagctccatgtcaggttgtaagaactgaagcacacatagaggacgattaaaaggtattaggatgacatgaaaggacattctgtacccaggcaaagagctaggaagcttttgccagtctggggtcaaaagacaaatttgcacttatggagtgtgattaattgctgctaatcagctataatgtttttgataattatgaaatgaagttaaattaaggagccttccttctctggctagttgggagagtgtggcatatgagctccattctacagtaacattcccttcccactttgtatatgcaggaagatccaaatggcctctccagggaccttctctgggacagaggcctgacacttccggagcctgtcagctctgctctatgcctctgttcaggacctgattgtgctgctagcctcctgagtgtggggcaggactggtggttaacatttcatttacccttgcagatgtttctagagcagcagaggcacaggtactgtagaaagtttctgtattctgcaagcaacgcaga

SEQ ID NO: 37866 - DNA, 1195 bp, Homo sapiens
gaaatctgtagatctctgcagctgggaatggaagtctcccatgtcaaaagtcaaagaaatgtcagtctaagagctttttcttcttgtccctgaatccagtacttacttcttagtaagatatttcaaatcaaattgtcccacactggagtatttggtgtaagcctgtctcgtgcttattcaaattgaggtttcgttttgtcccaactaaagctgaatttgttggcatgcggtatgacttgctggactgtgtaatcgctgaattatgatagatgtcctgtactctcatagaagttggtatgtttaccagttttaccaactgattctgggtagtgtagacaggctttgtttgagtagcaaaatatgtgtaacagcttatagtaagttttgctgccttcatctttctagatcgatacctatgatttttggaagctttcctcccccacccccttcaggaggcaaattttaggagtttagtgatgggagtatatctagacactaactatgttaaactgtgatcactttaatgagaagaatcttggcaatgtcttaataaggaggggaaaactttgggggataacagcagtttatcgctctgacattatccttaggaatattgttgactgctttttattattggttttatgttctgaaatgttttataaagacaagtagagaccagctaagaatttctaattttttattctattaagtattttgatacttggggagtattaaaatactctgagatgccttggggagctgtgaaacagtattgtacagtggaaaatagatagtaaaaatatttattgaatcttgtccaaggacagcttctgtttggttgttggtgagttgctcctgcatttgcacagtgtacatctccacataatccctagtctgggccgctgaggacttgatggtctttgtcagataaccccatagagtaactggcttctctgctcccttgtctccctcctcctactttctccttcccccaacacaatacaccttatcaattacacattgtttgttctagtgggtattcagtagcttaacagttgaatgcagaaatcatgaaagatttgaggggcagaaatatggtctgtttctaggttatgatcatctcatattatcaaaatagcatgtgtagtatagttcttaaaaagatacatttagaactgcaatcactggtaaagga

SEQ ID NO: 37867 - DNA, 1050 bp, Homo sapiens
catgaaagctagaaggagaaagtgttccaagaactgtgttgaacactgttgagaggttgagtaagatgacagagaagcacccatagagatcattggacttgaatcacagccaattcattagaggaggtagaagtgtgattggagaggtctgaggagcagataggagggaagacaggggaggcagctgccttagaaaaccgattcaagaagttttgcagaaaaaaggcagtactttcaggggactgagaggtaaagaaagggttttttaatggtttgcctcaccaagaaggatcttgcagagtaagaaatagaagattaagaagaaaggaaggttaatggtaagagtgaagtttctgagaaggtatgtggggatgaaatcattgtctaagtggaagggttgtgtgtgtgtttttgttttgttttgagacagggccttgctctgtcacccaggcttgagtgcagtggcatgatcacggctcactgcatgcagtctcaacctcctggactcaagtgatcctcctgccttagccttctgagtagctggggctacagacatgcaccaccatgcccagctgatttttttatttttgtagagatgggggtctcgctgtagagatagggtctcactaataggtgggtgatattctcggccagggttctgtaaattacagcccaagggccagctggtctcaaactccttccctcaagtgatcctcccacctcagccttccaaagtgcagggttgtattttgattcctttaaaaacacagtacagggatgctatcaattttaacagtagagaaagaagagactatacatacaggtgtaggtcgattagtagatttggtagagggaagatagagttcttatgagatttattttctcagctgagaggagggagaataggcgatttgaggagacaagacaaagcatgaaatagttattttggagagcagacaatgaacatataaaggaggtttaatagaatttccatagtgcccatttgggattcatggctctgaatttaaagtgagaccattcagcacagtt

SEQ ID NO: 37868 - DNA, 1086 bp, Homo sapiens
atgtctaatgaaggttatgatgaagggagtggtgaagtcctcttgttgattttcctcctgaatatttcagaaatctatctgctcttcttcatctccattgtcaccactaagatactgtcatctctttccaagacgattgcagtggcctcctaataggtttccaacattcacgcgtgtattctctaatccagtgcttcccaggcttttttttttttttttttttaacagtacagctctcagaaaattgtatttgcacaattcactggggtaaccggacaaaggtgctcaaagctggaggcaactgctcaggggggttttggctgccctggaccacccagccactccagggactgagggatcaatatcctgggcacatctgttacccattcatgactcataggacgtttttgggaagctctgttctcattcattctgtatgcttcagctgagtgagattgtttttaatggaaatttgacttttgctctcctgcttaaaacccagtggcattccattgccttcaagataaattccagaactttaatatggcttaagaccccacacgatctgactcagcctcaccagcctcatctctgtattctcaccctttctgtctctgtgcttcagtctccctggttgacattcagttctcccaacttgccggactccatttatctggaattactctctccccactctcacctctcctcttgttaattcctgctcatccttcagagctgagttctcaagtccctctgtgagttccttgattccatcagatgtttcctccatcgaagaccatggtttccctcagatcccttattacaatggtagctaaatgtctgtgtggcctgcaacagtataatctccagggataagtgtgtgctttgttcgcttctctactgttggtgctctttggagtgctgagtgcccaatacctgttggttagatgaattatgtgccagttcttggtgctagggttatagcattaatcaaatcagacatgatccctactctttggagcttacactgagatacagacaataaagaaataaacaagaaaccatcatgtagtaagggtgatgttt

SEQ ID NO: 37869 - DNA, 1041 bp, Homo sapiens
taggtggggctagggcagaggagagggcatttcaaatcaaggaatagtgtggacaaaagtctggaagtggagtggtggttgcagtggtgtaaccctccattgggaagtgagtgagtgggaagtgaggctggaaagatctaagggaaaggaattaaagtgaatgaaattagcattgcttctactcactttttctaagtactgcttgttctgtgcaagtagctgttctaagtcccaatgctattcattcagtgtggtttctactcagcattccgtatgtcctgggctccacagagggatcgtcctgctgcagacattccaggtcctgctgcaggtttataggaacaaatgtgctactgcttattcatagatcaatgtttcctagtcagttttcaagttttgaaactaaatttttttttcccccaaaactaattttaaaaggaaactgaaagtttggtttgggcctttacctttgagattactattagacacccaagtagagatgttgaatagacagttggatatatgaatctggaactctggactagcgaaataaaatggagaattgtctacaaattgccagtttatagatggcgtttcaagtcatagaactagcttgggtcaactaagggaaaagtatagctggagaagggacagggtttgtggactgagccctgggtcactgtagcaggaccacagaggtgtggacggcgtccattttgagtccaaataaccaagtgaatacccacatgggcaaccctctgctgatacagggccaggctgaagggttgctctcaactcccttggtggtaaggggactgctttttcatgggctgtccaagcagaggctggcagcagaagtggtcagttctgttagacctgagtcgcaagtgctctgtatgtggacaacactgcagggaggggatgcccgaacacagtccttttaaagtatagcagataaaaggtctgccatggatctgtggaatcctgagtaaaatttgagggaggtgggtactaacatgggcagaagcaaagatgcctgcg

SEQ ID NO: 37870 - DNA, 1055 bp, Homo sapiens
gagcttaaccaggcctgccagggccttcagctgtgtggctgagatgagaaaatcagcattgaggagaacactggagccaaggcatttctttgaatgtttactaagcagtcagaaggtgacttactccattccccagttccagcccctgagcatagagggtttagggttaggaggagtaccacagactgaagaggaagtagagttaagggcttggcaagttgcccactcctatccctggtctagctgcctcagaactaaaggaggcctggaactaacaagtcactcccttccagattagatgaggccagctggcctttggatgccccaggaagaggtggtggcagcagtggcatgagggatccctctgtaactccacatgccaggtcatctgcactggattagatgtccatttcaaattgtgcgtcatctggagagagaaaaggcaggaagacaggttgctggtctgaggatctgcaggctcagcatcagtgcagaaacccctcttggaactgaacccccgcactgtgtcacagtggcatttgaactcaaaggctgggacaattcttaattcctgctttccttaccgggtatctcttcctctgtctcctgctccttcagctcctccagcttggagagaggggctgttggaggagttgtgaccccgggaatctgagggaggcagcaggggggtgtccgggcaatgggtgagttcttgcactccagcaggaactttcggtcgtagatgatcctggtgcctgtcaaggggttgggactgaggtaagagtcaggagcttgggtaccgaggtgactggggtcccagactcaggccttttggggcctggaggtgagggtggtgtcaaatttccctgtgtatcaaaggacatcggctctgaagcccagctaggttctcagcagacaagccttcatagtgcttaaaatcttccagacctaaccaagatgtgggtataaagcaaggggggcatcccagctggtataggcaggggctttatgtttgggagagcttcagatcttggctctaagaggaacaccaaact

SEQ ID NO: 37871 - DNA, 1162 bp, Homo sapiens
cgctattcttgtttttcttaaaatatcaagagctctggcactcagttcacacgtgtaagtgtcagcatgcagccagagttgtgcagaagctgtgccctaaagagttggcattgttcctgtttgtctcatttaggtttatttcctggcatctgtgggcatttgagtgtgggttgcttatacttcgttagttcagtttgcccattcattcaacaaatatgggtgcctacagggtcccagacaccatagctgaccctgagaatttagtgctgtagagggcacagcccttgccttcacaaaacacttaggatagagccaagatagaccagaaataagttgtacaccactggttgatggaagaggtggcccctttaggggtcaggaaggctacctgtaagaggtgatagaaatccgacagtccaagagggaagttagccaggtgaaggggagtggggcaggtgtaccaagcacagggaaccttagctgtgaaggtgagagatattagtggatgagagtatctgaaagaatctagtgtatctggcatgcaagggggacgtagtgagaggtgagatcagagagaatgacagaagccaggtttgggggacctcataggtcagggtgatgagtttatctggaggcactaggaagcactggagcccgagagtgaagtcagggttatggattaggatgaccacttaagctatagtatgggtaaaagatttggaggacgtaataggaggtaggaaggccaattaggacacctttgagctgttcagatgagatgactgggagcagttgcattggggctggagtttgagttgtacacctttacccttgactagggaatctgctttgccagggactagtccccaccagtgagagatggaaaagaggcaacatagtggtacatgtaattaagagtttaggctctgcaatcagagagaactaggtttgaatgccatttctgcctttctctggctgtgtgaccttgggcaagtcatatactctctgaatctcaatttcctcttttgcaaaacagggataataacccctcataaataactgaattatacaaagcacttagcagtgtccagcctgccctccttaagtgtctgatacatgttttatgattttgttattgagctacctgggaatgctctagaaa

SEQ ID NO: 37872 - DNA, 1045 bp, Homo sapiens
ccccaacctgtcagtgctttgcagtccgctctctgggctgggtagaggtacctgaagaggacctggcaccggggaagagcagtattgcagtcaataactgtatccagcagctggcccagacccgcagccggagccagcctccagatggtgcctggggtgaggtgagttggctgggccctttaatggtttgggcccagggcccagcagaggtagctgtccctgaatttcctatttctcatggcaatgacctttatctgagctctgggctgacctctgtccttggcagggccagaacatgctgatgatcctgaagaaggatgccatgagcctagtgaatcccctggaccacagtctgatccactgccagcctctggtgcacatccgtgtgtggggcgtggggagctccaagggccggtgaggatgcctacatcccccaagcaagagctacttctccctcccggctgcaggctgtgatccccactgatgctgatccccagtacttgaacccctggacacagatcctctgatgtggacccaggactgcttcccctgcctggtccagccctggttggggagggtgggcccagctcagcagggacagtttggggagagtccgagaggctgggctgattcccttctgtgctcccacatgcttccggaacagtgacaggtgagtgaaaaccaggtatcctgagccccatccctgatgtccctactccatccctgctatatccctagcctgactttccagcctcctgcaggctcctgcctctaaccagcttctaccccagccccatctctgcccctgctagggacttcgcttttgtggcaagtgacaaagatagctgtatgctcaagtgccatgtgttttgctgtgatgtccctgccaaggccattgccagtgccctacatgggctttgtgcccaggtaagtgtcaggggtggggcagggaatgtgggtaaggggttgggtctgaagcttccaaggtagttggggtggtattggcccttttaccctaattcccctctctccctgtgggtcatgc

SEQ ID NO: 37873 - DNA, 1031 bp, Homo sapiens
cccattttggggatggagaggggattatgacagcatgttattctgaactcacaaatcatatgctccctcctctctaatccggtgttcctgtagatgacttgtggggggaccacagtctggaggtggaggctggcctgcctcctggctggaggaagatccacgatgctgcaggtacttactactggcatgtacccagcggtagcacccagtggcagcgcccaacctgggaactaggagatgcagaggacccaggcacggtaggtagagtgtgaggaggaggtctgagcccatgtgtggacctaggtctgctgttaaactgactaactcccactctacagggaacggaggggatctggggactgcggccccccaaagggagatccttctccagcctggagagttcactggaccggaggtaacgggtggcccaggcaaaatgaaaggcttggggttccatggtgttcaaaaatgcagctggacccatggtctgctttccagcccaggttctggattctgtcacatgttttgggttctgttacgttcttggctctgtcccaggttcttaactgtcagtattttgagttttatcccttgttctaagctcttgtttgtagctacatgtttttcatattcttggtcctaacctatcatgttctagaccttggccattaagtcctctgttctagggtctcttgtcccactttggggttctggtccacatattggaccctgttctattttgtgacttttattttttattttttgagatggagtctcactctgtcatccaggctggagtgcagtggcacgatcttggctcactgcaacctccgcctcccaggttcaagtcattctcctgcctcagcctcctgagtagctgaaactacaggcacatgccaccatgcccagctaatgtttgtatttttagtagatatggggtttcaccatgttggccaggatggtctcgatatcctgacctcatgatccacccgtctcagcctcccaaagtgttgggattacaggcgtgagcc

SEQ ID NO: 37874 - DNA, 1044 bp, Homo sapiens
tggcactatttgaggttaagacaaactgcatatgtacttcaattgctttgcacttttccgtttcagcggaagacctgaagagtggtcagaacagagcctttgatttttattatggttattttattgattattactggcaaaaacggccaggtacaacacctttttcatacaaggcccaggaggcttagtccagtctgtgctcctgggctacaaggacccagcctgagatggtcccatctgcagggccccgcaccagttggagcagatgcctccccaccaccaattgccaaaggtccaataaaatgcctcaaccacggagtctgcgtgtgtcagtgatgcctagccccgccttccccagcagaccaatgtagggatggaaaagggagaaaaacagtaaacttgtgaccctgaggttcttgtctccagcgtccaccctgcggcttgggagctcctcctcgggaggcagcccccgtacatacgcacccgcgactttgcagctttcacctgaaggtctgagcgaagcccgggcggcgcacgtgcagtggatacctccacccccctgggaggcggggtcgcgctcagagccaatgagagcttgcggggtggaggggtagggaagcttccagaggccggtggggaggaagttataaagagggtacgagggggccagctggagagccatgcagtccaagcgggattgtgaggtaagcggctggcgacttgggggccggcgagccccgccggagcgggggtcggctttagggaccccagtaccacaggagaggtgggggcgcgcttggcgatccgccattccaaccttcctttccctctcagctgtggtgtgagagggtgaatccagagaacaaggcggcgctggaggcgtgggtcagggagacaggcatccgcctggtgcaggtgaacgggcagaggaagtatggcgggccacccccaggtacggtagtcccagcccctccgcctgtccggctacaccagccccctttgggggaggggctgctccgagccttcactgtcagaaactgcgaa

SEQ ID NO: 37875 - DNA, 1055 bp, Homo sapiens
tgccaccaccatttgtttgttttattgagacagtctcactctgttgcccaggctggagtgcagtggcacaatctcggctcactgcaacctccacctcccaggttcaaggatcctcatgcatcagcctcccaagtagctgggactacaaggggcgtgtcgtcgcacccggctaatttctgtatttttagtagagacgaggtttcaccatgttggccaggctggtctcgaacccctgacctcaggcaatccatctgccttggcctcccgaagtgctgggattacaggcgtgagccactgtgcctggcctcaggtaggtgtttgttattaggccaggaaatgttctgttatctgagagagagtgtttagaaaaatggcttaaagaaaagagttctaagaattttagaaaatagacccaaacttaaaagggaatggagtttggaaggcagatagcaaatgggtgtgggaattaatagggaattatttgtacttgttttaaaactcagtggcctgtaggaaaatctgtttagagcaggatttgctttttcattattgaggtcatccttttatatttccaaaacatattgttcttggttttcaaacctcatttctggttctctggctgatttcaactccaagggcacaagagactatagtccccggcagatggcagttcgcgagaaggtgtttgacgtaatcatccgttgcttcaagcgccacggtgcagaagtcattgatacacctgtatttgaactaaaggtgaggaatgggcaagaagaaactacatggtagatgagtgggcatttgaataacaaagaagatgacaacaagagagtgagggtccaaagggcccactcctgttgtggacacagaccagtctttgctccaataagaagggggacaagaatggcttggagggagaggccctgtcttttattatcttggttgtggccagcagattccaaaagagagccattctttggaatggtaattgttctgggtcctctctacattgtattgcgtggcatctgtacttggaatgttttctagattcatgc

SEQ ID NO: 37876 - DNA, 1068 bp, Homo sapiens
ttcaaactattagatgaaaagcttactgtggaatttatgatggatcagtctgtcctcactagtgatcagttttaacatcactaaaagtaggacaactagacattatgttcctgctgatgtgatgcaagaagaagtacacagcaccacctgggaagtattcttgccaagtaaattgaacttgaatctaatcagatctttggactaactatcagtttacaggaaatactagagatggaggaacatgttagatggcacatcaagcatattgttcaccaaatctagaatgtgaaaatttttttttaggacaaatggcccaatttcctcagttaataaatgacctttttaaaataaaaaaaaaaagttggggagggaaggaaactattgtagattaaatagacatatcagctgattacaacgcatagacttcattctgaagctgattcaaataaatcaaccataaaaagatattattgaggcaactggggaaaactgaccatggcttagcattagataatattaaggagttgctgttagttttgttagttataataaagatagagtctttggggttttttaaatgtccgtatgagttagagattcatactgaagtatttatggatgaaatgatatgacgtctgggatttatttaaaaatatgtaagaaaaacatgtcagggcttaaatgaaataagaatagcagatgttaatggttgttgaagctgggtaatggataaatggtgacctgtaatactattctctatattgtgtctttgaaaatttccatactatagtgttaagattatgctagagagttaatatccattttagtattaacaatagaaaactcagtattgtggggacaagactctttcaagggatcttcatggtcaaaactatttctataataattcttttgttttgttttgttttgttttgttttgttttgttttgtttgagacggagtcttgctctgtcgcccaggctggagtgcagtggcgtgatctcagctcactgcaacctccgcctcccgggttcaagcgattgtcctgcctcagccttccgagtagct

SEQ ID NO: 37877 - DNA, 1180 bp, Homo sapiens
acagaatctctcgtcttctcttgcagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcag

SEQ ID NO: 37878 - DNA, 1035 bp, Homo sapiens
catgggagtatatatacttagacgtaaatatatgaacacatgcctcctataagcttacgaaaatgttggtatagttttcttctaggcgattccaaaaggcttatctgagtcttttctagtctggctctaaccaagagccctagtgctttatttttaagtaggataagagaaagctgagcaagtaatttgaccagtggctttgatttttctcagtgaagaggagcagggtcttcctggaacaaatggggaagtggtggggcagtggggaaagtgggaatatgttggaggacctgccaagaagggtgggagaaagtggaattgggacacacaaagagaattgctaacagcgcggaggccccagttatcattggtgctactgcaaattcatagactccagtccgcatcagcctaggtgtcagagtagagaaatgaaatggctagactgaccagggacccagaaggagaaggaagcaaaagaaaggtaatagtaggagtaataatactaatgggagtcatagtagagagcaaatgaactgatggtttagaggctcctaatgaaataggaaaggcagagtggaactgatatatcagtgaaaacagaatggtcaggagactggaaagagaggtcctgataaggctgaagagtcaagtgagagattagaaagggagagttgaaaaaacaggatgtatttgttagggaataggatatggtggtttaaggtcaaggcagctttgaggatcacgtcctgagagtggggaactaaagtagagtggggtgaaagtctttgacgtatatatacttttttgagacgggtctcgctctgttgctcaggctggagtgcagtggtgcggtcacagctcactgcaaccttgacctcctgggctcaggtgatcctcccacctcagcctgccgagcagctgggactacaggtgcacaccaccacgcctggctagtttttgtattttttgtggagatgaggtttccccatgttgcctaggctggtctcaaactctggggctcaagcgatccgccca

SEQ ID NO: 37879 - DNA, 1098 bp, Homo sapiens
acaagctgattagtatactgccctctacctgtcaggaaatttatttggaggactgatcagcagttaaattatgcagaaagctacagcttgcccttttacaaaaggatcttgtcctgttgcagctagtattttcaatagtagcaatattcgtgttctttttggggtccagaggctggaaaggtttttgttctttagtctgataccttcatgaaagcatagccttcctttgagagggctcaaagagaggtttgtattttatcagcttggtagctcattgtagcctcattatatacacactcataatcccatctctgtctcagtttctgctgaaaaactactttaagcgcataatagaacctacccacattatatatggataactagcttgagataacatactgaatccatttcttcagggaattcccctggtctaacttggatagaatatgctggtgcagaaagattttcacggtcaaagtcaaccctttgtgtcatatgttaactcctaattatccccagctagtctcatttttagagcctctttctagccatcccagctttagtgtgtgcctgtattactcttttctagaaacatatagactgaaatggtatcttttaagtccaaggtaccatctgccattatctgtggattccagattttatttctaaccaaatgtccttttaaatgtcattgtctgagacttagaccatctagttggggggtcagtattacttaaacttctaacatcttggtacagtcagttcctagccttaaatgtctgttgataccagtaaatctcaaactttagtataaggattacatgaggagcatgtttgtaacatgtaacatgtttacatgttaatggtgtgaattaagccactcttcacctgttctcttaataatattttggtatctgtatctgaataggtattatataagtattatccctgttcttatggaggtcatatgagattgattaggaaacaattcaacattttctgttgacttggcagtcaattttggagtcactgtttcagaggcacttttcttgccatcttccaaacttctcagtagccatcttagaaggacattttgaa

SEQ ID NO: 37880 - DNA, 1032 bp, Homo sapiens
ccaaagtcatggatttatgaatccactctcctatcccaattccgcaggatgtgagttacacaggccatttttttttttttttttgagttggagtcttgctctgttgcccaggctggagtgcagtggcataatctctgctcactgcaacctcagcctcctgagtagctaggattacaggcgtgtgccaccatgcctggctaatttttgtatttttagtagagatggggtttcaccatgttggtctggctgctctcgaactcctgaccttgtgatccgcccaccttggcctcccagagtgctgggattacagacgtgagccaccacacctggcctacataggccatatttgcatgcacagtattgttcccatgatgtgtttgagatgcctgtgattctgagtgagttagcctttttcttctagaaaccaagttaatataaaggaccttagggatttgctcataaaatgagcaaatttggcacagttagccaaactggtgggagaaatttaatgatgagcaagacttctctgaaataaagccttaatggttatgaagctagaggatttggagttaggaggaggatacgtagtatatatatgaatctagttcttgaataatcaccaattaacagatgaactggaagtattctctcctaatcccactgcagctattctgtgcctcaagttagtcttattctagtaagacattgctgataatcagccagccacctattttacagcctcatccgttttctaggacggaaagtacagggctcagtttactaattcttaacaccctgcctttatccacagcttgtggctgaggacctctcccaggactgcttctggacaaaggtgaaggaggaccgctttgagaacaatgaacttttcgccaaacttacccttaccttctctgcccagaccaagagtgagtaccttcctctttgatgcaaaggtccagtgtagggcttagaatattttttcattaggtttcctattcccttcccttccctgggtgaagatagaaagggtat

SEQ ID NO: 37881 - DNA, 1021 bp, Homo sapiens
ccggggataattctggttttcaattaaaaaccaggttgaaaagcttaggtttctaaccacagaggatacttttgggttccctgacttctacttttgttgttgacaggaccttcgagagattgaaaatgaagatatgagagtgcaactaaatgtgtttgatgaacaaggggaagaggattcctatgacctgaagggacggctggatgacattcgcatggagatggaatatccttttgctgactaggttcaaggcagatgagacattcattgtatttagttccctgatccctgtgtggaatggtttgggagatgatgactcagaacagagcatcaggcttatgtgtcttctcattaaataaggcaggtgtatttttattgcgctggctttacttagcttatcatagatcagggaagtcagtaaaggtgatctgagggttgttgagcatggaagccatcaaaatcagtgtaaacttcctagaatgtgatagcttagcttactaagatgtagaactggcttttagagatgtttggactgacagagggagtaatttagttacctgttaatattttcagtaagtgactttgaggcagttacctcttattttctgtctactgcctgatcttcaagccaagtacttactaggaatcctctgtgtgtatagtaccacccaattcactggtcccttaaaggacgttttagaaagcttaaagtttctggtgatgtttacaggaagaacagccagtagaatggaagtggtgtcttgctacttttccctagctttttcaagagttaaataagccacctgtcaaacataatttctgcatatttgctttccttagcctatttcccttttccactgactttaatgaagtctttcagattctcttaaacacagtgaaggattcaaaggcagagccacacttcctttccatcctgcagcacttactcttggtccgaaatgactatgaggccaggtaagatgctgtgcttatgagaagttttgaatttgagcctaagtgg

SEQ ID NO: 37882 - DNA, 1045 bp, Homo sapiens
aacattttatgtctgcatcaattctgtttcattccattatataagcctgttcactttttactgtcttatttagttaccgttcttacatacattttgcctggttaaattttcatgaagtatgtaaatatagggaatgggataggcagttctaagtctcatttatgttggtggtatgtgagatgggtatctgccctgataaacgtggcctgacatggtggcttactcctgtaatctgagcactttgggaggctgaggcagaaggatcacttgagcccaggagtttgaaatcagcctgggcaacgtagtaagaccttgtctctgctaaaaataaaaaataaaaataaagtataaactctattgactaatactagtccttaatttatgactgggtccaccattactaatctctgtctatgccttctgtctagggcatgagccagaaggagagctctaagtctgccatgatgtatattcaggagttgaggtcaggcttgcgggatatgcctctgctcagctgcctggagtcccttcgtgtgtctctcaacaacaaccctgtcaggtgaggattctgaggaggtaacaggagtaggagccaaatgttggacttcactggtggtgattgaagatcaaaggagccagggaagcatgagaatagtctgaattgggagtagtaagttgtcaggataaactttgtttggcaaataagtatttattggtttgatattgcattgcctctctctgttccttacagttgggtgcaaacatttggtgctgaaggcttggcctccttattggacattcttaaacgacttcatgatgagaaagaagagactgctgggtgaggacttccaagtctttgcaacttcaagttggagagtcacaggggacttggctatttgctctgaaggagaaagtagcagttaaatgtaaagttgtgggctaggggaatgtactgttagccaagaaggggtttatcatagtggtggctagaggatgaatgatgattatagatacaggaaagggaggaggaacttaaatttcatgt

SEQ ID NO: 37883 - DNA, 1051 bp, Homo sapiens
cagaaaagagagaagtaggagtgtataccgagggagttagtgaattgtgttgtgattatacatataagaaaacctggctgggcatgatggcaggtgccttgtaatcccagctactcaggaggctgaggcaggagaatcacttgaacccaggaggtggaggttgcagtgagccaagaacacaaaaacctttgtagttcccagggatcctgggcctcctagaatcgtcagagtgtaaggaccaagtggcattcagctgtgctgttctggtggtagtccatttagccaagaactcaaatataattgtagttgtctattacaacttagccttaacaaaatctttagaaagtaatgaaatacaggcttacagtgtgggtttatatttcccgtgtgctggccacatggttcttgcaattaccgtccatgattaactgtccatgtgaagcacagaagtaggaattagaaacactttttgctatgtagaatgtactctgtgttcagagtaatgtttagtcatactctctttttagatccctgctaacctctctgctgctaagaactacccaattaccttttgcttggctacatgagcatcctgtgccaagagaccatgcttagttgtctgagtattctctgggccctttttctgattaaagtgaaaagttaaagattcagagaatcaagtagaggtgaatcagtctcttggatgagttttcttgtgtcctgaatttacaatagattgaattctgttactaagcaaacagagggagcctctgtgcagaagactgccattggaccgtttttaaaaagctgaagtattaatacacacaaccaccaccactgcaagaacaaatccagatatgcaaaataagttttaaacttcatttatgttttctgataataattaatcagggtgtttcaaactcattaagttattaattagcttgaccttacagggaataaataccttggggtcttttgacttttttgttgttgttgttgttataaactataaagtatctaggaagtttctaatttcctgtagatggtaacc

SEQ ID NO: 37884 - DNA, 1029 bp, Homo sapiens
aagactgaaactgtggtcgatttttaaaagcttaccctgactttacattcctttagtggaaatgtgataaattttgtggcaaaggccaggcgtggtggctcacgcttgtaatcccagcactttgggaggccaaggcaggtggatcacgaggtcaggagttcaagaccatcctggctaatacggtgaaaccccgtctctactaaatatacaaaaaattagccgagtgaggtgatgggcgcctgtagttccagctactcgggaggctgagacaggagaatggtctgaacgcaggggcgtagcttgcagtgagccaagattgcgccactgcactccagcataggcaacagagtgagacttcgtctcaaaaaaaaaaatttttttttgtggcaaagctagatcaggcctcaatggtaactgaattcaagatcctattatgaccctctgttgcctcagtaccctaaggaactgtgtcaatcctgaataaagaaattaatcagagctggacccttatctctctgttctgcatgattctaagtgacatatgccttaccttacctgttctttctgggtaggtagattaggatatgaaaggaaattatttttggctgtagtgatacttatttcccattttacccataggtagactttgtcattattgagggcttattgtcctgtgggctccagtcaaggttccttggtctcattcataaggaaagacattactcttgaaggtttgatttactgagctattcgtaacaatcatagtgtactgtcatataccttgaattgaaacttttccttacttttctcaatttgaatagagtaatgaaagaataaatatactgtttcggatgatgctcctaaacctgtagtgatgctaattttaaaatttatttattaaaatgtgggccacatcagttgaataagacatgattttgccctcatgcaatttagtctggttcacagaaaaagttacaacaaatgatctgttaagaaggttctaatatagtcccggtgcggtggctcacg

SEQ ID NO: 37885 - DNA, 1031 bp, Homo sapiens
ttagtctagtgcttgccctggaccgagctctgttcttgctaccttgctttcaaaacatggtggctatcactataatttttttcatgtgttccatgggtattgcacacattgaaaactgcattctcttggaaaacctgtcactaattttctgccaggataatggtctcacgcgatttttggtctgggatgtgagagggtccaggctgtcaggctgtacagccacgtgggcgctgcgtgggagccagaggcctgcgctgctccaaccgccagggggcggtgctctccgccgcggccgcggagagctgcaccgcccactcaccacccccccccacgtgggtccgaatggttaggtccgctgggcaggtagcgcgcttccgcggcttccctccgcccctctcccttcccccattggtaggggctgcgggtccgggcggaagtggggcaggcgggcgggagcgaggcgtcgtcgttgtatattcatgaggcgcgcgcagcccggcatgctaatgaggcggggcgcggcggctggctaaagagcgactgggcggcggcgggcgcggagctgccaggcgggagcggcgtaggcgcggggtcgccggccagcgtgaaccgggacatggagccgcccggcgggagcctggggcccggccgcgggacccgggacaagaagaagggccggagcccagatgagctgccctcggcgggcggcgacggcggcaaatctaagaaatttgtgagtgtccctcccatcccgctcctgcctggccccgtaaccgccctctggacccctgcagccggcccctggggcgcctgcccggctttggggagccgcccccgcgccttccttcctcgtttcgctcggtccgcagctctgcagcccgacatcctctcccttcgggacctcgggaagccccggaatcccacccggctcttgccccggccacctcggggcttccctcgttccccagcccttacattctgccctcccgcccgcatatccccggccggctctcagccccgtctctcccctc

SEQ ID NO: 37886 - DNA, 1089 bp, Homo sapiens
aaaaaaaaaaaaggtatcaaggtacaggaaatttccactacccaacaaaggtcactcacccttttgtagttaataacttctctgcaacctagatccagccaactactgataagatgtctgtccttgtattttaccttttccagaatgttacataaatggagtcatacagtaagtaggcttttgtgtctggcttcaagcctttactttttataaagaataacaatggtaataattatagctgacatttattaaaggctgagcggatactgtatactgtgctacaggcttttcgtgggttatctcatcactgtttcacatatgtaggtatacagttctttctttaaaatatgtgactgaaaaatattattgaacattatgctaaaatttgttacactgagaagactaagaaaaacagagctcatgttttctttcaactgatttcctttttacattgtacttgagtacctggaagctgcttgcttctttccgcagctaggatacaaactccctgacagttaagtgcttctttacttcccatccagtgccttgcacagggcttggtacatggtttggtccaaaatatttgttgaataaatttgcagatagcccacgtgtgtaggagagggagagaaggttcttgaaaaatggagattggaggaatctaggatggggagggagatatgggaagggcccagacagaggcaggagggttccaacttgttcctcttccctgcagcccagtgtttcccgggctctttgagttctgctcgcgttacacaggcgcatctctgcaaggagcaacccagctgaacaacaaggtgacatagtcccgagtcctgttcttcctttcctctggatccctggactcgggatttaaccctgatcctgggctcccagcttgaggggtgggcaggaaggactgtgacttaggtgtttgtctttcagatctgtgatattgccattaactgggctggtggtctgcaccatgccaagaagtttgaggtgagtgaggaggtgatgggaaagacagtggccatcctagggtaggtgtttaggatgatggtggggggcagctgggaggggaattgc

SEQ ID NO: 37887 - DNA, 1032 bp, Homo sapiens
gtattcctgctgttatttctgagctcactttctagctctgtgaatacagggtcagcccttacgccacactggggtcccgtagatgctctttgtgcgattagggaatgctaattagaatactatctctgggctatttatgctgcatcagtcttcctgtcaaacaagttacagttgtgcttatctgtatttccgatgagaatcaggaatttttcttctgtttaatgaatttctgattggtttcaaagtattctaacataagtagccaaattgtactataggcctttaaatgaaaaaaataaaaaagtagtcccaagccgggcgcagtggctcacgcctgtaatcccagcactttcggaggccgaggcgggtggaccacctaaggtcaggagttcaagaccagcctggccaacatggtgaaaccccatctctactaaaaatacaaaaattagtcatgtgtggtggcacgtgcctgtagtcccagctactccaggaggctgaggcaggagaattgcttgaacccgggagttggaggttgcagtgacctgagattgcaccactgcactccagcctgggcaacagagtgagactctgtcttaaaaaaaaaaaaaaaaaaaaattccagacctctccttttcacccataaatccctctgcccagtgacagccactttcagctcctttcccctatgtcttctggtatttacctttggatttctaaataataatattaattgactgttattactaatctgtaatccttaggtaatacctgttatatactaggtactgttctaagtgctttacagccattagcttatttaatctcaacaacccctatgaagcagggtctattattgtttccttttaccgatgaggacacttaagcacagaaaggttaaacagtttgtacaacctcactatcattagtaggtgttaaagaacctaggtagtctagctccagaatcggtgcttgtaatcatactcccctcctgtattgtctctcattgctatttcttcatctgtcaattttagg

SEQ ID NO: 37888 - DNA, 1038 bp, Homo sapiens
acccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagata

SEQ ID NO: 37889 - DNA, 1061 bp, Homo sapiens
tactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttcc

SEQ ID NO: 37890 - DNA, 1048 bp, Homo sapiens
agtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagta

SEQ ID NO: 37891 - DNA, 1045 bp, Homo sapiens
cttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatc

SEQ ID NO: 37892 - DNA, 1026 bp, Homo sapiens
ggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttcttcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaa

SEQ ID NO: 37893 - DNA, 1057 bp, Homo sapiens
cccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgcccta

SEQ ID NO: 37894 - DNA, 1030 bp, Homo sapiens
gggatacattggcagaacgtgcaggtttgttacacaggtatacatgtgccatggtggtttgctgcactcatcaacttgtcatctacattaggtatttctcctaatcctatccctcccctaaccctgcatcccctgacaggccccagtgtgtgatgtccccctccttatgtccatgtgttctcattgttcaactcccacttatgagggagaacacgtggtgtttgatttttctgttcctgtgttaatttgctgagaacgatggtttccagcttcatccatgtccctgcaggatgtgagggcaatctggctgcgacatttgtcaccccattgatcgccagggttgatacagctgatctggctggctaggtgggtgtccccttcctctctcaccgctccacgtgcgtccctcccaaagctgcgcgctctgtcaaagaggacgatcatccctgatagacgaggaccagtctttggtcaagggtacacgagtagctgtgctctcctgctagaaccttcaaacaagctctcaaggtccatgtccctgcaaaggaaatgaactcatccttttttatggctgcatagtattccatggtctatatgtgccacattttctttatccagtctatcattgatgggcatttgggatggttccaagtctttgctattatgaacagtgctgcaataaacatatgtgtgcatgtgtgtttgcagtagaatgatttataatcttttgggtatataccaagtaatgggattgctgggtcacatggtatttctgattttagatccttgaggaatcaccacactgtcttccacaatggttgaactaatttacactcccaccaacagtgtaaaagcattcctatttctccacattctctccagcatctgttgtttgctgacttgttaatgatcgccattctaactggtatgagatggtatctcattgtggttttgatttgcatttctctaatgaccagtgattatgagcttttttcatatgtttgttggccccagaagtgtctgttcatat

SEQ ID NO: 37895 - DNA, 1098 bp, Homo sapiens
ttggaagaatagaatagctaagtttatgtgatttacaacttggaccctggctcctaagagttgaaagtcccttcattagttttagacattccactggctttgtaagtaggaaaacaggaatgcctctgcatttttggacatgtcttttagacatgtcccaggctaggctgggagttgtgaaaggaaagggatgggattctttccaccctacaatgacatccacagtgtccacagtgattccctgtcaccttatacataccttaaatgaatgtaactctctctgttgcaactgcttattttactaggtctgatttccccattagtccgaattctttgtggagaaaagggaatgcatattcaccactggtgggaatgtaaattaattcagccattgtggaaagcagtttggtgatttctcaaagaagttcaaatagaattaccatttgacccaggattcccattattgggtatatacccaaaggaaagaaaatcattataccataaagacacatgcatgtgtatgttcatgacagcactattcacaatagcaaagacatgaaatcgacctaaatggccatcagtggtagactggacaaagaaaatatgatacatatctaccatggaatactatgcagccataaaaaagaataagattatgttccttgcagcaacatggatggagctggaggccattatcctaaccaaactaatacaggaacagaaaataaaatgccataggttctcattttataagtgggagctaaacattgagtgcacatggacacaaagaagggaacggatgctgggacttacttgaacatggaaggtgcaaggaggatgatgattgaaaaactacccatttactatgcttattacctgggtgatgaaacaacctgtacaccaaaccccccacaacatgcaatttagctatataataaacccatgcatgtacacctgaacctaaaataaaagtgtttttttaaaaatacattctctacacagtggccagagacgtctttaaaaaatacaagtctgatcacatatcttccctgcttaacactctttaatggcttctcattggacttgtagtctaagcca

SEQ ID NO: 37896 - DNA, 1962 bp, Homo sapiens
taggatgtatctcaaatatcttcagatttccattttaagcaattttctctatacttttagcctaggttaccgcttgggataaaacattgtgtctaacacagcaattatttatacacatcctaaaggttaccttcagcacattcaagatacctcttaaattcagtgtcttatgggtagtgattgaatttatttataaggacaagtttttctttaactcggtgtttgggagcctcttcaattgtgaattataaaagaagtcaggctcctagtgctagataactttaaacataacttttgtcaagtcaacaataatatctgtgtccatgcagctccaccagagaagtcttggtgctgagggcaggttatgatatgaaaagccattgtaaaatgatgtcatggcaagttaaagacagtggcaacatcagaatagtgggaagttatgggatacaaaaatggaacattcaggaacactgtggatcagggaaatattaaggtcaaaattgagtttaccatagagcaagtttctcaacctcagaactattgacaatttggactggataaaccttcattgtaagggattgttctgtgtactttaaaatgtttagcagcatacctggcctctgtctgctagatgccaataggaaccccttccctgagttgagacaccaaaaatgtctttagctattgccaggtatctcctcgtggaaaaaattgcacctgcttgagaacaactggtataggaaattccacacagcagagatatcactaaaggattgattgatgcaaatgactgataaccataaatgttaatcctctatattgttagcctagacaacttctcttacttccaatctttgtatttaactggcaacatctgtatttagatgtctgaaagacactttattctgaataggtacaaacgtgcactcatggccgggcgtggtggttcacgcctgtaatcccagccctttgggaggccgaggtgggaggatcacgaggtcaggaactcgagaccagcctggccaatatggtaaaaccccatctctactaaaaatacaaaaattagctgggcttggtggtgcacacctgtagtcccagctacttgggagggtgaggcagaagaatcacttgaacctgggaggcagaggttgcagtgagctgagatcgtgccactgcactccaacctgggtgacagagagagactctgtctcaaacacacaaacaaaaccaagagtgcactcatgacatcattattattattattattattattattattattattattattatacttcaagttctgggacacatttgcaaaatgtgcaggtttgttacatagggatacatgtgccatggtggtttgctgcacccattaacccaccatctacattaggtatttctcctaatgctatcggtcccctagcccaccacccactgacaggccccagtgtgtgatgttcccaaccctgtgtccatgtgttctcatagttcaacacccacttatgagtgagaacatgcaatgtttggttttctgttcctgtgttagtttgctgagaatgatggtttccaccttcatccatgtccctgcaaaggacatgaattcatccttttttatggctgcatagtattccatggtgtatatgtgccacattttctttatccagtctattactgatgggcatttgggttggtttcaagcctttgctattgtgaacagtgctacaataaacatacatgtgcatgtgtctttatagtagaataatttataatcctttgggtatatacccagtaatggaatggctgggtcaaatggtacttctggttctagatccttgaggaattgccacacggtcttccacagtgattgaattaatttccactcccaccaacagtgtaaaattgttcctatatatatctccacatctccagaatctgttgtttcctgactttttagtaatc

SEQ ID NO: 37897 - DNA, 1034 bp, Homo sapiens
gatctccctccgagtaatagcattttttgagtgatgggtactttaattgtaatagaacttacttaaatgaactgtgggacaagtatgaacaagaaactactattagtcttgttttgcacatgaggaaggtgatacaaagaaaaagttaaatgacttgcctgagatcacgtagctagctaaggatggagtgccagggtggaactaagcactccttagtcactttgctactctgcctttacagaagtcacactgaaccgcctcaggtgactgtgcctttgttcatgctacctgtgtggcttgcattgtcacttccttgtcaaagatcctgtgtgtacttgaaggttctgcttacaaggcaccatgtctataaagccttaccagacttcttgcaattaacagctccctttttttttgggggggggggtcctctagcaactggtatatatttcaattataatattatatcactttttgtaaagtgagcttcatgatgtgtctctgcttaattcaagtgaactctctgatgactttatatcttaatcatttttaagtccccattgtccagtacatagcaacaccttgggaaatatctgcaaaaggtagaaggagtaatattttcattatctcattagattattattggctaatccaaacatttcttctaagtaaactaatttcaggtattaacatataaacattgaggattctcagtaagctgctaaaagtttattaatgacatgctatgagcaggtgttttcaataactttaattgtgaatacctagaaagtagttacttctttgggaagcaccaagaggccttgacagaggtatgatacagtcaattgtgttgataagacgtttctcagtgatgaacaacagaaaagcagacccaaacaataaagagcactttttgcctcatttttaaaaaaagaacggtggcaggaataacttgattttgtaaggataagatgtttttcttttttcctttttggttctaatttcttggtgttgcttctattttcagcaagcatctc

SEQ ID NO: 37898 - DNA, 1571 bp, Homo sapiens
gtgctgcagtgaacatacacatgcatgtatctttataatagaatgatttatattactttgggtatatatccagtaatgggattgcttagtcaaatgatatttctgtctctagatctttgaagagtttccacactgtcttctaccacggttgaactaattcacacttccaccaacagtgtaaaagtgttcccttttctctgcaaacttgatagcatctgctggtgatgattactttttaataatcaccattctgactggtgggagatggtatctcattgtagttttgatttgcatttctctaatgatcagtgatgttgagcttttttccatgtttgttgaatgcgtgaatgtcttcttttgagaagcatatgttcatgtcctttgcccactttttagtggggttgtttgtttttttcttgtaaatttgtttaaattccatgtagactctggatattagacctttgtcagatggatggattgcaaaaattttctcctatgctgtaggttgtctgttcactctgatgctagtttcttttgctgtacagaagctctttaattagatcccatttgacaagttttgcttttgttgcactttatttttgtgtttttgtcatgaaatttttacctgtgcctaggtcctgaatggtattagctagattttcttctagggtctttctagttttgagtttaatgtgtaagtctttaatctgtcttgagttaatttttgtataaggtgtaagaaaggggtccagcttcaattttctgcatatggttagccagttctcctagcatcacttattaaatagggaatcctttccctattgcttgtttttgtcaggtttgccaaagatcagatggttgtaggtgtgtggtcttatttctgaactctctattctgttccgttggtctatgtgtctgtttttgtaccagcaccatgctgttttggttactgtagccttgcagtgtagtttgaagttgggtagtgtgatgcctccagctttgttctttttgcttaggattttcttggctattcagggtcttttttggttccagatgaattttaaaatagaattttctaattccgtgatgactgcaatggtagtttaatgggcatagcattgaatctataaattactttgagcagtatggccattttcacaatattgattctttttacccatgagtatggaatgtttttccatatgtttgtgtcctttctgatttcttggagcaatggtttgtgttctccttgaagagatccttcatttctcttgttagctgtattcataggtatcttactctttttgtagcaatcgtgaatgggagttaattcataatttggctctctgcttgcctgttgctagtgtataggaatgctagcgattttgcacattcattttgtatcctgagactttacctaagctgcttatctgcttaagaagcttttgggctgagatgatagggttttctagatatagaatcatgtcatctgcaaacaaagataatttgatgtcctctctttctatttgaatatgctttatttctttttcttgcctaattgccctggccag

SEQ ID NO: 37899 - DNA, 1054 bp, Homo sapiens
tcattagttttctgtctaatgagttgattccttaggattcaaaagttgcctataatgtttttgttagtcatactataaattcatattttaaaactgctggatgttttaactgattgcaatggactccagttgccgcaatttttgccaatagctggctgttcggattaactcttgggtcttcttgaaatgaccttagaaacctttcatagattccttgatcacaagatgttcaggttcattttacagatttcctaccacagacttgtatttggccacttctctaaggagccctggttcctttaaatgggaaatggtatttaggggccacaattttggtattagaagtgtcctttgctactgagtccttccttgtttctatgccttttcaatagacaagactaggacgtatgattctttttaagaaacaaaatatatcatgaattttactgatacttccaatccatattcaggactacagtctttttattttactttactgatcttacatccattttctttctcccatcctggatacctcagctctcaagaacactaacataattacttttctgcttagtcacattcacagtagtctcagaataaaaatatcaacattattgccaacaacatgattactaaaaatagtttttattttcaattctttcttttcttgaggtatatattccaataggaaggtgtagtcaaactattggtgcctattggtgacttgaaatagttactttctctgtcattacatagttagcttaatatgtttcattttatcttcaatgtctgtcggttgcatttttacattaaatgttattttataattattaaaacataattttaatgttaattacctgttatgcaacaaagtaattaagtctagcttgaattcttaactctcagctctatttactttgtcttcttgaaagaatcaattccaaaaattttatgattggattttcactttttaaaaaatataagcaatgatgtaaatacatttgtttcctcttttttagatgtagagtagcagattttgcacacttgtcta

SEQ ID NO: 37900 - DNA, 1052 bp, Homo sapiens
ctgatttacagtctactctggaggggctagtttaacttgaaaaacctgagagtccaagcaggtttcagtagtctgaagttttatttttctaatagacatggaattcattaacgaccagggtatggcatacactacaatactgacatcttagtccagtgcctggcacactgaggtgttaaatgagaatttgttgaattaatcagtggatgcatgaatgtatagaactggcaaaggtggagctttgccagtttctgcaattttatttatattgtctatgataattttgagctctttgatttggtgcttccaaactacaacccacctttacctcttctttttgaacacgaaggcttaaaagactttgctttctctcttggtattactatagattaacctgtcatagaaaggccgtgccaaaaaaataaatagtgcagggtaatcgatagtaaataacatggctgacatgtggtgtgccatttattgactctggctttgaactagtgtgtgtgtgtgtgtgtgtgtgtgtgtgtgtgtgtgtgtctattatgactcttcttcttcttcttcttttttttctttttgagatggctctgtcgcccaggctggagtgcagtggtacgatcttggctcactgcaacctctgcctcctgggttcaagcaattctcctgcctcagccacctgagtagctgggattataggcacccgccaccacacccagctaatttttgtatttttagtagagatggggtttcaccatgttggccaggctgatcttgaacttctgacctcaagcgatctgcccacctcggcctcccaaagtgctgggatttataggcgtgagccaccgtgcctggtctattatgactcttcttaaactttagtctttgttaaactaacatgagttcattgcttaaaaaatagaaaatacgataagcaaaacctcaaattactgacaatctgaccacctagggacaatcactcttaatattttatggacttatatgttttttataagttttaacttgatgaattatgaatattcttgtcaata

SEQ ID NO: 37901 - DNA, 1195 bp, Homo sapiens
atgttagcaaagaaatctagatctgggattttcaacaagattcacctgcccttctgatagtgattattatttgattgatattggatagcttgaacatagagttaagaattcttgacttaacatgtagaatgccatatcagtatgtttgtctgggtgagaaagagaaagtggcaggatgcatgccataagttcatttgaagtatctgaaattgccttcataggttaaaaatggtcaaatattggcagtattgtattgttcaacccaatactcatttatctcgaattttaaattgttctgaactaattttttctactctgtgaaatgctttgatacccctgtcagaattcatgccaatggattagttcagtgtgcatctatcatcagatagttggcaaaatttccagatctgttatgtcatgtacctttggctagatatggcttgaagtctacagataggtaagactgggtactaccttttctagggatagtaaaggaaaataaaatattcgggcactaaatagtacagttactacatttagttgctaatacataggataatttatttccatgctctttgtagaagccttataattaaggaaatagtgtcataaattttctcagatctagaaatctttgctaaaaattcagttatttaattttcatatcaatatttgagcttgtaatagtaacagtttctaattacttatgttcagcaaggttaactctactgatgtgcttatgttttctgctatgtagtattttttgaccatatggagcccctaatttgcatttcgtgtttgccattcatcttctcaatggactatggaacagtgacaaatgactaatcactgagggaagaaatgttgggggtcaaatcaggacaagccattagtgagcagtttctttagcataaaatattttaattctgcttctcaagttatatttaagatatgcaaacaaattcatccattgtccagggtcttatactatatattttctttgaatctgtattttgaagactgacttctcttaaagtcaagacacaaagtgagtttatctcatgtacgaactctgatgtttaggttctgattgcgcaggggtccccactgagaataaatcacagtgtttgttgtggggaagtactgtgcattttttgatccttctaaatagtcagtgacttattgtaggcaagaa

SEQ ID NO: 37902 - DNA, 1045 bp, Homo sapiens
acagacatatacataattctctaccttaaatcatcagaatatacattcttcccatctgcatgtggcatacactctaaaaatgatcacacaatcagccataaaacaaccctcagcaaaatcaaaaaaccccaaaatgtaccaaacacactcttggacaacagtgcaataaaaatagaaatcgatactaaaaaattcccaaaaccatataattacgtgaaattaagcaacctgttcctgaatgacttttagataaacaataaaattaaagcagaaatcaataaattatttgaagctaatgagaacaacgatacaacataccagaatctctgggacacagctaaagcagtggtaagagcaaatttatggcactaaaagcccacatcaaaaagttagaaagatctcaaattagcaatctaacatcacacctaggggaactagagaaacaagtgcaaatcaacctcaaagttagcagaagacaagaaataacaaaaatcagagctggactgaaggaaattgagacacacacaaaaatcatacaaaagatcaatcaatccaggattttgttctttgaaagaataaataagattgataggctgctatctggtctaataaagtaaaaaagaggggagatccaaataaacactatcagaaatgacacaggttacattatcactgaccccacagaaatataaaaatctctcagtgactactacaaacacctctattgcacacaaactagaaaacctagaagaaatggtacattcctggaatcatatgacctcccaagattgatccaggaagaaactgaatccctgaaaagccactaatgagttccaaaattgaatcagtaataaaaagtctaccaaccagaaaaagcgcagccaaattctaccagatgtaaaaggagtgctggtaaaattcctactaaaactattccaaaagggttgagaaggagcaacttctcactaattccataaggccagcatcatcctgatagcaaaacctggccgatacacaataaataaagaaaaattcaggccaatat

SEQ ID NO: 37903 - DNA, 1055 bp, Homo sapiens
cagttggtaaaacacctggttttcacactgctctgcattatcatcttagatacaaagtgttatttgttcatgggtctgtttttctctgagttgttccattggtctatttgtcaatgtttgtatcaatatgacattttcataataactgtagcttttcagtaaatcttgacttctcatagagctagatctactatattttaccattcttcaagtatgttttggctatttttggcctattgcaatttcatacacgtgttaggattagtatttcatttaccacaacaaacaatcaaacaagcaaaaaatatctgttgggattttgatagggattgttttgaaattatagatcaacttgtggaaaattaattttaaaaaagttgtgtctttgtgtatctgataatagtatattctttcatttaattaagtattgtttaatccaataatacaatgtttctgttttgaatagagttatacccattttgctaggtttatcctatgtattggtaattttgtagctattatgaaaggtcttagaagaatttttaattttctattagttgctgggttatggtattgcaagtaatttttaaaatttgaggctggttgtggtggctcattcctgtaatcctaggactttgggaggccaaggcagttggatcactggaggtcaggagttggagaccagcctggccaatatggtgaaaccctgtcttccctaaaaatacaaaaattagccagtcgtgttggtgcatgcctgtaatctcaactacttgggagggtgaggcaggagaatcacttgaacctgggaggaggaggttgaagtgagccaagattgtgccactgcactccagcctgggcaacagaacaagaccccatataaaaaaaaaattgaccttgctaaattcgtttctcagttctaataatttatctgtacagtctttggatcttcactgtacagaaacattatctgccagaattttaatgacgattttacttcttcatttacaattcttctctctctctatatttcatattacatattttaatatttattt

SEQ ID NO: 37904 - DNA, 1072 bp, Homo sapiens
acaagattaatgtacacaaatcagtagctcttctatacaccaacagcaaccaagcagagaatgaaatcaagaactcaacatcttttacaatagctgcaaaaaaaagtaataaaaataaaatacttaggaatacccctaaccaaggagctgaaagacctctacaaggaaaactataaagctctgctgaaagaaatcatagacaacacgagcaaatggaaatgcatcccatgctcatggatgggtagaatcaatactgtgacaatgaccatactgccaaaggcaatctgcaaattcagtgcaatccccatcaaaataccaccatcactcttcatagaattagaaaacacaattctaaaatccatatggaaccaaaaaggagtccgcatagccaaagcaagactaagcaaaaggaacaaatttggaggcatcacactacctgatttcaaactacacaataaggccatagtcgccaaaacagcatggtactggtacaaaaacaggcacaaagaccagtggaacagaatagagaacccagaaataaacccaaatacttacagccaactgatcttcgacaaagcaaacaaaaacataaagtggggaaaggacatccttttcaacaaatggtgctgggataattggctagccatatgtaggagaatgaaactggatcctcatctctcaccttacacaaaaatcaactcaagatggattaaggacttaaatctaatacctgaaactataaaaattctagaagataacattggaaaaacccttctagacattggcttaggcaaggatttcatgaccaagaacccaaaagcaaatgcaataaaaacaaagataaatagctaaacctcattaaactgaagagcttttgcacagcaaaagaaacagcagagtaaatggacaacccacagaatgggagaaaatctttataatatatacatctgacaagactaatatccaaaatctacaatgaactcaaacaaatcagtaagaaaagtacaaacaatcctgtcaagaagtgggttaagaatagacaattctcaaaagaagatatacaaatgttctc

SEQ ID NO: 37905 - DNA, 1085 bp, Homo sapiens
cgatcttctcagcccaaaatctccttaagctgataagcaaattcagcaaagtctcaggatacaaaatcaatgtgcaaaaatcacaagcattcctacacaccaataacagacaaagagccaaatcatgagtgaactcccatttacaattgctactaagagaataaagtacctaggaatccaatttacaagggatatgaaggacctcttcagggagaactacaaactactgctcaaggaaataagagaggacacaaacaaatggaaaaacattccatgctcatgtataggaagaatcaacattatgaaaatggccatactgcccaaagtaatttataggttcaatgctatccccgtcaagctaccattgactttcttcatagaattggaaaaaactactttaaagttcatgtggaaccaaaaaagagcttgcatagccaagacaatcctaagccaaaagaacaaagctggaggcatcatgctaccttgcttcaaactatactacaagtctatagtaaccaaaacagcatggtactggtaccaaaacagatatattgaccgatggagcagaacagaggtgtcagaaataacaccacacatctacaaacatctgatctttgacaaacctgacacaaacaagcaatggggaaaggatgctctgtttaataaaaggtgttgaaaaagctggctagccatatgcagaaaactgaaactggaccccttccttacaccttatacaaaaatcaactcaagatggattaaagacttaaatgtaagacctaaaaccataaaaatcctagaagaaaacctaggcaataccattcaggacataggcatgggcaaagacttcatggctaaatcaccaaaagcaatggcaacaaaagccaaaattgacaaatgagatctaattaaattaaagagcttctgcacagcaaaagaaactatcaccagagtgaacaggcaacctacagaatgggagaaaaattttgcaatctatccatctgacaaagggctaatatccagaatctacaaagaacttaaataactttacaagtaaaaaacaaacaaccccttcaaaaagtgggcaa

SEQ ID NO: 37906 - DNA, 1097 bp, Homo sapiens
aaaaaaaaaaagctattatttattgctcactatgtgccagaaactatactaagccatatatacatgattttcaagttttagatatatatagagttatatttatatatgcatatttagaaagagttatatcgagatacacatatgcacacatacatataagcttgaagattaaactttcacatatgttaacatagttaattagctagccagggttagctaaaatggaccccagtgattctcccccctctgatatttatgcttttgtgtggtcccctcccatattatatcagagtcagtctatgtgatcagttgactatggtagaagtggtgatatgttactcctgaggctacgttataaaacacattgcagcttcctccttgctcactctgggtcattcattctggggagaagccagctgccatgttgtgagggtcctgtggaagggcccacctaagcagggacagagactttgtgcccccagctgtgtaaacgagccattttgcaagcagatgcccaagaccccgtgaagccttcagatcattgcagcctacctgcaagcttcactgcaattccacaagagactctgagccaggacctgaattctcctgggcaagggtgatgtcatgggacaactcaaggaagaagagcaggttggaggtggcactggaaattgaccaagaccacatttctcttctaaaaaagtgatatagtctgattttgtgcattagctggcttctctctaccttattctcccttccctaccaattgcttcctagtccactagcctctagtcattcaggcctccttcagggctttgaatgcaccaagctcttttctgcctcagggcttttgcgcacgttctttgctgtacttaagcagctcttcttctgcctcttgacgtgactgacttattctcatctttcaggtcttggcattcatgtcacctctacagagagagcatctccaactgctctaaaggggtagctcccctccctgtacctgtttgtttccttcaacatgcttaggataatctgtaattatttatatctttttctttacttgttagtgatgtttgaccataagattttatactttg

SEQ ID NO: 37907 - DNA, 1252 bp, Homo sapiens
agttgttagagtgctttccatttgtaaagcatcgttattttatttaattctcagaccctccgagtgagttagacattatatgttcataaatactcttagcttgcaagtaacggaaaccaccttgggtgtcttaaacaagaaaatggaattgagaaagactgactttaaaaataggggatttgccctgcaacccctgggctcagctgggcttctgaaagggcctggaaagcagtcatgactctcagctccttcctgtgtgtgctttttaatctctttgcacagctcatctgcctctccctgtcagtacaagtgcatctggctgctaacagcccaattctctgttttactggtcccaccactctgaaggagactatattccctttcgggcccaattctaaattttatctaggagagaaacataggtggcccaactttctcaagatttcactcctggtccagtcaactgcagccgttgtcaaaaatggctcctgcggaaaactatttacaaagtggctcctctatacactgggggacattaagaggaacagttgtgggttaggcagatatttcaaaagttttctatttcattatattgtttcctattttacagaggaagaaattaaaccttagtaacaccaagtgattctcaagtagtactttgtcaaatatgagtatgcagactccagatttcaagtgtgttttgagtacaccagactgttgctcatggattgctgtggacttgggaagtcaccccagtaacaccatatttgggctgcagatcgtgttttgctcatttctcatctcattgcttggtatatcattggaagttgggaatttcctctgtgtcttttacattgtttccaggttgcagctggaagctggatggacagatgcaaattttggaattttctcctggttgactgctgtgcttagagttttgatccatcagtggagggaaattgagtgaaaatgatccacatgccaatctgggctggcatctcatcgcttagcccagcgtttgtctcacatcttgtgtgtaatgccagcaactaaatctccaagctcgattagcaatggttacagcccagtgagctcacatccagaaacccccttgaaatgatgtttcatcagggagaactttaaccacaaaacctgcttctgaaccaactgaggaagacacctcaggtactgtgactctaattctggggcagttgttgaataaaatatgccatgactttatggatttattttc

SEQ ID NO: 37908 - DNA, 1087 bp, Homo sapiens
ggttgaatttctgccttgtgtgcccggttccagcacagtgcggttgtgtcgttggtcttttttagtatttcctatttccaattttctaagaaaagacagaattaaaaaaaaaatctcctagttttttattggcaaccaattcagaattgtttaaaacattgtgctggccaaaacaaaaaacatgtttgccagccagtagtttttagcctctgcttccagagtgttaaggacaggcctaaacatcctggccaagctttaatggatttgcatttttgtactctggatgtaagttttattctgcctctcctctaagactacttttagatgtatcttcctcctcattcctaaataatcctcagggattacttttcctcactcagtaattttccccctgcaggcagctattgcttccagcttcacatatatggcttagaaattttatggtctttttttttttttttttcatttacttttttttgagatagggtctcactatgtttatcaggctggtcttgaacttctggcctcaaatgatcctcctgcctctgcctctgcctcccaaagtgctgggattacaggcttgagccactgtgtctgtcctctttttggaattaattagggcttgttaatttttttaaattatatgttttgtgataaaacatttagaagtccatgttttttattctgtactgtgtagcttaagaaatgtcaaaaccaggagtacaggcttattgggcacactagaaacaagagtgggaaagggttaattcacagacctggccagtctcctcctgtcttcaaggcgatgatttaccctgtgattctcagacttcacatgtaccagaaatctttggggcaacgtgctaacgtgcaggttctcagtccctttccccagcgattctgattcgtggaatttcagttgatcattcaggacacagtataaagttcttatgcagagagaagctgacttgaactatccctatatgactgaggtgcttttaccaggaaggggcttttatagtttcagtcatatatggatgaaaaaggtgctgtattctttttctatgaactactttgtgtattttat

SEQ ID NO: 37909 - DNA, 1050 bp, Homo sapiens
ttgttagactgttacatacatatgatatatacagtggtatttgtagtagtttcatgtcttcgggaaaggaaaaggagttagtttacacgttctgtgaagaaattaaaaattataaggaaatgcaaaatgaagtcaaatatacctttaaaaatcccttaaatcatccataaagtagtatagcatacatggcatatgtatgcagcctgtgggatcgttctcttgcacactgcagtttgtgatcagctaagccaggatcaagaaagacaagggcttttggcagatatctgggtcttcagatcacattgctttcatgagagtctctagtatgaaatggggattgaagaatcccatgtgaacctgcttgtctgcgggctttacactattatatttatagcagaaatactctgtatattaatacttgataggtttccacgctttgagaaggactgaatgagatcatgcgcatggcagcttctctaggatagcaccctgcgtgaacacagtagctgctcagttaagtctttgatgggtgtgatcctgattcagcttgatcaattctgcagtcatactggattgtgtttgaaaaggtgtccagaaaaacctggccatctgcctcctgtcttcccaggtaagtgttcctggtattgacctctgagaagccttccctctttcaactttttctcatgggagttttggtaaattttcatgaattaaaacatgaatattcaggttaccacaagatggcgtcagatcatttcaagtaatgccaggtagggggagcctcagttcaataaatctttaaagaggttgaaatatgtgcctttcatagtatggtagttagctattgcaaataaacccctactttcttctactgttcttctatggaaacttgaggctcttggctgttcaactccaaaaattatgtaagtgtgaagtatttgagtttataatgtttaagaatttctctgatagcttagtgaagtaatcagaacttgaaaaatttgatcatcatgtctccctggtgtttacattttcaacgtcttttatagt

SEQ ID NO: 37910 - DNA, 1028 bp, Homo sapiens
atgctgggaagatgaaggtcatttgttaaacgataaggtgtagcctccgttagaggaggtgacacggtggccctggtcacagaggagtgaggaggacactggttaacactttgttgctatagggggcctctttagaaggaatgtcagcttgctgatatgttcgttgattttcagtatctagactagtgcctagcacctactaggtatttaataaaaacctgagcaatgaataaatgaatgaaagaatgatttacagacctgttgtagactttgccttaggccaggcttctgggcccaaaaagtaacagccaacacccaatttttttgttagaactggcactttggagtctgggtacccttaagccactgctcctttgtaaagtctttttggattgtcatcatcaagagtcagttgatctccaccttctcagaactcacagggcactctgtctaggcgttgctgaccgtctgcagtgtcagatggtgacttctgtatgtgttgtgtttcccgttagactctaaggtttttaaaggtgagactcactcctgcagaagcacataacacaatgccaaactcttatttacggaggtcctggcgcattgtcagcttttggtaaatgcttttcttttgttgaatacttatcttctgtgtgccaagctttgtgttaagtgctagaaaaatgtgggaggtcaccgcagaccctgttctcatggaactgatggtgtgtagtggggagattaacataaataaatgatgcgcaaatgaacacaaaattcaaattgatgatgtgtacttatgaaaggaaaatacatggtgcttgaatatagcagggaggcctgctgaagtcagagagggtgatctttaggaaaggctttcctgaagaagtggcactggtgaaatgatggctgaagcatgaatagaagtttcctaggaaggctgggtgtgtggtgtgtggtgtggtgtgtgtggtgtggtgtggtgtgtgtatgtgcgctcatgtgtgctttccatactttatcatgtttac

SEQ ID NO: 37911 - DNA, 1068 bp, Homo sapiens
gaatcttgaccttgccacttactagctgtgtgaccttgtgctgatttttaatctttctggttctcagcttctcttttgtgaaaaagggtacaaaagaactacttcagggatatagaactaacgtcgatgaagtgcttagtacaatgcctaatacatagtagagattcagtgaatgatggtggttgtggaagagaaaatgtagttattgttagtgtccatcattggtgttgatatatgtagttgtagtcatctttacctaggcatttggttataagcatgagcttgtacagcttttctttcatatttgagtactccttagtcatgattttaaaataccagaattagatctgtctttcattgggcattgaaaacgtagcagagattcctcctccctcagcagtattcaagttaaacaatcattttcttgttgttttcctagcctggtgtgtccgtttctctggtgaatccccagccatccaatggccacttctcaaccaaaattgaaatcaggcaaggagataactgtgattccataatcaggcgtttaatgaaaatgaatcgaggaattaaaggtaagttgttccccaaaactcccatttgtcagtagcttgtagatttggtgagttctaagcagaaaggaaaaagaaaagaaaccggcttgcttatggacagctgtgtattattatggaaaaagtactgggatcagaatcaagaaaactattctttttgggactctgtggctaggtagcttagtggctttgccatgtcacttaagctcaaaactgatttttcatttactaatgtgaggacaatagagggattagatagttttcatctttctttctagctctaaaattgtaatgagtgatttctgtctctcagagatattcagaatcaaggaacacatacccttaatattctaaactaacctgtccagcaggtctgttccttgagaaggaagagaaacagagtaaaagttattgcatgtcttccatgtattaaccatttaatccttttacagttctataatgtagagggtattcttattatttcccttttatagatggt

SEQ ID NO: 37912 - DNA, 1041 bp, Homo sapiens
ttaattcactattctctgaaacagctttaagaaggtggtatctcagaaaattaaaattttgttttttttgggtaacttaaagggatattttcacacatttggctgattccctgtaaagtgaattctttgggcttgcatgttaagtcagtctaaataaacaatcataaaaccgtatttattttataaatctgaaaaccttgtgccttcccatcttttcagtgctgccataatcttataatactttaaaagataattatttggagctagtaaatttcattaacaagcaaatgtaggtaaaggaaatcatgagtccaaggcctttcctttaactcctgaaatctgaagattttatcagttgagagaagaatgattactttggaggaagtatgttttccaacatattcttactgtgattttgtttttccataccattttggctattaggaaaatctggagaagatggggcctcgtattctggatttgcaattagaatttgatgaaaaggctgtgcttatggagaatatagtctatctgactaattcgcttgaggtaagagggccagggattgtaataaccagttaactgtagttaaaccataatccagctcttttattttataataaacctttttataaatttcatcttctgtgtttagtatctttgttaaatatattagtcgaaaatatttttggagagaagaaaaatgggtgagtataaaagttgcaggaaaaaaagtgatatgtcatcttatttcatcaattcttaatttacatataatcaattatacattaaaaaactgtatatctggctattctactgcaaattatttttaagagaccttatattcaaatgctttccaagcctctcatgttatggagtactctgaattgttgccttttttcccccctcccttttgatttgcagaattggattaattataatctttggtttagaattgctgcactgatatattggttcatgatatattatggttcatgatatattatgatttggttcatgatatattatgattgttccatg

SEQ ID NO: 37913 - DNA, 1071 bp, Homo sapiens
gtttttaacaggtcagtagctagggattcttttcacaattgtggtaacagtttcttccaagtgtccaaaagcagacattatataaacttgtatgatagttgtgtaattttttattttaatatgactaataaaatgcttttagaaatttgaaaacaagtttttatgagaccatttagtttctgaacaggagaaatattcaacacaaatcacttctttttctcttctaaactaaaaagtatgtgttgttaatttatagagaataggagagttccttctgcattgttcattgagctttcacttccccgtgatgctagggctggacacttttctgctgttctctaaggattgatagaggccaccattctatgcctggtcacatctactgttctgccttattcttgagacttttttttctacattactctccctccttccttttcttaggccaataacggaaaactgcctgacaacaaagtcattgctagtgaactaggcagtatgccagaactgaagaaatacatgaagaaagtcatgccatttgttgccatgattaaggtaagctgtggaccttatgcagctgtgaccacatgagcaatggttagatgggacaatagaaggatggggaaaagccttggacatagtctcctgccagaaatctgctaaaatagcacttttcaatcaatgactgagagaaatgatctatcagattttgggtttacttgtggaattgctgagtatgtgaaaaatattattgtgggagaaaaattggtttagaatggctgcactgaactattcccttcatattctaccttcccttctttcaaactcttttggcttacattaggcttatagaggcttgcatttcctagaccctattcctggaaccaggattcaacatttgtataggtatagcttaacagggtaaacattggttatagtggttagaccagggtgtctcagcatagctctgttggtattttgggctagatagttcttgtggggcactttcttgtgcactgtaggatatgtaatggcatccctggcttctactcattagaagccagtagaact

SEQ ID NO: 37914 - DNA, 1032 bp, Homo sapiens
tgtctaacccagacagtataggctaaatcacagtggactgagtgtgagtctggaggtcctctcctagctgtgtcactgatagctgagtaacccaaacaaggcactttatcggatgaaattcagttttcaccgctctaaaattagtgtaatatcttttcctttccgtattttgaattcttttttgtttttatctggtcatggccaacctagttaattttatttggctcatttggtttatttatattactgttattaatgattgatcactgactctctatttcagatgtcaaaatccacaggcaacttcctcactttgacccaagctattgacaaattttcagcagatggtgagtaaacatttttcttattgctgttctgtagggtccagttctcagattatagaagacacgttaaaattggtgttttaattttactttctgttttgcttttaacaaaattttaaaatcttaatgtttcctttgtggatgagcaacataatatttaatatataagaattgctgacatgatgtgttcaggaacaaatcaagctgaagttagtttgagtcttcctttaatgaactcaatatcattgctaagattcaagacttgttttgtagagatgttgagtatgggccaagcgcggtggctcacgcctgtaatcccagcactttgggaggccgaggtgggtgtatcacctgaggtcaggagttcaagaccagcctggccaacatggtgaaatcctgtctcaactaaaaatacaaaaaaaaaaaaaaaaattagctgggtgtggtggcaggtgcctgtaatccaggctactttgggaggctgaggcaggagaatcgcttgaacccgggaggcggaggttgcagtgggctgagattgcattgcactccagcttaggcaacaagagtgaaactctgtctcaaaaaaaaatgttgagtatgtaggaagcttttccaagatatttcctctgtatttggtattccattcttattaactgagacagagtcttgctctgtcacccaggctgga

SEQ ID NO: 37915 - DNA, 1286 bp, Homo sapiens
aagaaatcataatccaaagctacccagctaatgaagatagtacaagtatgcaaacccagagagattggctccacaactcttgctctcaaccccccatatgatctcattgctagaatgaatgaatgacatgtacatagtttgaaaatttaaagaatacataaaggcaaaaagttaaaagtgaactttcatccttgcctgcacactactctatttcccaaaattcatcatgatgctattggtttcttgtgattttatataccagcatctgatatctctatttgttaatgtatataaagataccacattgtttacactgttctgtcttgttttcacatgtatatgtgtgtatatatgtgtatatatatgtgtgtgtgtatatatatgtgtgtgtgtgtatatatatgtgtgtatatttatatgtgtgtgtgtgtatatatacatttttttgagagggagtcttgctttgtcgcctaggctggagtgcagtggcgcgatcttggcttaccgcaacctccacctcccaggttcaagcaactgtctgcctcagcctccccagcagctgggatcacaggcgccagccaccacacccggctaatatttgtatttttagtagagatggggcttcaccctcctggccaggctggtcttgaactcctggcctcatgatccacccgccttggcctcccaaagtgctgggattacgggcgtgagccactgcgcccagccttcacatatatttttaagatctttttatatccatacgtgtagccccacctaagtagttacgtcattgtatacctgtatcctagtttatgtagccagtcctttgatttgttttcacttcccattacaaaaaggactatagtgtatatccttgcacttttatcttagcaagcctttatgagtctattagcttttacctcaaaattttaagccagaactatcatctttgtttttttattttctatctttaaacatttatctgtgaagtgacaaatggcctacagctgtgagagcaaatggacatctcctcctgaactctgagaaggtaaggcttattgcatcttaaaagtttaaaattctgtggaaggcttttcagatttaggttgttgcacttttttttaaatgtatgtaagaaataatgtgtccaggtgtggtgcctcatgcctgtaattccagagctttgggaggccaaggtgggaggatcacttgaggccaggagttcaagaccagcctggacgatatagtgagaccccatctctaccaaaaaattagtaaataaataa

SEQ ID NO: 37916 - DNA, 2475 bp, Homo sapiens
aaaacatggtcagttttctagtggaaatttttcatggcactataaatctttagtaacaagattttctatgtttagtctttgtatatcttttttttttcttaagcagtagtttataagaaggataaaaagctgccatagggctgtgcacagtggctcaaggctgtaatccaaacactttgggaggctgaggtggaatacttgagcccaggggttcgagaccagcctgggcaacatagtgagaccctatttctataaaaaaattaaaaaattaactgggtgggttgacatgtgcctgtagtcccagctactcaggaggctgcagtgtgaagtagaagggtcacatgagccaggaggtcgaggttgtagtgagccatgatagtgccactgcgctccagcctgggtaacagagcaagaccctatctgtcaaaataaaaacaaaacaaaaaaaacataaaaccccaaaaaactgtcataggaagcccaaccttcaaaccataggattcgaaactgctgaccatcttttgtgtttttttttcctttttgttcactttttaattttcactgaaatgaaataatcagtagctagagaaagtgatccacttgatgaagattcatgcctttttaaaagcaggtgttacatagaaggaaaggtagaagatgactgaccctgggaaggcgggcaagacataatgaaaatgtgggctttcagttattggtggtatagcatttttttaaagtaatttttatccttgaggaatgaagattgatttgacatagtatctaatgtatgtttatttaccttcctttagggagatgcacttatttacatggaaccagagaaacaagtgatgtccaggtcgtcagatgaatgtgttgtggctctgtgtgaccagtggttagtctcttatagcaagaaaattcccctagtcaatttgctcacctttgacttaaaaaaaaacatatcaatttgtccactcccaggtacttggattatggagaagagaattggaagaaacagacatctcagtgcttgaagaacctggaaacgtaagatgggagaaagtgatgaaggaggaaaaaggagatgaaaaatgtggaaacagtaaagttgaaatgcaacaaaaaaagtgaaccagtaaagatacactttgtcttttgctcttttctagattctgtgaggagaccaggaggaattttgaagccaccttaggttggctacaagaacatgcttgctcaagaacttatggtctaggtaaacaaacttgaaatttttctgtttggataactttgccagttacacagaaaatatacatttttacctttcccccctgccctcaattctagtgttttctgaattgaaagcagtaagtttcctctggatggtcatgaaaactaggatatagtccactatcatctactgtgtggtagaaatatgccctctctatatagattttgtggtgtgacttttttatggagagactccaagcttcaaccatttgtcttttttttcttttttagagacagagtcttgctctgtcgcctaggctggagtgcagtggtgcgatctcagctcactgcaacctctgcctcccgggttcaagcgattctcctgcctcaacctcccgagtagctgggattgcaggcacccaccaccatgcctggctaattttttttgtacttttagtagagacggggtttcaccatgttggccagtttggtcttgaactcccgacctcaggtgatccacctgccttggcctcccaaagtgctgggattataggcgtgagccaccatgcctggcccattttgtcttttatctacaattttatttttattaattattcaagaataatttaagagcttcctaaataagtagctttgtaaatgttatagcccccttcttaaaaatgtggattctatagatgaaatgtctctcaggttcctcatgcgttactttttatttttcaggcactcacctgccttgggatgagcagtggctgattgaatcactttctgactccactatttacatggcattttacacagttgcacacctattgcaggggggtaacttgcatggacaggcagagtctccgctgggcattaggttggtaaacagataagggaaaggagcataatttgtcagtaagagttgtgatatttgatttatgtatttaaatgttttaataagatttatttcacagaattttgtcatgatatttttgcttttttactattgaactgggaaaaattaataaatagccccttactgtcatcatctattcttcattcttatggaagctgttgtccttatttgttcctgtaactacattaagaaagagattcctaatccatgtttcgattcaggtactgattcttccaaagaaattacatatatatatatataaaatagtttgttttatttttaatacagaccgcaacagatgaccaaggaagtttgggattatgttttct

SEQ ID NO: 37917 - DNA, 1023 bp, Homo sapiens
aattagaaaaaatgtagaaaaatttaacatagtttcagctatacattgatttgagagcttaatatgagaatgtattctatttccaaatttctaatttttgtttttatcatgtcctttgcctaaaagcattttcagaaattgtctttttcgtgccctctaggaatctctatggagtgaatttcttgacaagatatttcaaattagttcatattattatgcagtaaacttcaaagatttattgaatggagaatacctggtcccttcttttgctcttttagttaaggagttcatattttagataagcagttttattcagtccattaatttatttattaatgtctactaaatgccaggtgagttcaacaaacatgttctgaaccattcttttctcctaattgtgcatatgttaatgtggtttatatttccatggaaagaaggctaggctagagaacataaaaatccaaacaagttattaggtgcttcagagtcaaatgaagatttttaaggacatcaacaagaatgttttttagtttagctttcctacatttttctggataaccaagaattggttacatttcttttttttgaagtgacacatattttgaatgatgataaaagcaacacttatgtagcacttatatattaatttacttaattctgaaaataaccccattctgaagtaggcactcttatctccaatttacggatgaggaaatggaggcacaaagagattattaactgatttacttgagattagccagatagttagccagtgggaactggaattcaaactaggtagcctggctctgggatttacatttgtgtgtgtgtgtgtgtgtgtgtgtgtgtgtgtgtgtgtgtctatctgacggagtcttgctctgtctcacaggctggagtgcggtggctcaatctcagctcactgcagcctccaacttccgggttcaagcgattctcctgcctcagactcctgagtagctgggactacaggcacgtgccaccatgaccagctaatttttgtat

SEQ ID NO: 37918 - DNA, 1050 bp, Homo sapiens
gacagcacatctgtttaaagcatggtttggtgaatgttttaagcccactcttgagacctactgctcaggaaaaaaaaaaatttctttcaaaatattactgttcattgacaatgcacccaatcactcaaaagctctgatggagatatacaaggagatgaatgtttttatgcctgcaaacacaacattcattctgcagtccatgaatcaaggagtcatttgacttgtaggtcttcttatttaagagatacattttataaggctataacagtcatagatggtaattcctctgatggatctgggcaaagtaaatagaaaaccttctggaaaggattcattgttctagatgccattaagaacattcatgattcatgggaagaggtcaaaatatcaacattaacaggagtttggaagaagctgattttaactcttatggatgacgttgaaaggttcaagacttcaggggaggaggttactgcagatgtggtagaaattgcaagagaactagaattacaagtggagcttgaagataagcctgaattgctataatctcatgagaaaacttgaatggatgaggattcgcttcttacggatgagcaaaaaaagtagtttcttgagatggagtctacttctggtaaaggtgcagtgaacattgttgaaatgacaaagattttgaatatcacataaactttagttgataaagcagtagcaggttttgagaggattcactccaaattttttttttttttttgagatggagttttgctcttgttgcccaggctggagtgcaatggcatgatatcgactcactgcaacctccgcctcccgggttcaagtgattctcctgcctcagcctccctagtagctgggattacaggcatgcgccactacacctggctaattttgtattttgtattttttgtttgtttgtttgttttagtagagacggggtttctccatgttggttaggctggtctcgaactcccgacctcaagtgatccgcctgccttggcctcccaaagtgctggaattacaggcatgagccaccatgcc

SEQ ID NO: 37919 - DNA, 1028 bp, Homo sapiens
agtgcagttgtgtgatctcagctcactgcaacctctgtctcctgggctcaggtgatcctctcacctcagcctcctgagtaggtgggactgtaggcgcacgccaccacacccaggtaatttttctatttttagtagaaatggggtcttgttatgttgctgaggctggtcccaactcctgggctcaagtgatctgcccaccccggcctcccaaagtgccgggattataggcatgggccactgcacccagcattgaaaaaatttcttttgtagaaatgaagtttcactgtcttgcccaggctagtcttgaactcctgggctcaagtaatcctcccacttttgcctcccaaagtgttgggattacaggtttgagccaccatgcctggccttaatcttctcaatatactttaaggttaacagcttttaaaatttctcttttacagctgaggaaactgaggcacagagaggctaagtaaccagttcaaggttacatcactgggaattgactgggcctgggcttgtttttaggactttctgattcaaaagtcttttttccttgcttattaagctatattctaatggatatatatatatatatatatggatatatacatatatggatatatatatatatggatatatacatatatggatatatatatatatatggatatatatatatatatatggatatatatatatatggatatatatatatatatatggatatatatatatatatttgagacagagttttgctgttgttgcccaggctggagtgcaatggtgtgatctcggctcaccgcaacctccgactcccgtgttcaagcgattctcctgcctcagcctcccctgtagctgggattacaggcatgcgccaccacgcacagctaattttgtagttttactagagacgggttttctccacgttaggctagtcttgaaatcccaacctcaggtgatccgcccgcctccgcctcccaaagtgctgggattagaggtgtgagccaccaggccccagcctttttttt

SEQ ID NO: 37920 - DNA, 1026 bp, Homo sapiens
ggttgcatttaacagaagtcaactcaagttggttaaggaggaatttagtaataaagtggaagttggccaaaggcgatggctcaagcctgtaatgtcagcactttggaaagccaaggctggtggattgcttgagcctaggagttcaagaccagcctaggcaacatggtgaaaccctgtctctacaaaaaaatacaaaaactatctgggtatggtggtgcatatgcctgtagtcccagctattcaggaggctgagatgggaagattgattgagcccagtaggtcaaggctgcggtgagctggtgcttgcaccattatgctccagcctgggtggcagagggagaccctctctctctcacacagacacacacacataaatacagtgaaatttcatattacccatgaccgtagggtaggagatatgactaggcttcatgaggccctacatacttttgcctttgtgggtgggtcctttcctctgtaaaaatattagaaattatattttacagaccgggctgggtggctcatgcctgtaatcacagcactttgggaggctgagacgggtggaccacctgaggtcaggagtttgaggccagcctggccaacatggtgaaacctcgtctctactaaaaatacaaaaattagccaggtatggtggcacgcacctgtaatcccagctgctcgggaggctgaggcaggagaattgcttgaaccccagagatggaggtttcagtgagctgagattggtcttgctgtgttgcctaggctggagtgcagtggctccatcttggctcactgcaaccaccgcctcttgggttcaggtaattctcctgtctttgcctcccgagtagctgagattataggcgcatgccaacgcatccggctaatttttgtatttttagtagaaatggggtttcgccatattggccaggctggtcttgaactcgtagcctcaggtgatccacctgcctcggcctctcaaagtgctgggattacaggcatgagccaccaaacctggccaaaaaaatt

SEQ ID NO: 37921 - DNA, 1051 bp, Homo sapiens
tagatgatcatggaactaattagtattgggacttaatttttcattttaaaattataagttaattcactttttaaatttaattttgaatttcataatcgagtttgtgaccatttgtatctgtatcaagtccagctctagctctaccacttacttgctatatgagtttgatcaagttacataatcattatgcctcagttttctcatttgtgaaaatggccataataatagtatcaacctcagcaggttgttatgagaattaaataagtttgtacaagtaagatatttaataattttacttcccatcattattactattgttatctgcagaaacagaatcataataatacattcatttttgaggatatgttaattgatgctactttgtgatcatgatcttaatccaaataaattaacttcgggtgtttttcaggataactgtctgctcaaaaacctttacaaatattttcaagagtttgagtcatcttcttcattatagcatgttaagacaaccctttaaatgagattacttctatagtttgtaattactttgatctttgcaccttcctagggcatcttttatttattctgtaatttagtttctatttatacgttaactttgaggctctgctttcatctgttctttcaaggtattctttctattcctttgaataattttccattttgagcaatttgttttaggattttaatctttgtttcaaatcttttgctgtgatgaagttgtttcaattctaagaaccatctcaaaaaccatatagatgccagcattcggttctgggtatattcttcaacacttgacttagctttgcttttgaagtgctattattttaacgttttattttgaaatgattacagactcacaagaaataacaaaaatagttcagagatcccttgaacacttcactcatcttttgccaatggtcacatctcacataacagcaatatgatattaaaaccaagaaactaacatctgtacaatactgttaggtaggtggcagggccttattcagatatcaccaatttttgaaggata

SEQ ID NO: 37922 - DNA, 1044 bp, Homo sapiens
gcatcttggactctcttggctgccttcttctttccaaaggtaccatcttcttacaccatacttcttagatgttatgatgtgtgtctaaccaataatcagttgtctccttctttcttactgaggcaaccctgatttttttgttgacagaggcaatgtgcccagcttaaaaaactacatgttccagcctcccttacagatgtagttatgcagagctgaatgcaagttctagctgatattaatgtgtataagctggagacggagtaaaaattaaaatgtcagagtgtgtattaagaagacctatgaactccctctaacagaccaatgaatacaaagggaatgtgtgaagttctgtgagactgagagatatcttatgtagtgcataacttaggataaatcattaattgaaaaacatttttatgagagcaataatgaaaaagagagctcaaaatgtaagatacaagagacatgaattctggtcctggctgtaaaaagcaaaattgtgattctggacaagctctaagaaaggcagtcttccttttctctctgcttgcctttaacatcttttctttatcttcgcagttttgcaattttagtaaagatttagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaagatttaggtgtttttatttttccttctctgcactcaatgtactttctgaatctgaggattcacatctttcaacaattctggaaatatcacagccataaattatctctgtgaatattgccg

SEQ ID NO: 37923 - DNA, 1015 bp, Homo sapiens
acgtgtgcaccagcacatccagctaattgttaaattttttgtagagatgctgtctccctatgtttctcaggctggtctcaaactctcaaactcaaatgattcccctgcttccacctcccaaattgctggaattacagacatgaaccaccacgtcctgcccatgatctgtccatttctgatagaaaagcgttaaaatttccaactatcataatggattcatctctttccccttgaagttcttttaggtttttgcctcatgtattttgatcctctgttgtttgacacatacacattgagggttgttatgccttctcagataattgattacccctttatcattatgtaatgtccctctttatttctgataacttcgcttgctccgaggtctattctggatgaaattaatatagttatttgcactttcttttgattagtgttagcatggtatttctttctccattccttttcttttaatatctctgtgcctttgtacttgaagtgggttttttgtagttaatataaagttaagccttgcttcttgatccattctgacaatctctgtcttttaactggtgtatttggatcattgacaagtaaggtgattattgttacagatggattatagatggatatataccgtatttgttgatgtattctatttgttgtccttgtttttgttcctacttttgtcttctataatttttctgttttttgtggttttaactgagaattttatatgattccattttctcttctttcttagcatatcatttatacttctttttctcaactttttaaatggttaacctacagtttgcaacatatatttacaaataatccaagtctactttcaaatagtgctgtattattttatgagtagtgcaagtactttataatgataatattcctaattattttctcctatctcttgtatcatcactttcatttatttcaattatacagaagcagatgtatgtacatcagcatatataacagaatacattgttgctattgt

SEQ ID NO: 37924 - DNA, 1059 bp, Homo sapiens
tacatacatagcatacactcccacaccagatatcaatgccaagttccaaagttagacttttctaattctatttgccagagaatccaggaactagaagctactttgtacaatgctctacagcaagaaactgttatcaagtttggtgaattattaagtgaaaaacagcaagaggagctgaggacggcagtagaaaagttacggcggcaaatgctgaggaagagcagagagtatgactgtcagattcttcaggagagaatggagctcttacagcaagcccatcaggtgaggactgagtcactgcctctgcgtagggttagtactagcaaatggaacttagtactaggtacacggtattgagtatgggtacggagaagcccaggagatacaagttattttcagagagtaaaataaataaccattgttttctaccttcatgcacatacaaaaatgacagttttataataattcaatcttgagaaaattggcatttcagaaggactgaatactgctactatttttagaactacgttttcatgaaataccctttgaatttcatggtgtctgattatctgccttatgcagggaagcaggacactctccagggcaaaaatagtgcttcccatgtattgctcactccagtccgtaaacaagcctgataataatccgaatagtgtaaaagagagcaaggaccgttcacattacaaacatcaccaccaacaaagcctggcagctgctgtttacttactgacatttgctttatgtcagtaactaaactaaggactctacttacatcatttcatttaatcttcataatagccctatgaggtaagtatttttattatctcaattttggagataacaatactgtagataagaatgcttaagtgatttgcccaagataacacagatggtaagcaacagtcaggatgacagcctaggtctgctgaactccaaggtcagtgtgtctaaccactgtattgtaccgtcatccatgacttatgtgattcatcagcaaggtccaaaataggcacccactactaatttccagcaaaaattttt

SEQ ID NO: 37925 - DNA, 1031 bp, Homo sapiens
cttcatacaaagaaagtcctactcttgaaacactagcatttgttgcctatccccagtgtacaataggcatcacattttagctgatgctgtaaggatagagccatctgtggtgtttgtatttctggaattctatttttgttctgcgattggcttttgctattgttgttaatccagaaattttagggttttttttatgagtaagatgttcaagaaaactagttcatttatggctggggtaaaaaatgtttcttaattcctctctattccccaagccactcagccttcatcccacctcacttgcctctctgcctaccctcttttcttgaggtcttgctgttatttaaagagtccctctctaattgtttttttttcaccaatgtaaacaacttccctagatctttcaattactttttcttgccctggaattctctctacatctgttcttcaccatttccacccaggctagagcctgattctgtcttatttaacaattgtacacattttcttactgtaacccatcttgacttacttgaacacaactgtgctcatgtcaacacatactcaagccagcagcaattctttcaacctaccaaatcagaactttaactgccgttattttctttaaattttctttaccctacatttcaaatgtgatatgctttagtgtttttcctactgtatgtaataatagatgggtgtatattttctcttttattgattagatcatagcatgagcaaaggcctgggggatagaagagcatagacaaattacaggaaaaggtaggcagtgaatagatcttatatggccaaatcttagataacgtagattgtgataaatgaggttcaagccagactgtgaagagcctttcagagctgaggaggtggcatttttctatggcccacagagtaccagtgaaaatccagattatttttgtacaaccactttccactttgagcaactctaggaagctatattagtccattctcatgctgctatgaagaaatacctgagactgggtagtttatgaaag

SEQ ID NO: 37926 - DNA, 1057 bp, Homo sapiens
atgtgtgttgaaaaagtcttctctcaaagctgtctacacctactcaccacacactttatccacagctgccctagttgggcttccattgtcatcattctaatgatactgcatctgtcaaatccttaacaaactatgtcccttgatgcttaattctaaagtcatttttttctctttctttttcttatattgacctctcagataaaactgttgaccacacttttcttattaatggctttcccttcatggttttgataactacacactgagtgattttttttttttttttcactgactgcctcttctcttgtccctcttctgctttccatctctaaacatttgggtttaccaaggctcagtgcttgacttccttgttttctggctacattctccccaggtaatctcatgcatctgcatctctaggataacaccagtctgcagtcctgacttcccctcagaagtccaggctcacactcagttgttgacttaacatttccactaatgtgtttacaagtctttcgatcttcacaggggcaaagtagacttctttactcatatgcatgctccaccccagcacaaacgtgtccttctttctctccattttagtaaatggcattaggttttaaagccaatttgaagagctgtccttgatttctttctttcctttataactctcattcaatctgttaacaatcctgttgcttttacctcaaaacattccctaaatctgtttacttttccatctctattgccaccttcccatgtagggctgccatcttcccctgcctgaactacctcagtaacccacgactgggactacctgcttctctcccctgtatggtaaattctcctcacagagaacacaatgacccttttaaatattgtcaaaattaccaaatcctacgaattgactttgcagactcctctcctgatctcttcctcatgtcttcctcttcctgttaatcagacacacttttcttgacttgcacttctccttaccttattaggttagctgcttcttgtcattcaaattgcagcttaagtgtcctgttttaaggga

SEQ ID NO: 37927 - DNA, 1077 bp, Homo sapiens
tgtatgaatgggatcaacctgtaaggggaaggggtgatggacagtatggagtaggaactcattcaaagatgccccattaatatattatttaaaatgtgtctctaagtatagttgtccatgttaaatttcacttttgcagtatcctgaacatggcagtggtttcacaactctatagcttggtcgaaactcacagatctgtacacccaaaccagcaaattttactacatataaatctaaaaacaaattataaaattttagtgttgtcaggattttcccagtccttcatactcttgatgtctgtttcattgttttggctgcccttgcccgaaagagctgactcgggacactgttttctagatttcctttccagtaccctgaatgttcatctatttgatttttattgataataaaatatgaattagttaactgcagtctcaaacataaatagattaaaccaaacaataccgggaagactggaggacaaagaccagctaacacagaaaggggccaggaggctcttatctggactgtgataactctgctttgccaccctttatctgcctctgttctctgctgcttcacacggtcggcttttcagtgttcaaacagcaggttaatatggagtttgccggatagtaagtgattaagaacgccctattttgaattgatgtggtcttatgttcccttgctcaattctgttaattccttttgaactaggctgacttctgggcagctgtttcccagttagatacagtctgaagcctctctcctccttctctggctccacattcattttttagttacagacatatgatgtcactgtgtctgaacacctgttctgctttacaacccctcctgcatgtgagtctacttcttcccaagccatctcctctcataaaaatgagtgatcatcgtttagttcacatggaagcggtttcctttgacatccaaggacccttggttcctgggcaactgtgacccctctggagaggacagatgctcaagggaaaatccaactgtccctgtgttcatgtttccacccattcacctcttaccaagtgagtgtccaccctaagc

SEQ ID NO: 37928 - DNA, 1025 bp, Homo sapiens
tgtttactaccctaaccatagttactaagcagagttttatcataataatatagacagctctcaaagtattgacattcagaggggattacaaatattatttttctatcatattgacctaccatgtccacagtcttccttgaattaccttccagttttactgggctgcatctaccgtttatgtctagtttgactttttctgagttcaccaattgctgctaggaatgtgctggtcactcagcagcacacccacatcacaggggaagattttgaaatacctggacagtctgaacacactgctctgaatacactcaattctaagaagtaccagggaaccgcatcttcttgctgaaatcttgaatttttgtcagcttttttttttactgtggacagtaaagctggaaagatctaaataacccaacaggaaatgcggatgaaagtgcaagagttggtttgtggtcatctggagtccatgtctccaagactgctggaccttcaaattctgcaacttgttagatcatctggatgatagcacaactgttagaagacctagaagaatacagcgttgctatgactcagtggtgttgaatgcagaccatctaccagctggggaaagaatcaattataaacaggtattttaaaactccagaacgtcagaaatgtgtagcagaatgaattctgttataaggaagacaaaacaattcagtctgttttttaatgcagtttaggaatagtgtatacctcctatacttaaaattgtcatttatctttcccaactttaaatactcttttagtttctatagggaaggaagagttattacaggttttttttttttaattattctttaactttagatactgccaatctgatttaaaattctccaagcttaattctgtgcaacaaacagaaccacacaagcagccaggcactgtggctcactcctataatcccagcatttttgaggctagatgggaagatcacttgatctcaggattttgagaaccatccggacaacatagggagacct

SEQ ID NO: 37929 - DNA, 1031 bp, Homo sapiens
acttttgttgaagttaaatagcttttttatcacaaaatttaagttcataaatgttcatgctcctgagcaaatgaatcttaatcattcagtttagtatacagtgaagaggaagtattggcatgaataatcaaaaaacaaaaaacatgctttgtaataccttaaattatccacatgtatcatctggataatcatttaacccttttccatactgcccagctttattccaggaaccacctccagctattaaaaaaggtttcagaaattcagagttatttttattcaggcaaagaagtaccaagtattgtgactagttagataaggggtggggggaagacagtagatggtggatcattaggcatattataagaataaaactagttttatagtgcctcatttttacttacccattcacatattttgcttacatttcgtagcatcatttaataatttacaaagaaagttgtattacattgtttagattttgtacatacaggttagctaggtttttagtaaagtgaccttgtgaatgttttagaagggcaagggaaattatgacccctggttaggaaaaaaaaaaaaatgctgcaagtactaaacactaagattagccacagtgattttgaagaaaatgtgcctctattgaatggaattatggaattatccccctactttttttggtttttggttttattttttgttttttttggggggtttttttgttttgttttgagacggggtttcactctgttgcccaggcaggagtgtagagtgcagtggtgcgatcttggcccactgcaacttccacctcccaggttcaagcaattctgtctcagcctcccgaatagctgggattacaggtatgcgccaccatgcccggctaatttttgtatttttagtggagatggggttttaccatgttggccagactggtcttgaactcctgacctcaagtgatccacctgccttggcctcccaaaatgctggcgttataggcatgagccactgcacctggtcaaattatcccctattta

SEQ ID NO: 37930 - DNA, 1034 bp, Homo sapiens
taactactactagcctactgttcactggaagcttcaccaataacatgattggtcaataactatatatatatatatatatatatatataaagctctttaccctcatcatcctcactttgggctgaggaggaagaagaggggttgatcttgtttgggtagcagaggcagaaaaaaacctgtgtacaagtggacctgtgcatttcaagccccttttgttcaagggtcagctgtattgagtttctgttaaaacctttttttgtgtgttccattctaaattgaattaagttctccaaaggaacaatttaaaaatttttttaaattttttttatatagatgggctcttgctatattgcccagactggtcttgcattcctgagctcaagtacttctcctgcctcagcctcccaaagcgctgggattataggcatcagccaccgtgcaatgacccaagaaacaactatgacataccgaaaaattctttatctagataggttttggaggtttgagctgtagatctgccatgtgatattgactgggtcatctacagtcagtcagttccttaatgtgtgtaagcccatctgtttcctcatttagaacataaaaaaaggattgttctaatgggaaggagagtgctgaatagaaagatttagggctgcctacccttcttttgccagctaaatactcatttccatttgcctttgcatactgagcttttgggtagggttttgtttgaacaagggttccctacttaaaagtgtcactggcctcattgatcctaaggacttttagtcctggaattttaagacctattttcaaaggatagtagctagaaaaaaagcattccagcagtttgatattgtgtctactacttgccttcctttcttgtttttcctatttttctttcatcttttattatttttatttttagcggcaggttcttgctctgtcacccgggcggagtgcagtggctattcagaagtatgataatagcacactacagcctcaaactcctggactcaaatgatcctcctgcct

SEQ ID NO: 37931 - DNA, 1052 bp, Homo sapiens
ctgcctcagcctcccaagtagctggaattgcagagctgcactactacgcctggctaatttttgtatttttagtagagctgaggttttgccgtgttggccaggctggtctccacctcctgacctcaggtgatccacctgcctcagcctcccaaagtgctgggattataggcgtgagccaccgggcccagcctgttagcccctttttctattccagtttgtatttttcatgtcttgaattaaggactgggttgcatagtctttacatggaaacaactcaaataaaactgtccttaaaaagagttccagccaggcgtggtggctcacgcctgtaatccaagcactttgggaggccaaggcaggcaggttactttaagtcaggagttcaacaccagcctggccaacgtggtgaaacctcgtctctactaaaaatacaaaaattagctgagcatggtggcacgtgcctgtaatcccagctactcgggaggctgaagcaggagaatagcttgaacccgggagtcggaggttgcagtaagctgagatggcgccactgcactccagcctggtgacagagcgagacgccatctcaaaaaaacacaaaaaaacacaacaaaaaaaaaaacaaagttccaatgctgatttacagttttaatggagaattgagtgataaaatgtgctattggttgtaaatgagcaagtaaatcatttggaagaaagttgcaaatttatcttatgaggtgaagattaaatctgagatgatatagatttgaagtttttaaatcattcttgcctttaaaaaaaaaacctactatgtgggaaaataaggcccctcacccctgatttgctttccattactatagtttttcctagaatttcatataaatggaatcatacgatatgaggtcatttgtgtctggcacttttcacttaacataatgtttttgagattcatctatgttgggagattttataaatttcacaaatcaggttaaatttaatgtatttgaaatcagtttcaaaaagcattaagcattgtcatttttcagtgctaaacc

SEQ ID NO: 37932 - DNA, 1056 bp, Homo sapiens
gaggacgtacggatttcgtcactaccccctgaagaggcctttgaggctggttgcctcgttttataattaccgagagctttctctttccagcttttcacttcttcttgtagtcgcgacttggagttttgctaatgtctccctcctttcctaagtgacattgaatccgtagggatgttgatgccatcatcccctctttcccctgcaggaagtggcagtgaagctagaatctcagaaggccaggcatccccagttgctgtacgagagcaagctctataagattcttcaaggtggggttggcatcccccacatacggtaagaacccggtgcatataggcgatccgctgagggaagcacggaatggggaagtgggtagaggcaggtaatgagaccagctgaatccgggtcttggtgttttagttacctgggttccctatagctggtggtttcctgtaagtcagtcatctcaattactgagtaaatttcagtttgccaacttatttcattgtattacactgctccatttcgcttccgtcattctcactcttcccgaggctttcatttgcagttatgcgtgcaggtcatctttgatccctacgcggaagggttggctgctgccttttttacggcggcacttctgatgtacttaggtttgtccagtgaagtggatttgaaggtgccgaagcgacccggcagtgtcagttcgagttgctattggagctggcttgggaaatggctgctcttttgttgtgtttttgttccaacatgtcttcctcctccgcttagaaaatggcggaacgacgtgactcaaccccatattcctgcccttttctcagcttgagttcacaaattatgcttccttgattcctcctttagcagccccgagtggattaaacctttgaaaagccaagaataaagctgcaggaggcggtgtggaggttcgaggaaggagatggcatagtgacagtgtttgtgatctctgcagcagatgtgacacgaaattgttgaattacactatgtaaaatccttcgtagttcttttaaaagtgttaattactct

SEQ ID NO: 37933 - DNA, 1067 bp, Homo sapiens
ttgaagggatcaggtggagcacaggaaaacaggagatgagaggcttgagggctgtgttggtaagggtcccttgaattctaagctgaggagttcatgcaggaatcaagcagctccctcgccccatgaagggtgttaggaatggtaccagtacatgggtagctgttggtcttgggtttcttcttgccttttggggtgcagccttcaggcatctgctgctagatccctaggcttctatcttgtaggtgctgtgagctgagctgttggtagtttctggggaaaggatacttctcatggtactttgccatgtggccacagttgatacccccccaagtgcaaggagaaagaagttttagtgaggcagaaatgagagaatacagtagagtattggatggaagaagacagggacatgaagcaggactagggtttcatttaatagccaggggaaagggattctggaaatgttttgtctgttaaccttgagtttcttttccttccactcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaagtgagtacctgggtggagaggcatccagctggcaaaaggctgaggaaggcaatggctgggacgggctagcagttcaggggattctctctaaagaaatgctgttttgtccaggtaagaaaatgtgcttgtccatttagcccacaaatattgtgatttcccaggggttacaagagaggagacacattcttcgtccttacagcgtgatggtcattgaatccttggtttcttgggaattatcttctttccctagttccctttgcaggagcagcagtggactgcaagtgggctctgggtgcgggttcgacggccatttagcaagttgtgacttgtgtgaaatcactcagattctgagttttggtttcctcatatgtaaaattaggacagtaatgtctaccttgtggagtaatggtaagga

SEQ ID NO: 37934 - DNA, 1009 bp, Homo sapiens
acacagcagcccctagcaccttgtcaccactctggggctctgtggaagaaagggcacttaaaactcccagtaaatcttggaataaatatatttttccttcccttgtagtttccatggtagctgaatgtgctcagatgtgagcagtcagagactgacagccatgctttcctatacttgttcaaaggatcgatggaccgtaaataagctgccattaacacatctggttactgctgtaacatgactaataaaaccgaacgcctgttccccttacccgtgtgggggacacgcagatgagtgaattggaatgtccagcagagttaccctcccaattatatgttcattttgtatattttttggtcgggggaaaaattgacctgcagtaaaaaaacctttgaccatttttatgtccattggatactttcctttttatcatcttaaaaaaagataactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggcccaaaaaaagacaaaaataaaaattcctttttattcctgtcaactggatggaaacacaaatttcatggagctgtgtaccatcgaagaaacctggtgtctggcatgaaattactgtaaagaacttcctgtaaaacacgttctttaacaaactgaaatgaaaagcattggagcgtctgaatgaaagacgtgacctcctgctgggactctgatggtcttcagcattcaccttcgtgtgtcttcagtgtctcattgtcatccctgcttctgtttggtcttagagtgtttggatataactgaattgtagatggtaaaggaaatttgatgtgttttttgtttttaaataattaaaacgggtcaatttttcacatgttgtcatgggtttatttctagattcctctt

SEQ ID NO: 37935 - DNA, 1006 bp, Homo sapiens
tcatagacatgagaagcctacagatccagatgacccccttgctgatcagaatattaaagaccgttattacggaatcaatgatcctgtagctgacaagcttctaaagcgggcttcaacaatgcctcggctggacccaccagaggataaaactatcaccacactatatgttggtggtctaggtgataccattactgagacagatttaaggtttgtgggtataagttagagagttatttttgcctttaactgccctggaataatttatttgcaaaaactgcaagaatgatcattctgtacaaaatacatttttctgtagtctctctattgttagtatcatgctgactggaatttttgtaaaattgtcctttatggtgccacagtaataatgtgcttatgtggctgggcacagtgcctcatgcctgtaatctcaacactttgggaggatctcttgaaccgaggagtttgagaccagcctgagcaacatagtgagaccacatctctactaagaaatcaaaaaaattagccgggtgtggtggcatgtgcctgtagtcccagctgtttgggaggctgaggcaggaggattgcttgagcttgggagatcaaggctgcagtgagctgtgattgcaccactgcactccagcctaagcaacagagtgagaccctgtctcagaaccaaagctcaaagagtgcttatccatcctggcatatggtaataatgacataggattctatttgacctaacagccaagttttaaaggatggcacgcatccaagtatgatgaattatgtagaggagggagagctttgcgatgataaaactcttgtggtttaaattgttggtttttaaagagactggcatttgataaatttgtgttatttttggcttgtattatgcttggctagatgagacttctgggcagatagtaatggaaattacctcttccaaagagataaagtggagaagaaactcctgtaagtttataacctgcccttggtagcctgtctc

SEQ ID NO: 37936 - DNA, 1034 bp, Homo sapiens
actgtgcccatcctggtttgaactttttatgattaatatgtattgcttttataattaaaatgtattttaaaaattaaaaagtgtgatggagttggggaataaaatacagtataaaatgctatgttcttagaaataagtggtcctgtggccatgcagaaaaaaaataagagcagttgtgaggggaaataagtaatgaagttagagagcaaaaaatttccaagcctcttcattgcccatttcttcccatccttgaacttcagttttccatttcacttcggaaaacagatcacataacgaagaaaaattatcttagaagaaaaagggcaaacttgcccatcttaataatttgtcttctctattcattatgtgtctagtcagtgtagttgattaatttgatatgttttctgttagcttttttgtgtactgagtctgtgattttcttacagatgaacaaattgattgaatattaccagcagcttgctcagaaagagaaggttgagcgagatcgcaagaaactggcacgacgtagaaactatatgcctctggctttttcggtgagaatttggtactaaaatgatttgcaagacctctaaggcctaagaacagtgatcatttcagaaaatggccattgtcctagattcctgaatggtggatatcagagagagggattcttcaaattatagacgtttaagtccaatagttaggcttttgctatatcattagttctgtttgagttatttgtgttttgaggacatttgtgtttctttctccatcactcccctttatcttctgattatttccccagaaaggctgttaattttgtaggcactgcagagttccacgtacagcttttgtgtattacagaaagtctgagaagaaggaggtgggcaaatggtagatttcagtcatattacccctgtagcccacctttgacatcctggcagtagtggtttctcagctttagttataatttttttaacatcctcccctgtttctccaagatgaaaaacactgactttttacatagtgcactt

SEQ ID NO: 37937 - DNA, 1032 bp, Homo sapiens
aatgagattattatgtctcccaaattgctacttagaataaattaccagttcaaaagaagcaattagataaaatattcagacgtttaaaaatattacagctgaaacatttctttcacataattatttttcatgattgccttaagtgaggcaacttctaaaataatattatactaaagtgttatttctgccatttcttgcaagaggatacaatgtcaccttcagcaaggtaattgcgtcctttttgttttgaaaaaagtgattttatatgaaatatgtatattcatgtacttatcacccagtttaagaaatgaaacagccaaaacagtttaagccctccccctactttatcttcctctctgcccgctagagataataatcacaatcctgaattcagtgtttattagcatccatacatgtctttatacttctccacatatgtatgcagccacaaacaaataacatttttcacttttaagcaaatgaaaacatactgtatatatcctgctacaactttactctatcagcattatgtttctgatacacagttgattcctgtatgactcaccacagtttacttattccgtcttctcttaatgaacatttaggttgttttcattttctttgcttttgaaaaaatatagctgctggaagcaatcttgtatgtgtttcctaaggcacaagtgtaaggacttttctatataactagaagtaaaattgccagtcataagttgtgtacatccttagcactccaaaatgatttagcagtctttgctcctagtagtaatatgtaagagtaaactacctgtagctccagttccttgtcagctcttagtacttttggactctaaaatttttccagactgatggttgtgaaatggtatctcattatacttttatttttccctttatttggctagctttaccaatatataatttatatataataaagcttaccaattttaagtgtagaattctgtgatgtttgacaagtgtgtaatcacatagccaccaccataatcatgatacacaaca

SEQ ID NO: 37938 - DNA, 1050 bp, Homo sapiens
atacctttgcaaatggaggttatgcctttgttgagggctaactggacagctttattgtagaccatctgaaactgcaccttctctttttccttcagtgcagtcaatctcaattctctgtgatttctgtttaatagggtatccagtttccaaaccagatgtcatctccaagttggaacaaggagaagagccatggatcataaagggagacatatcaaattggatctatccagatgaatatcaggcagatgggagacaagggaagtgaaatatcaatttatgtttttttaattgattggtgcctgaggtttatgtttctatccttatcaaaatctcctattctttgcttctatgctgagaatttagtagtcactcaacaagtaattgtgaagcctttcagaggagttctatttgttgttgatcctgtctcttgtgtgtatatatatatgtttatatttgttgtctttcctgaaagggttttaaaggcaatagaaggcaaattcctttcaagaacacaagctgtgctttaaaaggcaatattcccagataaatgactgtattaaattaaatgtcaaatacagttactgttttagaagttcagagaaaattaagagtctaaagagatgtgagcgtatttgagaaacatttttcagagcatgcaactgtaactgctctgaatgacataaatgctgatgaggctgaaggaggagggtgaaggcaagcagtgttggagagagagtatatgaacaaaaccttagggtcaggaagatacagcttttctgggagaactttactagttttacttgacatgtatagaaagtagtttattgggagtagtggaatttacgtctgtattctcagtttgactctgatactgaatctgtagcaggatattggatttttctattatttgttagttgttaggaaaatagatggaggagagttaaagtattttgcatacagaagataccttgttttttagagtgatggtaggataataagaatgtgtagcacatgatttataatataaatgaaattaaaaggtgaaaaggg

SEQ ID NO: 37939 - DNA, 1085 bp, Homo sapiens
gagaaccctatttcattaggttctattttttgctggctgtgtggccctgagcaagtcacttacactgtctgggcatatgtccagggagataagcatgctgctgcccaaaatggttgtgggaatctgctggcagagcaaaacaggcctggagtctcttggaacgaaatctcatgtcaagggatagtgggggtcagaaggtggcccatgggtggagagccacggctgtgctcaccactgatcactgcaactcagtcctctatgagcccccttcccttctctgggcacgtggaatcccagagcaccgcatctgaaacagtggccagaggagataaggggagaggccatgagggtgcctgaatcctcccacagccgggcaagagaagagggttccaatggcttgagagttggatgatgggactcagccaggactctggctggctggggctgctggtcttgtgtctttctcctctcccgtcttattactcctatcaatatgatgctgtgagaagtggtctgggagtcaggagacctgagtgctgggctttgctgtgtctctgatgccatgtgaccccctttgctggggctccagctcctccattgtaagatggagtcaggttcagggctgtcttaagggccctttaactctgtcagcctgtggttccatgattctctctgccaggtttagtcacctagaaaccagcagttactaggatcccgtgcacgtcagcagttgtcactctttccggcttctgcagtccttttgtagagacaaggagcgtgggcagcctgaagttggactggggaggtgacgcagcaagaagaggaggacctggtctcttccctagcatctccctttcaattggtaggaggaaaacacctctctggggctgagtcacctttcgtccattccattctccacatgccccataaccctatctctttaccctggggttgggggtaaggtgagtggttgggtcctaacccagagctaagacatctgaactctaagaacttgggagcagagatgggcatgcccaggctttcattagccagcaagtcctgactggttgtatgtgatatgatca

SEQ ID NO: 37940 - DNA, 1044 bp, Homo sapiens
tcctgacctttaaaatggggatatggggcttttatgagaatggctgggataatagatacataaagacttttcaaattgtaaatcattgtctttatcattgaggcctgttcagggcagcaaggagcagcagccaacttgggattttcccagtaagcccagggagcatggtctctctgctcaggctctgccccgtcactccagggcaggccattttctcagactacctggccctgatgagaccacctcccattctcccacactcgagtggggaatcctgtctgagaacccttttgtcaagggctgtccttgagagggtggtacctgggcttctccccttcccagtcagttcatctgtgctttcttgattctccaggaaaggactcaaatgtcacagcatctcccacagcccctgcatgccccagtgacaagccagcaccagtccagaagcctccatccagtgtaagttttatttggagtcatgggtggaggttgcctggatggacctcaagtcctactgacagatacaagaacatgaagaaagagggttgaggtcaagaaactgtgttccgtctcgctgggtgatattgggcaagtccatcgcaaactctctggggcctcagcctccccattttgaaatgaaggtcatagttaaaacttaccaggaagaccctggtatgtacaaggaattcttctcacttactaagttgtatactgttaagtatcactgagtgtgcacagtgctaggaaaacagacagatgtgacatggagctcacattctcaaagagggctcagaaactatcttctacaggctgggcgcagtggctcatgcctataatcccagcacttggggaggctgaggcaggaggattgcttgaacccaggagtttgagaccagcctgggcaggatagtgagactccatctctctaagaaaaaaagtagtcaggtgtgatggtgtatgtctgtggttccagctacttgggaggctggctgaggcagaagggtcgcttgagcccaggaggtcaaggctgcagtgagccatgtt

SEQ ID NO: 37941 - DNA, 1033 bp, Homo sapiens
acagagtagtttcactgcctgaaaaatccaacccggcctttgatggatggacctgaggctgcagtttccccagcctggaaattggttggggaggactggaggtcatcataacacaaatatgtggacagttttttgtttatgtctgcaatgtgatatcatggcatctcacttcctttcatccttgggtggaattgcaggatattgccctttacagcagaggaaatgaggctcagattcccagttgttggtgagtgtggcatcgtggttcaagggcttcttatagctacatgttcactagctatggtgtgtccaggcaccctgcttaaccacagttaaatggtgatatgcaggtcactagagaataagtggaggccagaacctagcttactgagctgacggaagagcctaaaatcccattaaaggagagaacaaatggggaaagccttggcccttagataagctgggcacagttgtggggttgcctcagccttttattaagcacctgctgtgtgtcaaatgctgagctagttactgtatactcttattattttggaaatcttattataaaacaaagatgtgtttcttgttaaatcagataatcaggaagtattgcctaaagtagaaagtgagaattcccttccaactatacacatattgtttcatttaatttctttgatcttctatcaggtaggttctattattactcctgctttacagatgaggcacctgaggctcaggaaaggtgagtggctgctccagggtttcacagcccacagggtggacagagctgaggctagtgcaggtgaggccccctctcaggcctcgtgttcgcaaggttggccttgagcactttccctgtgtggacctttcttcctgcctccaaggcagcgatgtttccatggtgctggctctctctctttcctcagcttgctgctagctcctgagacttgggtcttcttgatcctgaggccagctttagccatcacccggtttctgtgtggcccatgctcctccccttgcatgtgagggaatg

SEQ ID NO: 37942 - DNA, 1040 bp, Homo sapiens
ccttccctgatctttttatgcaaagcagccccttttttcactttctgtcacgttactattttatttttctcatacgtgtatcatgctatgaaagaatcttatttgcgaatgagaaagcatatgtatagaacttagtgtctggcaaattgttatttttagtgtttatttgtttactgtctttctcttttcctagaatagaagggggtgagcagggacctccttagtcctctcgagtgtatttctgtagcgggagaagagtgcctggtggatggctcttctgagtttgttcagtgaatgagtagaataatggcacatttcacaaatgaggaaattaaggcctagagatgagaaggcaggaggagaaccagagtgctctcctagcgctctcccaagcatcatttcctgatgactcctgtgcccagtgccatgcagtgttcttgatgcacaggtgcgtaaggagctggctttgccttccaggaacttttggtcaaatggggagatgtgctatgagtgtgacctgaaaggcattgtgtgccagtaagtgccaaatgagtcggattggcataggtataactggagtgcagagtaatttgggggcaccagatggttggaggggtcttctggagggaagtgacttcaaggtcagaccctaaaaaaatgacaaagtgcagagtggaacctgggtctcttctggaacttagtagactagtcacaataactggaatcagcctctcctcggttgggagaattgaccagttggcctgggaaagaccctaaaagattttgataccagacatagaaatgttgatttttctccttagcagcattgggaaatggtcagagcagttggttcacaaacatgagcatgcatcacaatcctggggatggaggtagagggtggttgttaaacacagattgctgggctgcaactccagagcatccgatccagtggatggtggtggtgccagtgccgctggtccgggctgctccttgagcacccctggtgaagagcacatgattcagtgcttggcagacctggg

SEQ ID NO: 37943 - DNA, 1081 bp, Homo sapiens
tgttgttgtgtaagcccatcagaggaggacaaccaaccaggctgtgtggagggcagacttcgagcccaacagccctgacttgaactctgatcctacttggcatcctattctgggagacaagactagctccttggagaaccaggcagtaaatgagatcaagccttggaaaacgagtgaagtccccggggaaggctttctggatacggtgaggcgcacagcgagtgaaatttaaagaggtagcagagaaaaattgattctccttcaaaagtatggatcccattctgttcacttttccaggagcattctagaaactggtggtgaaggggttaactgtgccagctaccacatcccttgcccccacagggctttgaaaaaccagagtgctgggatttgcccaaggtgagtcagggtcactaccttcctgctgcctttggccgttcccaggataaaactcccctggttgagtgagatggaaacctaaaatgaaaccttgctagagtcccggactcaagcctcattactgtcacctttgtcagcagccgcagcgccaaatctatcgtcaccatcatcacttctccctgaggcctggtatcccgttggggtaggaatgtgctgattttgcttgggcaacgcaccctctcactgggcctcagactcaattttcctacattggaggatactttagaggcaaaatgagattaatttcatgaggagcctagcacagtgcctggtaccctgggaatgttcaggtcctattacctgcccttctgtctttcccagtgtcctctcctcttttctctctcccatcccagggtccaggttaattgcagtgcaatatttgcatagacgtgagacctcacccggggaaattccccctggtgaccaaccaggtttcctttctgaggtcaggccacatcatcagacactgctccttcctctccggcttgccactgccaccgctggctttcgcccctgtcatctggtgggtttagatcctggcacacagatttaggctcatcctttgaccttgggcactgtccagagggtggggatgtggaggctgggctagggacccagagca

SEQ ID NO: 37944 - DNA, 1050 bp, Homo sapiens
ctcaagggaagaacagtctattgtatttacttaggtctttaccagttctgttactcttcctacattcttgaagtttcaagtttcaagtttccctctggtttcatttgaagaatttcctttagcaattcttttagagcaggtttgctggtgatgaattctaagtgtccttcatctgagaatgtctcgatttaatcttctttcctgaaggatattttcactgcatatgggattctgggctttttgttatggttttgtactccaaaagaaagcaggaaagagaaaacagaggataaagatcagcgagaacaaacagaaaacacatcctaaaatggtagacctcaacccaacattatgaacatcaacattttccagcagtttttaaatttttttcttctggtctctaaggtttctaatgagaaacacacagttattcaagctgttgttccctatatgtagtgtaccatttttatctggttccattctacaccttttctgtgtcattagcttttggaaatgatgttgtctgggtgtggatttctttgggcttactttggagttcagtgatcttctttaatctgtaggtttatgttttggcaagtttgtggaatattcaatcattctttcttcaattttttttttttgcactgcaccctttttcctctaattctttgactgtgatgatagtaatgttagctatttgggcattatcttacaggtctctgaagctccgttcatttttttttctaatctttttttctcctctattgtccagatcagataatttctattgatctatcttgaagttcactggctctttcttatcatctcatctccattctgctattgatttcacctagtgagtttttatttcacttattatactttttagttctaaaatttccttttggttcttcttaataactctatttatttgctaagactttctatttttctattattcctaaaagtatattcactcttactttccttttctctttttccttcttgccgtcagtgacagaacacccatacttcttggagtctttttac

SEQ ID NO: 37945 - DNA, 1035 bp, Homo sapiens
tctgagagtcaggaatttgggaacagcttggcctagtggctccagctcagaggctctcataaagctgcagtgagatgttggctggagctgcattcatctgaaggcttgactggagctggagaatccacttccaacatgtctcactcacatgcttgttagctcgagggttcaatctctcactttgtggacctctccttgtggttgctggaatttctttgtaatttagtagctgacttcctctagtgcaagtgaccccagaaatggagcaagacagaagtcacagtgtcctttatgacattgtgatagcttcagaagccacataacctcacttcaagccatattctataagacacacagaccaacccgagacatgtggaatgggattactcaagggcataaataccagaggcagagatcattgaggccatcttggatgctggctaaccgtacttaaaatcctgtgttcatcccattcacaaatctagagagggactcttaccctcaattttcagatgtggaaactaaggcacagagaagtaacatattgatgatcatgcaactagtagtgccagagctggtatctgaagccatatttatctgatttcagatggtctcatttccagagattttaaaataaagtattggtataagtaatccttgtgtgaaagcaaagcaaaagatccagaagttcaaaccagccatgtcaattatccattgactcaaaaataagttttaagcacctactctgtccaggcactgttccaagtattaggaatccagtagtgaactgaacaaaacctctgtcttctgggagcttaccttcagacccttgatctgttagatatcctagagactgtagaatgtagagcttacatgaagactaggagccggggatcccttcctgcctggcctccaacccactggggaacccaggcaatcctttctttccctggacccagatgctgcctctgagaatgcggcccttggatgaaagcagaatcacctggggtaatgagtagacataacagattcccc

SEQ ID NO: 37946 - DNA, 1055 bp, Homo sapiens
aggcaggagaatcgcttgaacccagggggtgaagtttgcagtgagctgagattgtgccgctgcactccagcctgggtgacagagtgaatgagactgtcttaaaaaaaaaaaaaactaatctaatcttcaaacagctcatttcaacagatagggaaaccaaagcaaaaagaagttaaataattgttcaatcatgacattgtgaaaaatgatactttgccctttcctcagttgccaccaaggtgcttggtccttccgaggaagctaaggccacattggggtgaggccatcacttcatccagtgactagcaccacctctggcaatgtcagccccacactcgcccgcgccatggcctccatctccgagcttgcctgtgtctacttggccctcattctgcacgatgacgaggtgatcatcatggaggttaatatcaataccctcattaaagcagccagtgtaaatgttgaaccttttggcctggcttgtttggaaaggccctggccaacgtcaacattggaagcctcatctgcaatgtaggggctggtggacctgctctagcagctggtgctgcaccagcaggaggtcctgccccctccattgctgctgcttcagctgaggagaagaaaatggaagcaaagaaagaagaatctgaggagtctgatgatgacatgggctttggtctttttactaaacctgttttataatgtgttcaataaaaagctgactttactgctgttggtcttgcccatagtttgggaatgtgctctgcaaaaatggtctcagttttgtaatgttggcttttaacctattctgccatgacacaggctggttttgcctgccaccgttgcctgatgtgagatcttggacaatcctgatgccaacaagaaggcacctcatggtacagtgttgaaagctgaagtggggtggcaggaggaaggatcagagcagatgctttgtccaagttacgtataaacttgataattatcaagtattataaacttaatagagccaccatgtccaatttttaattgtggtaaaacatacagaacataaaatt

SEQ ID NO: 37947 - DNA, 1068 bp, Homo sapiens
gtggtttgtggttctccttgaagaggtccttctcatcccttgtaagttggattcttacgtattttattctctttgaagcaattgtgaatgggagttcactcatgatttggctctctgtttgtctgttattggtatataagaatgcttgtgatttttcaacatcgattttgtgtcctgagactttgctgaggttgcttatcagcttaaggagattttgggctgagacaatggggttttctaaatatacaatcatgtcatctgcaaacagggacaatttgacttcctcttttcctagtcgaataccctttatttctttctcttgcctgagtgccctggccagaacttccaacactatgttgaataggagcggtgagagagggcatccctgtcttgtgccagttttcaaagggaatgcttccagtttttgcccattcagtatgatactggctgtgggtttgtcatagatagctcttattattttgagatacgttccatcaatacctagtttattgagagtttttagtatgaagggctgttgaattttgtcaaaggccttttctgcatctgttgagataatcatgtggtttttgtcgttggttctgtttacgtgatggattacgtttattgatttgcatatgttgaaccagctttgcatcccagggataaagccaacttgatcttggtggataagctttttggtgtgctgctggattcggtttgccagtattttattgaggatttttgcattgatgttcatcagggatattggtctaaaattctctttttttgtcgtgtctctgccaggctttggtatcaggatgatgctgacctcataaaatgagttagggaggattccttctttttttattgattggagtagttttagaaggaatggtaacagctcctctttgtccctttgctagaattcggctgtgaatccatctgatcctggactttttttggttggtaagctattaattattgctttaatttcagaggctgttattgctctgttcagagattcaacttctttctggtttagtcttgggagggcgtgtgtgtccagga

SEQ ID NO: 37948 - DNA, 1026 bp, Homo sapiens
gaatccattcttgctctccactcttggctcaggctggtccattgtcctggccacctttcatttcctcaaagaacccaactctttctacctctgagcctgccctggggctcatagtgttaggggttcctctcaggagccctgggtatgcaccatgcccatgaagatggctgagcttccaacagtcctgcttctcagatggggagagtaaggcatagagaaatgtggttcactgaaggccaaactgtggtgagaggtacgactccccagttatggcagtgtctgaatctccggaacctgtgaatatgttaccttatgtggcaaaagagacttcgcagatgtgattaaggttaaggatcttgtggtggggaggttatcttggcgagcctgatggaatcacatatcattaatgtaatcacagggcttataagtgaaagaaggaggcaggaaagtcagagtcagaaggagatgtgatgaaggaagcagaggtatgaaggaaagcaaggagaaggaaacagagatctgaagattctatccttctggctttaaagttggaggcaggggccatgagccaaggaatgtaagcatcctctagaagccaggaaaggtagggaaatggattcttcccaaggcatccagagggaatgcagccctgccgacactatgattttagcccagtaagactcatttcaggcttctgacctccagagttttaagcataaatttgtgttgttttaaccttctaagtttatagtaatttatcacagcagctataggaaactaatacagcgggagagcttgggcttcggctttgtatccagagatcttttccacacgtgtcgcaggagaactggaacagctcacaggacagctgcagggacagtgagcctactgttggggagaagccccttccagagcttggagcaccagagaggggctgggctctatttctgtcttagccactcacagagctcctccttctggagccttagtccctcatctgcaaggggctgagttcttcactggtag

SEQ ID NO: 37949 - DNA, 1056 bp, Homo sapiens
tgcaatagttccttcattaaattctcttctgttactccaggagtgggctatatcatgacaagatcttagccgactcagcatgctccatgaccttcttgctaaggtcaagttcttatactctcacgtgtacttctcctttgcagagcttaccacagtccctaactatacatttattttaatgatcatttgtttaatgtctatttttctaactagatcataagtgccttgcacagtcttttaatttctagcacagtgcctggtatatagtaggcatttgatgcatttttactgaatgatagctaatatttttctcttatctgtttcatggaattcttctgagagtctggggggtacaacaggtataaaaggctttaaaaattgaatctctccccatgtctacaaagctgtaaggtgttattgtgtgaggataacatgagcatgggcatactgaaaacctggatggactgtgtcagtcaccaccatgtcatcttgggtcagaatttcccctttgtgttattcagcctttgtcaagccatggtccatagcaccctctggtggtccctgagtgacagcatgagggggcagcttccagcttctgttcattgtcacccgtagcccccaaccaagactcaatcataggaccacaggtggagctggaagcatcatccaaaaacttgtcattttactgtggaaaacaggcctagttggaagcagcatttgcacaagatctcactgagtttttttgtagagctgggccagacagtgctcttcctaccatatctaatacctgatagcatgaaaatgttttggtaagcaagtactcatgcctgttgggtaagcatcagaaatgagttacagctgggtgtggtggctcatgcctgtaatttcagcactttgggaggctgaggcaggaggactgtttgaggccaggaggtcaagaacaatctgggtaacatagcaagactccatctctacaaaaaataaaaaaaattagatgggcatggtggtgtgtgtctgtggtaccagctactagggaggctgaagtgggaggatcac

SEQ ID NO: 37950 - DNA, 1020 bp, Homo sapiens
gttaattttctgctttcctccctgagcaaggctgttgctgccagtggcccccatgctcttgggtgagtacccctaaagccactcctttgcttaatactgacaaaaagatggaatggctgttctagggagggtaaagctagaacagggtcagtcactagtaaatgttttaacttttctacttgtttgatttctgctagagttcagagaagggggtctggctcttcttgggtgagtctttcatacaaaggttttgtttctaaggcataagagtcaattcattggcaacagtatccaaccaatctcaaaaattttctgagctcttgttttgtttctgacacaggtagggatatgataccttcaatccattcaaagccaattctctgccttttgcttttgcctttcctcatccctccgtacatatacattttcattctctttaaaagctcttctatgggatggtctttccaattttctatctttcgtaatttctttgtaatatctggtgacaaaacggagctctaacattcctcatccaagggggttttctaattctaggccagcatatttcctcctttgctctttaagcctctctaagaattccgtaggtcctttatcctttccctgttgtatattaaaagctttggtatattttgagttcgaggaactgattcccgaatccctttaattatcctatctctaagatctctcatattccctcaatgggctacattgttatctcattgaggatcttgggctgggaacttttgtttagctgcaaggacgttatgactgagggggtgttcacgttcccaaaccgtcatagtgcagatcatgcttctttcctctcccgaaaagaggatgcctaggatggacattaactcagtccaagtatacaactggggtcctagaaattgatcaatttgatctgctactccatagggattgtctaagagtggtttgagccctttttaggcttcggacttctgaactggttaacagggcgttcacaaaacaaatgcc

SEQ ID NO: 37951 - DNA, 1050 bp, Homo sapiens
caaatagctcaggaataaattactgtttcaatggttcttaaactttcttggatcataggatccttttgagaatcagattaaagccaaagatactctttggagaaaaatgcatattcctaattttgcatagatgacctttggattattggactctgactattgggaccctaaatactatttaattataaatcttttttttctcctccttggttatttaaacagttgaacagtgtcaggaacagatgtttctgtaatgtcacagttgctagcatgggaaaatcagagtctggcatgggtgtaggaaggaacactcctttcagataattgaactgttttctctaggattcattgtgaaggcttttctgctcacgtttgtagtttatttttcaattaattcctaggattggagctgttgggacagtgagaatgaaattcatttacaggaagtcccaggaaggagaaagtttgaggcagttttcaaagacgtgtatgtgcctagcattagagtttaataaactcacaaagggaaatactgtagaatttagatcctcacagttcttcatacagtgaagtgaactttaggaagacgatgctttgttaccagggatggagaatctttcttgattgcaaagacataaataggcatggctaggtagaaaacctagcctagttggtaggacaccagttctaccaactgctaaaatgaactttacttacagaggtggaaaaaatatatactcccttccacttgagtaaagagtgatattgttaaactagaattctaaattcctttgtgatctgtcagaagcatcacctgtgggtggaggagtcctgcacactcctcagttactgctttggtaagaacaagattatctatttgagtccaggcatggtagctcatgcttgtaatcccaacactttgggaaaccaaggcaagtgaatcacttgaggacaggagtttgagaccagctgggcagtatatatggaggcagtatatatttgagaccaacatttggcagtatatatggaggggctgaattgcactcagtt

SEQ ID NO: 37952 - DNA, 1026 bp, Homo sapiens
gtccaggaggtcaaggctgcagtgagccacagtcatgccactgcactccagcttgagtgacagagtgagaccatgtctcaaaaacataaagaaaggcagcttcaactcatgcactgagccctgaggttactgggaacggcaggtgcaaatatctcatgaggagatagaaagttggcataatttggatgagaaaggctactatggctgcaatatggtgagggaggaggttggagcttcagaagcaggtggaggacagatgtgcatgatttagagaaccaagggaaggaattgggtttttatctgaaatctgatgagaaattatgtttgcaattgatttctcatcagattttactaaaatacagagaatcagtaggaagggtactagctgtactctgatagatttctaagtactgcaaatggtgctaagtgctttgtagctgttctcttatttaatccttagaacaatcctgtgaagaaccttctaaatctgatggtatttatggctgtaagttgctggcaatgttttaatctctttgtataaataaagtcattttagccttacaactactgaatgaaatcagtattctttttacactcatatttcagatgtggaagtggaggctcagagaagttatgtaatttacccaaggttaactgactagtgggtggcaaagccaggatggaaactaggcattctagttttccaagcctgaacactcaaccttcatacttcattgcctctccattccctcatgttgttactaagtcacgtaggtaagtaagtagcgaaaccaagagtggagccaatattttgaccctaaaatccatgcttgcaaatactacttgatactgggctgaacagatttatagatggaaactatgagttccctttgaacatattaaggtgcttatgtcttagcttagacttctatgagtatcttaaggagattctgtgcttataattctaatcttcctaaaaactcttagtaggtattatccccattttatgagtaatgaaaattgagg

SEQ ID NO: 37953 - DNA, 1028 bp, Homo sapiens
agaaaaggaagaaaatattccatctgtagttatgaaatgtaacaggtttgtcttgtggctctaataaatctttggtctgtgtccataggttcttgatagtccacaatgggtgaaccacagcaagtgagtgcacttccaccacctccaatgcaatatatcaaggaatatacggatgaaaatattcaagaaggcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaag

SEQ ID NO: 37954 - DNA, 1028 bp, Homo sapiens
gtggtgtggggacacggttcagtctctcttctcccatcctttctactgaggagggggagcccgcttagtagagtgagagtaagagagactgtaggtcattgaatgttcccattctttttaggggacacggtgactatttctctttgggcacttaaaaataatcatgaacctgggacacattatggtggtttagatttcctctgatggacacaagttaaaatggagaaccagacactcagaaaattttatagtattttagtggatctctcaaggattctagcactatgatttctaaagttttttttttaaaaaaaatagcaaataactttaaaaaaaaagcaccaaaatctttcaaggaagaaaccccaatatgtaaaactgataaaaagtagtgttttgttagtacaaatacgttctctatatttacattaaccacttgagagaatattggggtagttttgatgaaaccaaatgttaagttatggattatgggtgagatgtctagtcttaaatctgtctgagtcttttcgtttctttgttttttttttttttttgagacggagtcttgctctgtcacccaggctggagtgcagtggtgtgatctcgacttactgcaacctccgcctcccgggttcaagtgattctcctgcctcagcctcctgagtagctgagactacaggcatgtgccaccacacctagctaatttttgtgtttttagtagagacgaggtttcaccatgttggtcaggatggtcttgatctctttaccttgtgatctgctgaccgcggcctcccaaagtgctgggattacaggcatgagccactgtgcccggcccataatgtgtgtttttaattataatttgtaagttaaaataagtaatacaaattaaatgcaaatcaaatgcctgaagaagaagcacgaatacctattttgaaatctgctgtagccgagacagcttctaaatctcccacttgggttctgtttctggaaggtgtgggtcctgtggtagctggagtgttggtggccat

SEQ ID NO: 37955 - DNA, 1049 bp, Homo sapiens
attgagaatatgtgtttatgatgctaattactcattttaatgtgtagattctcgtctttggggtattaggatgaaggaaaagaagaaagaagcagaaaggtgactgctctatgtaacagaaataagacctaatgtatgagttaagcataaagtcagtctactttatttgcagtcttaattgtaactgtcataattctttgcattggtacatttttaattattcttcctcttcctgttccttttttctgtccttttcagttatcctcaataaccactaggaacctctgcttctttctcctgaatttcttctttctcctacattgttccatatattaatcagttcagttagtgttgctcactttagatagtaaaagtatacacagaacagcaaaatgtcaggatatgtgaaatataaattgctttttgacagttttgccttatatccttgtataatgtgagacatcatatcctgaattctctgttttgttttgttgttttgaaacagagtctcgctctgtcgcccaggctggagtgcagtggcacgatctctgctcactgcagcctccacctccttggttcaaagtgattctcctgccttagcctcccaagtagctgggactacaggcatgtgccaccatgcctggctgattttgtatttttagtagagatggggtttcatcctgttggccagtctggtcttgaacttctgacctcaggtgatctgcccacctcagcctcccaaagtgctgggattacaggcataagtcactgcgcctggcctctgaattctgttttgaaagaataaatgtccacttgtgtatctccttaaagctgtactaacctaaaatcggtagttcccctgggcatttgccagggatggtggcttctagactttgagtgatgggagaataattgttagtgtaggtaagttgttggttttatccacctcaaacctgattgggacttcagaggaacctctttgggaagctaatgattcagggtattgaagacattagcatagaacattagtggttctttttgtttcagaa

SEQ ID NO: 37956 - DNA, 1015 bp, Homo sapiens
tactgttggccatatattaagaaggggagatggttctagtttaattaacccagttgagtgtagcagatggggcagaatgtctttcagcgataagacaattcagaaatggcaccagatgttggaagctgtccctggtggtgtttgagtgcagcccagatgttccagtcccacctggctagtttctaagcactgcggcctaagcagctgtgatgtaacctatataatgttcacataacactaaaagcaccatcattgaactgctgtagacttctaaggttgtgactgttaagaggtgaaatctttaaggacagacaaaaataaggacgactatttaaagtttcagatattggtctgtttcactaaagttgagaaaaaaaggaatattacaacttgaaataatgttataattgaaattataggtaaaagtaaatattcttacccatgtagtatttacaaataaaattttatgtcagaatgtaatgttacgcacacagagattgatttgcagacttataatttgggtcttacccttttaaaaacacctatctagaagtagcaaaaaagctatttttttcccatgcattaaaaatacaaaatacaagtatttactcttttatggagtaaacactacgggggaaaacccgtccaccaaaactattgtattgatatttctccctctctctgcttaaaataattgttttgttttgttttgttgtttgttgctttttgagacagcgtctcactgtgttgcccaatctggagcgcagcaatcttggctcactgcaacctctgcctcctgggctcgagcagtcctcccacctcagcctcccgagtagctggggctacagctgctcgccaccatgctcagtttaatattttaaggttttgtagagacgaagtctcactatattgcccaggctgatctctcaactcctgggctcaagcgatcctgctacctcatcctcccaaagtgctgggatttacaggcatgagccaccacaccagactctaaaat

SEQ ID NO: 37957 - DNA, 1050 bp, Homo sapiens
cttatttttgaagttgatcctgtgtatttttattcaagctagtagtctttccttggatttttttccccagtaaaaacttgtatagattattttgcatttggaccttagatgatccagggacctaagatactgagggataatgaagtttatatattaagtttaattaaacataagtcaaaggatttgaaatttaatgcttccttgacatttcattatgattctgtgccagtgtgtaccagaaaaacaatccaaatggattttgaaccagtttttgagaatagagctgtatttttataaactacattttctgatggtatttagttttacatggaacaatactttgagctttgcagcagtcacttttgttcttacttaccaatattattataaaccaatttttctgagaatgtaaagggtaatgcatatagcacttaatttacagagcaaattttactttttaaatttgacctttatcatttgtgcctcacaatatctctactagagtagaataagaattttgtctttgttgtttataagtaaaacctaaaacccagtcacactgtgtggacttgcctaaataacacagttagtgatggaaccaagccttcaagtgagttctcgtaactaaatgccatctctttttctttaccctgcgccaaaaatcctaatagttcagaattagggatcattaaaaagaggtccaaacaaaaatacaatctaattagtgtatttttaggatgttttcatatcttttaaatccctggaatgcctgttcaggaaataccaacagaataatggccataatttcaataatgttttccaaaccaagccaaaacttacacaggccacaaaaacattaatgagggaaacagctctgtatatttgaagtgggcaccatttccctcccaatgtttagtatttataattatcatatgcatcctttttcagtataaaaaagctagatatatacttgtaaaatagatttattcaaagtgctaaaaataagttctagctcttcaaagatcacattccagtttttcaaacagtctt

SEQ ID NO: 37958 - DNA, 1033 bp, Homo sapiens
gtagagacagagtttcaccatattggccaggctggtctcgaactcctgatctcaagtgatctgcctgcctcggcctctcaaagtgctgggattacaggtgtgagccaccgtgcccggccctttttagtttttatctatgcaggtggtgcactgatagaatacagactgctgagtcaggggagttaggggtgatccccagcaaaattaaatcagcccagggatacttctttagcaatttgagagaagttttactacaagtgctattttagttttcttttaaaaagtcagttttaaagttgtataaattaaaaatatttttaaatttttaaacagatgctcccccttcaacccactctagttattaccactctaacacagctgttttcatatggtttttttggttcttccgggctttgctcacatgtacatgtgtttttatatagttgttagcgttcatatacttttgtgttatgaggcttcttcttctatggccatggaaggaaaggaattttctagtggtgactgcctctgcctgctctgttgcttacattgttccaagtaccattgctgccacattttggaagctatttttcatcctacttcccttaacgtcacaatttttcacttttgctagccacaaaacagcccctccagcagtcttactgctgctagagtgcctctctggaaaataaaaacgccttagcattgtgggactagcctgtcttgagacagtttttctgtaagcctgtcatctgcccaggtcataatagcagcagcacctgtgctagagagggagtagaagggcttccatatacaacataataaataataacagaaaactgaatgctttacacatgtcatttcatttaatctccataatgataataatacataggtacctttcagatgaggaagcagagtcacacagtggttgatgtgtccagggatcaggtagtatatgccagagacaaaattcaggccctaataatctctaaaaaattattgatcaactaatatacaatattactttgca

SEQ ID NO: 37959 - DNA, 1095 bp, Homo sapiens
gtcccccaagtaagagggactacaggtgcttaccaccatgcccggctaattttttgtagagatagggtttcatcatgctccccaggctgggctcaaactcttgagctcaggcaatccgcccgcctcaagcctcccaaagtgctaggattataggcgtgagccactgtgcccagccagtaatatccttagtttgatgtatttggcttataagttcggtactgaatggggctttgaaggatggcctgtttctcactaagcatgtaaaatgtttagccctgtcatctgctgtccactcagcagcgagagggattctttaaaaatactaagtcaaatgggttcagaattctccagtggcttctcatctcattgcttaattgcctgtacagatctggctctttgttgccccgcctgtgatctcttctcccaccactgtccctcactttctctgttctgttcagtggacctcctgtattacatagtatgcactcacactcgtcactatttttttctgtgcttgccttcctctgttacatgtattcatctcctgcctctgatatgcaagttccttgagggcaggaactttgttttgtttactgctgtattactaactcttagaacaattatgacacatagtaggcgctcaaatatttttgaatgaatacattaaatttggtaagttgatatttattacagaggatatcctttaaatccagatatttctaataataaaagctaatagttattgagcatttgccatgtgccaagaacaaaggtgacaacattgttatgttcaattttcttatgaggaaattgggcacagaatgccaagagtgtgccacagatagcacatctagaagatagtctagatttaaatctagatgatatactttcagaatatgtatttagcagtttatgctaatcttttacaagacatcatgtaaacaaaaaaattgttatacaggcatacctcagagatattacaggtttagttccaaaccactgcaataaagtgaatattggaataaagcaagtcatacaaatttttagtttcccagttcatataaaagttatgtttccactatgtggtagtctatt

SEQ ID NO: 37960 - DNA, 1019 bp, Homo sapiens
tgaaaaatattatctatctttttactacccaatttaggatgtagacttgaaccaaattattcaagaacatagaagaatgttgtcaccaaagactttttaaggcttttgtgggtgtctgacacatattaagattagaacatgaggttgatttactgatgagtactcgggattttaattttcatcttttcactggcaagaagagaagaaattcttccccccaaatgtaagcatcttacagaaccgtggatctgttagactgtgcaccttataatgccataatagacgtgcatccatagaatggttggtctgattatcagaggtataaaatgatgaaggaacttgcaaatgaagaagcagtgacgtgattaagggctattcagatagatggatcaatagaatgagggcttctatgagagaaaggttaggggtttaactatctggttcatattctggcattacgtttttaattagctgtatgtatgatttgaggcagaatcacatgaatctccagactttgccttccttatctgtaaaatgaggggacctggctagagtaagactttttccacctttgatggctattggagaaatgcatttccatcaaggaaaaatagttggaactagtttttacaatagcagacaaattttggagccattatcctctgtagacaatttaggctgaaaagggaaattttcttaaaaagtggtaatcaataaatgttatacttaaatattttatgcaataaataagaccatgactcaggaagactaggacttttagtgtatattgatacccagtgaggttttacttcagaaaaagaaatgtactctgaaaaatgtgtttcctggagccactcttagattcagtatggtagcggctcttaagtgtaatgatgtatttcttttttttttttgagatggggtttcgctcttgttcccggggctgaagtgcagtggcgagatctcagctcactgcagcttacacttctggggttcaagcgagtctcctgcctcagcct

SEQ ID NO: 37961 - DNA, 1062 bp, Homo sapiens
ctcagagcccagttctcttgacatccagcttcacccccattcagcttttggttataccagattttctcatgaaatttccatgggcttttaacatacttccagaaatttaccaaaccttcctaaattttatacataattgccctaacactctgaagacttatctataccaccttttatgtgagatacagctccactaaaataaaaaagaaaattaagacggagaaagacattatgtcaaatattacctctttcaaaatgtcatgatagaaatgtaatacaatgtaaatagttgtgtccatttattttacatatattgaggcttacatgtataaatttaattcaaagttgattaaatgtgtggatttaaaataactcctagttgcctatttttttctaaatatgtttcatgtcctatatttaacctgtgcttattgaccatctattatatagaagttgctttgtgcaaaattataaactttatttgttaacaaatttaaaagcagtctggattagttgcattaaactttgaatatgactttgaagaacaactttcaagcccaagtaattttatgagaaatcatttctaaatgagccagcatattaaaaaaaaaacagataaaaatggtctaatggcctttttaatatagttacatagttacagccatgctcactttattcctaagaagccttagtctatattgttatttttgatgactgaggcacttgaaatctattttctatgttgataattatgaaatagttaaaaaaagactttaagatgacattttcagctcattatttacagcgtgttcaggaggtacacgtgtctgtaacttgaaaataggaaccacagaagtgtgatgaatttctaattttcatatgaatcaatgacagaattcacacctggctgcagtcatgtgacttttatgaagaaaatgaatatttatggatatctagatagtgctgtattcctttcttgctgattgctgatcactaggttggctccctgataccctgaactaaataaagccttctaccttatacaacctttactggctttct

SEQ ID NO: 37962 - DNA, 1035 bp, Homo sapiens
acttctctctctctctcttttttttttagatggagtttcgctcttgttgcccattctggagtgcagtggtgcaatctcggctcactacaacccctgcctcccggattcaagcgattctcttgcctcagactcccaagtagctgggattacaggtgcccgccaccactcccggctgatttttgtatttttagtagagatggggtttcaccatgttggccaggctggtcttgaactcctgacctcgtgatccgccctcctcggcctcccaaagtgctgggattacaggcgtgagccactgcgcccggcccaattacttctctgtaatttttttcccctgaggattggtggggaaaaaaaatgcttggcacataacactccatgttaagtttcaggattatttcttctttttacattattttagttttttgttcatatgtactcagggctcacactttgcttggctccgtaagtcctagagaaaaatggtatgagaaatgaattcacatgaagcattagtgccttagtctcttactgtttttacctttcccgtgaatatttgtgcttacaaaatggtgtccagaaaggcagtgcctcagcgagataaatatgtttctaatcttagcatcttgggcagagtgaggctggcatctgaggtcagggaggccacagggccacgctactgaccgcattggtaacagactccattaggttgacagaaaggttaaggttcctggaatctgtctctaaattctccgtaccccctcattaggttagaagccaatgccaatacaagtaaccaataccaaaccctctcttgcttacagaggcattattaagttgggggcaccctaagaacaattcattgcaaataattgttggcacatttattctcatggcacaactttcaaaagcaaattaattataaactggttgcaatttaattcagtttgtctggattatgtgtttgcaaggcctagagtacatttggcaccgttgctggcacatttggattttaatgtctttgacaagccacag

SEQ ID NO: 37963 - DNA, 1039 bp, Homo sapiens
ctcttgaagcagaaatgatcacaatgtaatataatgagaataattaataaggagtgtgccagtgaccttgaatattaatattgtttccttttcctgtaaacaaactgggttattttattattattttagtgtgtaatttggcataaacactccttttcacatgatttccccaggtgacttttgtctccttggcaatttccggctttaataaagaaaacctaattaagaaggagctgttgattggtttgctagtgtaattaacacaggtgatgctaatgagtttctatgaaaccggtggtttatgggaaaaataaacagaccgttgttgcatatggcccaactgatatctgcactctggaagaaatgatgatttccaagtctcctgtgagtggtttgtgggcatggaataggcagataaaatattttataagattcattagtggaacttgaccaaattgagagcaaaaaaagtctcagtgttaggtgatattaaaaaatctgatccctggctgtagtacgggttaggtttgtcatttttcatgtgcctaaaaaggggcagatttcttttgtttggggtgtgtttccaattttcattgtaggcatttgaagtttgcaaaacttccagcagccttttttttttttttctttctttctttctttctttctttctttctttctttctttctttctttctttctttctttctttctttctttctctttctttcttttctgtctttctttcctttctttctctctctctctttcttctttttctctttctttctttccagagtctcactctatcacccaagctcgaatgcagtggcacgattacagctcactgcaggcttaacctccagggctcaagtgatcctcccacctcagccactggagtagctgggactacaggtgcctgccaccatgttcaactaatttttgcttttttttttttttttttgtagagatggggtttcaccatgttgcctaggctgatctcaaactcctgggctcaagtgatcctcctgcctcggcctccc

SEQ ID NO: 37964 - DNA, 1127 bp, Homo sapiens
ggagacagtctattggacaggctctgggaggcaggttatttcaggtgcaagaaaggaaatcacctcgtttcattaactattagggacttaacttcctttggtgtaaagctgagtccaatcatcccagatctccaatgagaggatgggggcgtgcttgctgtcctaatcaaacccagctggtcattcggtcccaacaggtaaagtttttgaggaagccaagtagagatttgtgaattctacaatataaaaatgtgaaaaatgtgtcaatgtgagccccttccagctctgaccccccagttgtttatgtccaacagtgtttctcatgtggctgtggataagtttctccctctttccattttaaacttccatttgtaggttgcttgtgacattttgcttcaggccagcacttagcatataatattacagatgcctgaaatctttcagcctttctttttcttttcttttcttcctttcactctcactctttttttcctgcctctctctgtctttcatttcactcccaactccttttttccttacaacaccaaaaactctttcgtttaaaaaagttggaaaatatatgaagacaccacacagcattcacaactttagcactgatctgatctatttttctgctattcaacagacctggattttttccctgtgaaccagaaagtcttttgttttcttgtctcagtaaacacagcatacggtatgtactaagtattaggactcaggggtcttattcaaatattttttggggggagtggggtcaggactatggaaagagatacaggaggtgtaggagactgggttttaatgtgagatcattaatcatttcttttttcctgaatcaggcttgggacaaaagggataaagagggttttcccctcaaatattcaatttatcctatcagatttcccacagtgactttctctaccaaggttcttaatgcactactcttagaatgtctcatcagtgaccagagctgatggggtctttgaacattagacagtacccattagtcaaggtccctgggctaacatctctggatggcattttcttctaagtgtgccattagttagtataatggactggtgtctgtcagcctttggggcaggacagag

SEQ ID NO: 37965 - DNA, 1041 bp, Homo sapiens
tcatagaatctgatacagcctcttgattctcttttttctgaagccatttgcataaaatgagtctcacaaacttagcttttttttttttttagtgagaaaattctggcatctgatgtagaaaataaattaatacctgcttaagagttctgttttctgcagtgaagcacagctgttattactgttaatggccccaagctttcacgattcccaaaccagaaaaacaagcgcaagatctttgctatgttgaagggagaactgggaaggcaaggtctcaattcagggccatttggaaatattaatataatcatttaatttcataatttcttttagcatttggctcgatgactttacaatatttttttaaaagtcaaatgctaacaaagagaaaacttcgagtacttcttcttgcattttcttgcattgaaggctcttcttgcattttttcttttttttcctctctgtccatctgtccgtttgtctctctttgaatatgtctgagttgaggagtgactttgagaaacaagtggcgttgcattgcctaaatagcttgtgttcttatcccagcggctggttttcaaaaaaaagactcctttttcagtcccttttcttcttcattatatacaaactgcaaggcagaaagcccttttgcctgtcccctaattccttagcccatccttaattagtgtttttacggttaatccctaccatatatctttaagagttgcacatgcgttggctccccacaagttttattgcattcaaaatagaggcaagctggcagtgtgtgatggtgggaatatgtacagtcactgagaggagttggctgttacttgtaattgattgctcactgaagcctgcccgcgcactttaccccgaggcctgactttcctccatatgcctagtgtcagaacttggaagccagctggtcagtcagcgcacatcctgtgggaagcggcagacacaggcggccgggtagccatcagcctccccgagcacatttcctctgtgttttgataatagttctgtaagctttaattatgc

SEQ ID NO: 37966 - DNA, 1118 bp, Homo sapiens
gctggattcctttctgctcccaaatagtttgataccagaagccagaaaggataatcatgctaaacctattaaaaaatggtttcatgtagggttagtctctcctttagaaaccattgtttacattcacagaggtggtgaggacaagcagctgttgagttcattgacctcagacaggagaaacaaaggacccagcatgttaatttattcaataaatgttcgtgaagcatctactatataaaataagttgtacccccaatcccagattggggactgccccagaagcactttgtggtcctcccagggcactcacctattaaggaaattggatttggtgtagaatctctttctcttttccaaatcaccaccaaatccattgccattcatctttctcctgccattacctggccattcccagggtaaggtcccacctccaaaaagagatttaaagtaattcactactcatcagatttagtgtaggttaattccctactatgctaataattttcatcttcaaggtactaatagttctaatatgaacccaaatttgtgcatattcttctgttaaggagaaagcatgctttggttctgttaaaggctcgacacattaaattgctcattctgatatgggacttctcattcattatgaaatgagaaggaacctcatgtagaatgctgaactgggacacaggagacctggttttgagtactgcccctgctgttatttagatatgtgagcctctgtgtctgtgtgtctcttaacttctctggatttcagctttcttatttatagaacgagagaagtaaacacttaggatctttaaggttacctctctcaatgactttaatcctctctacccttataaatctggttacctctcatatctgacattggacagtacctattattaaacatgtgcttaagtagcatgtactataaggtaaatagcaacctcacagaggtcagaactgaataaccaacaatattctcaatcaactttcagttcttcttccttacctcatccaagggatcagccaggtaataagaagataaggcagcaggtacagcccatgtctattgctaaaatctaccttaaggcaggaagctagtgggtgagatc

SEQ ID NO: 37967 - DNA, 1034 bp, Homo sapiens
cactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataattatgttttgttcttgtggtttgttgtcattataaagtgctttttttgaagttctgttcttaggaggttctgtttttaatttagttggacttacatgttgatccttgtcagaaatgccctgtagatggcaaaactctttgattgaaaaggaccatttcttttgaaatcttctacacccagtgttagcaaacttacctgtgcttcagaagtgtttgggaagctttttattttaaaaaagtacacatttctgaaccttacttctgattcagattgaatcagccttttggggtgcctgagca

SEQ ID NO: 37968 - DNA, 1099 bp, Homo sapiens
aagaaatggaattggagaggttttttttgaatggttgcaacatttgggttaaaatactatgaaaaaatacatttccatgttaaagatgtatttgtattgtatgtattaatacattatgatgaatattgggcaccttccttccctagatttctttaagagattttcagaagcgtgctttttcccatttgaagtttagccctgttaaaatctgatttctatacagtatttgatgttaatatctggctcatttacagaatctggttggaaaacttctatttgtcttagaagttattatttttgccctcattgtgtggtaaagtaatagctattatgcctttgcacatgtagtgatatatatgactatttcattaatgttacaaagttaatatactgatcaggtttttagtctggattaagtcagaatagatttaaaaatatgtaacaagagtctaagcctttggattatttttctctttgaattaaatgagattcagattattttatgttttctgaaaatgtatgctttttttaggggcatgacagaaggagtaacgctgttaatcctggcagtgcagactgggctgatagaactgcaggttgttcatcgggcattcttgctcagtattatccttttcattgtcgtagcttctatcctacagtctatgttagaaattgcagatcctattgttttggcactgggagcatctagagacaagtaagaaacctcttaatattctttaaattaactcatgtaatattctttacatgcatttgttgtctaaatatttagggaatatttagagacagaaaatggatatgggtaattggtattagcttaggttaattcaacaagtttatgtttttatttttcctatatgagatgtctgacttacttgacttttgtttttttctctcaagattttttagttaaaaatgacatcaaaggccatgtaattataagttaactttttctgcttcagatgaagttaatactttttatatttgtccaattttaaaattaagaacatagagcataaaatttagtctagcataataaatgtaacaaataatatttaattttattctgtgtaaattaatt

SEQ ID NO: 37969 - DNA, 1003 bp, Homo sapiens
tcacagacgaccagtggagatttatgctgctctttccagatcagccctacagaattagtattcaaaattcacagaacatgtgaatatgtaattatagtcagatgaagtttaagtttgatttaaaatattatctacgagattttagttagacttcttcaaaagttgtgttattatccttatcaacagtgttttttgtttgtttttattttgtggatgccaaatactcaaaattaaatgtattctattccctattttaggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtaagactgctgacaaccacaaacaggtagataaaattctacataaatgttaagtacattaaagttatagttcatttttatttcacagttatggtaccattcatttttgcagtttcaaaacagctgctattttcagcccaattaggagcatctgaaagattcttgattatgttctattgagaaggcagtaaagtgaagtggttctcttaaagcagatttatctgagatcgaaccctgatgctgctgttcactagctgtgtaaccttgtgataattgcgttactttctgtaaaacggagctaataatgaaagctgtgctttcctcatagagttctgtgagatttaaatgagtttagtaccaggcagacaatgttccatatgtgttagctattgtaatgaagacaaaaataataaagaattgaatacctataagtcaaatcctgctttttccttctgattatagtcctactgtgactatagtttcttccctttgtgtgcctaatttaaacag

SEQ ID NO: 37970 - DNA, 1038 bp, Homo sapiens
aggcatagtttattatgctcctgagaaggagaatcagcacttataataattttaacaattaatttcgtacttaaaaaactggctatatccagccttattggaaacaagaaaaaaaaaattaaaaactagcttatagaaaaagacatttgcaaatattaattttctaagttgaaaatttcatgaacttttgaaaagttgggtttctgttttcctttatgtgtatttacataatgaaacttattatcctgaaatgactaaaaacttgtttagaatatgtctatagaatggatatagcttgcagtttggaagaattaaatgtcagagattcatgggttcagtcaatgtcatataaatatttaatattgatattctaattgaacttaacagaatttggtaaatgtcagtttaaaatttttaaaattactaaactcttccttggcgttttgagggatgtagggaatgtatttttctagtgctaatccgtatagaaaattgagactatccaaaactaagggggaaaaaagaaaaaccatacactgatactactattcctgtgagagtgtggtggtcattcctgtgagggtgtggtcacatccacagatggatgttttttctaaaatttctaaactccagtatttcttttttttttttttgagacagagtcttgctctgttgcccaggctggagtgcagtggcacgatttcggctcatggctcactgcaagctccgcctcctgggttcacgccattctcctgcctcagcctcccgagtagctgggactacaggcgcctgccaccatgcccagctaattttttgtattttttttttagtagagatggggtttcaccatgttagccaggatggtctcagtctcctgaccttgtgatccgcccgccttggccttccaaagtgctgggataacaggcatgagccactgtgcctggcccagtgttcttaaattccttgttttattgttagatttatgaaccaacatattggatttgtgtgtctgtgacttgaattaagagcccagtagaa

SEQ ID NO: 37971 - DNA, 1034 bp, Homo sapiens
caagtttcactcttattgcccaggctggagggcaatggtgtgatcttggcccactgcaacctctgcctcctggattcaagtgattctcctgcctcagtctcccaagtagctgggattacaggcgcatgccaccacgcccggctactttttgtatgtttagtagagactggattttgccatgttggccaggctggtctcgaactcctgacttcaggtgatcacctgccttggcctcccaaagtgctgggattacaggcatgagccccagtggccggccacgcatttttttttttttttttaatagttggttctttctatgttgcccaggatggcctcgaactcgggctcaagtgatgcttctgttttagcctcctaaatactttggactatgggcatgcctgtcttagatgcacatttttaaaagttttttgaaattgtaaaaaaaaaaataacaaaatgtattttaaccattaaggatacagttcaatagtgttaagtacattcacattgttgtgaaacagatctccggaagtttttcatcttgcaaaactaaaattcaatagtttttaaacaacagcttcccatttctgcttctccacctgctgtcaaccattctactttctgcttctgtgaatttgactactttagatacttttcatgtaagtggattcatacaatatctttttatgattggcttacttaatgtcttcaagactcattcatgttgtagcatgtgccatgatttcctttttttttgagacagagtctcactctatcaccctggctggagtgcagtggcgtgatctcttctcactgcaacctctgcctcctgggttcacacaatttttgtgcctcagcttccccagtagctgggattacaggcatgcaccaccatgcccactaatttttgtatttttagtagagacagggtttcaccatgttggccaggctggtcttgaactcctggcctcaagcagtctgcctgcttcaggctcccagagtgctgggattacaggtgtgagccaccacaccca

SEQ ID NO: 37972 - DNA, 1022 bp, Homo sapiens
gcctatggggtagccctgctctgtctatggagaagctactctagaaaaaaaagaaaaaaaaaataatcctgtaacaaattatggaattaaaaataaaacttaaaaatatattttatacactagatgtgttatacacaaactatgctaggcatgttttattggacttggggtttcctttttttttatttttgagatgggtctcgcttttgtcgcccaggccagagtgcaatggtgcaatcttggctcactggaacctccgcctttcgggttcaaacaattcttgtgcctcagccttcctagtagctgggatttcaggtgcctgccaccatatccggctaatttttgtatttttagtagagacagagtttcaccatattggccacgctgctcttggactcctggcctcggcctcccaaaatgctgggattacaggcatgagccaccgcgcctggcctggacttggggtttctgatgaggttttcaacctcttactgtaaataagactgtactttactgtgtactattttaaagtaaagctcttgttgaaacaaggtctaatcttcctaagatcaggttttctgtgggactactaaagagtttatatattatgtgcttatcttcactgtaatggctgagttaatttcatattgataaaaaatgaaagatgtgttagtagttatttttgtctataaagtgcatcattatttcctggtatttatttaccctgttttccctaaattcttgagtaaattcagacacacagtaccagaacagaagcttgttgtagtggcaggtattgcaagaaagtaattggagattaagttatattctaggtagatttaatatagaatgcctttactaaacacttttgggcagtggttgtcaaaagaaatgtgcatagatttctgagcttcattccatcattttgcattttaaacaaagtgattctgatacagaagattcttggaccatatttggagataactgatttttagggggtagtttgccaaagtatttaatag

SEQ ID NO: 37973 - DNA, 1290 bp, Homo sapiens
aaaaatgatcttgctgaattacgagctagtggccaaatcctaatggaatttgagacaatgaagcttgaggatttctggtgtgcccaattcacagcatttccaaacctggcaaagacagctctagaaatccttatgccatttgcaactacatacctttgtgagttgggattttcatcacttttacatttcaaaacaaagtccagaagctgctttaatctgagtgatgatatccgtgtggctatttcaaaaaaagttcctcgtttctcggacatcattgaacaaaagctacagctacagcagaagtcactgtaagctgatatacttttttaatgaataatttcaatcttaatatcattgtaaaattaagctgtaattctgtctctttcatatttatgatatactgaattctatgtctaaaaaacttaagaactttaattttgaatgaggcatgtgaaaatatgttttgagaataaaaacacagcagaaaagattaagtactactgcctagttgctatcatgagattttcccaattctaagtatctgtttaacctgttcgtgtggtatatgaaaaagatacctaagcactagaatatccagctaaatggtgcaataggctaggaattgagccaggagaaaagagaagatatcccagaagtcaaaaaggcaaaatgaaagattgagttcgcccgtctttgttatggagaggttaatgaaatcagaagaggattatgaaatataatgggaaaaggaatgatctggcttatgtaagacttacttttaaatatactctttggagttagtctcacaatgtccattcccctagctcctgtgctatgaatatcatattaataaatagcctaatatattaatcactgtttgtcatctttaaattacttcagaactccaagttatcaaggctgctgaaaaggagattcctgagccttaccctagagattgtgattagtaggcctgtgataaggtcaaggatcctcattcataaccagctttccagactgttctgatggattcttggattcttgggtcctctgggttcaatttttcctatacttatttttcctttaccctaattttgtcacttatattacatcttatatgtatttttctaagttcaaaatgtcagagtataaatcataaataaattgacatgaaatcaatggagtaattcaagaccatcaaaaaattccccatgggaatctaacttagcacactttttctggatgataatttggcaaaatattttttaatttaaataaattttcatttctatt

SEQ ID NO: 37974 - DNA, 1046 bp, Homo sapiens
ctaagtcaaactaaaacatgctgtctcatgtttcaaattttaacttgttcttagatgattagtaactatgacactcaactcaaattacatgtatttcccacagaactctgaggagtgtattataaatgagataactggggaagaatctgtgaaaaaacctcaaaccctcatggaggtaagttgataatcatttgtcctgaatttttaagtcctggagggagggctttaaaacctgcacctgagtttttttttttcttttgaaacagaatctcattctgtcgcccaggctcgagcgcagtgcacggtctgggcccactgcaacttccgcctcctgggttcaagtgattcttgtgcctcagccgcccaagtagtgcacctgagctttgttttcacattaataacactgcatttcaatcctccctttcagctgcatcaagaaaaactgaaagaggaaaagaagaagaagaaaaagaaaaagaagaagcatcgaaagagcagttcagatagtgatgatgaagaaaagaagcatgaaaaattgaaaaaggtaatttgtgaagtctaaatagtaaaagtgacaagtagcagtattctttgttttttgggttgtttttatttttttgagacagggtcttgctctgttgtccaggctggagtgcagtggcacgaccgcagctcactgcaagctccacctcataggctcaagcaattcttctgcctcagtgtcccaagtagccggtattacaggcacatgcccccatgtgcagctaatttctgtatttttttatagagccaggatttcaccatgttgcccagtctggtctcaaacttctgagctcaggtgaactgcccacctcatcctcccaaagtgctgggattgcaggcatgagccaccgttcttgccagtattatttgtcaaggcctttatttgtaatggcctgtgatctagtcctgtctccaaatgcatttttacaatgatgaaacaagcctagagtctgagtgatttgctcaagttatattaatggagatattgtgaggtgtaggtattg

SEQ ID NO: 37975 - DNA, 1043 bp, Homo sapiens
ctgatgagccttttggatgccaacagagagaacacaggaaagtgagtgaaatattttttctttccatcttaaagtagctttgcaaaatgacttccatataccagtcattaagaaatgcctgttacaaggttgaaaactaactattgaatactacactcactacctgggcgatgagatcaattgtactccaaatctcactattatgtgatacacccatgtaacaaacaggcacatcacgtatcccccgaatctaaaataaaagttgaaattatagatataaaagaaatggctattagaaatcctggatgactttttccccaaaaaactttatttgggaacattataagctccttcagtctataatcttgacctcccctcaatcttctgaaattgccttcttgaaatttcaagtggcatcttgatgctcaaatccaatcataatttctcaactcttaagttgtttctcttttttaacatttgatatattttactctactattcttcggattttcccccattggaattttgctaatattctgatattgaaaatctggttagtaccaagcactgttttactctctccatgataacctcatgaaggaagtacttatcatctccattattaaagacagggagctgtgtacaagctcattcagctggcacatagacgcaatacaatgaccaggatcttctctggcttcattactgtgtggtttagtcagcatgaccaactgactgaacttttattatctgccctgtcctaatcctaaaagtgataacaaccacagaacaaacagtcattccctttgttccatctcctcctttaaaattagttgttctttgatcgcatcccatggattttgaaaggaaaggtattcttactgatttttttcagcaattgagctttttaatttccttttgccttaaagaagtttagaagaatgcttttgactatccaatggggtgaatgtataataattttaacttttgatttctattgtttttttaaatgagattgtagtcacagaatatgatttatactc

SEQ ID NO: 37976 - DNA, 1070 bp, Homo sapiens
ccacttacatagaaaaatagtagaggtgagggggaaatgccgttttagtcattgtcctgagaatcgacatgctgtttctctgtaaccaaaccagaaaaaactgaagcataagtgctgatttcttgaatagccagtggagctcaattattaaaagaaacacaaaatctccaatgtaataaccagttttaattttagagggtataatagttgcctagaatcaagccaacgcttcagattggggagtgaagattttagaacccaccaatgtactaaacttgcacacggcaatgaatttaattaattgattaattttgtaataacgaagaaagcaaatcaagtgcactgagtccatattttctgattctaacataagacaagtaagagtcagctcctttattcctaatactaggtaaaaaattcattcttggtctctgctttagcttcttttgctcgtttttttcaataaatatttgttgagccttttttaagttgctggcacaatgcttggcatatagcagtgagtcagttagttaagcttccttgtcttatttagcttatgtagaacacagcactggtcattcacactgtgatgggcacaagtaaatgagccgccagggtgtaagataataagttgtttgggttcacgatgggtgatccaggatgcccctgcagaggaagtgactcataagccaataactgagggatgagaataagccagtcagttgaagagatgaggaagagcattccagggaggggaacagcaggtgcaaagattgagaggtaggaaagagcagctctgtctttggtgaacggcacagtaaggaaagcgtcaggaagagtagggaaacaaacaaaaaaacacaattctctatttattttgcaaatactttttaggaggcattttactaagcacttttagggatagaaagaagattaagatgtaatccttgccctcaacaacagaaaaagattattatttcgttagtatagattaattctataaatcaatggatatactgtagctttatatatgtggataatatatctctttttttttttttttttttttt

SEQ ID NO: 37977 - DNA, 1048 bp, Homo sapiens
tcagaagtctaatccatctcatatgttattctgttcccccactgagataggacaacaaacaatctcttgatatttatgtatgtacatatgtacatttttgctgtacttttacataaaaccttaattaagcctagatgtgaaacataattgctcacttgatttttttctccctacccattttatatcatagaaaatataaacaagtgtccatggaacacagatttggtccttcgattaaagctcatctttccagagcaagcatgtagtgatggggttgtcacctccaatctgtacaggttcctcaaccaaatgccatgcagtagttgagtaacagagaaaaaaaaatcattacattgcattatttcatctagtgatgtattctttaggcatatatcagtgcactagtaacttgtattagatattatttaagaaatggcaggccgggcacggtggctaacgcctgtaatcccagcactttgggaggcagaggcagacagatcacaaggtcaggagattgagaccatcctggctaacacggtgaagccctgtctctactaaaaacacaaaaaattagctgggcgtggtggcaggtgcctgtagtcccagctactcgggaggctgaggcaggagaatggcgtgaacccgggaggcagagcttgcagcaagccgagatggcgccactgcactccagcctgggcgacagagtgagactctgtctcaaaagaaaaaaaaaaaaaaagaaaagaaaaagaaatggcaaaaataataactattattattgtcagactgttgtctccctgagggcaggagcaaagttctattgttttatttatatccccaacacaagcaccacttctggagtatggcagatgttctatgtatgcttatgtttattcaatctttgagtaaaatctttacttttattttgcagtacgttggaacaggctctctgtgaaatcattttgaaaataagatatgcttccataattttttttttctcagaaacttggagaataccttacagaaaagactactaaggggaggtatt

SEQ ID NO: 37978 - DNA, 1064 bp, Homo sapiens
ttttgaaagtggccaggagcagtagctcacacctacaatcccagcactttgggaaaccaaggcaggtggatcacttgaggccaggaattcgagaccagcctggccaatgtggcaaaaccccatctttactaaaattacaaaagttagctgggtgtggtggtgcacacctgtagttccagctactggggaggctgaggcatgagaattgcttgaacccaggaggtggaggttgcagtgagccaagatcgtgccactgctctccaacctgggcgacagagcgaaactctgtctcgaaaaaaataaattttgaaagcaggatgtctactttctatgatatagtccttaatgagtgtattgtgtactgaacaaactttaatatttctgcatttaaaaatctattgatcattttctatggtaatactataagttcctattttaagatattcctatacatctggttttggtgggtggagaggagtttaagatttgactttttccctaaagtaaacctggaaaacctgactagcttctggaactttacatccttttcatagaaaattggtactttctgatagtttttaatgttacccagaggttaacaataccccaaaagtgcagttgaccatatgtttaggtaagtaagtgcttatccccagccagggctttaaacataacctttacagtttctggaaacagtagcaaaaattaccaaaactatgaaggcatattctttttgatttaagcccattttcctcattttcttctagcaagagtttggagtccagccaacccagatttctttgaaaacaaaaaaacacaaaacattaaatgataccactaaaagaattcaagcacctggccaggcgcagtggctgactcctgtaatcccaacactttgggaggcccaggcgggtgaatcacgaagtcgggagatcaagaccgtcccggctaacacggtgaaaccctgtctctactgaaaatacaaaaaaattagccaggcgtggtggtgggcacctgtagtcccagctacttgggaggctgaggcaggagaatggcatgaaccc

SEQ ID NO: 37979 - DNA, 1782 bp, Homo sapiens
gcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttatt

SEQ ID NO: 37980 - DNA, 1070 bp, Homo sapiens
actttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttt

SEQ ID NO: 37981 - DNA, 1701 bp, Homo sapiens
taactttacacgcttttcctcctaaataaccactctaataattcatacattcatatcttcaggtaaagaaaactgaattttaaacaattgaggctgggtgcagtggctcatgcctgtaatcgaatataaggacttgagtataaaatttgaaaactacatggggaaatgtctttatcatgcatctcttgatagtctactgaaaactattaagtaaacctgcggtctgtaaacaaaaaaacccatagtgatacttaccttgtgtaatgtaaacaattttttaagctctttaaagtacatctagatttactggtaatgtatagaagtcaattttatccccaagcatttctacttcctaaaccattagcaagagtctcaaaacaacttcactaaactattggacctccagtgttaacttgccaacataaaaatctgaaaaactttgtaatcactatcaaaaatacaaaagagagaataaattcccaggtaaaaggctttacaaattttggaactattatgcttttgtttactaaacactgatccttttagtaattctgcagtattgcctcagactcccacaaagtttcaaaatagctcatctattagattcctgtaacatttatttgggataaacgtggttttgttgccgttgttcataatagaataaaatatttagctttgatggttcagatgtaatacaaagaaataactaagtttgggcctgagataaatgtggtaaagcaagaatgcagagatgctgtaatgatgagtgagttttatagcattactgaggacctgaaaacttgctgccaaggacactttgaaggttttgttggctggaagaagtgtctctggaatcccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctgga

SEQ ID NO: 37982 - DNA, 1860 bp, Homo sapiens
tggattgttatacagttgaatttatcagtcttttcttttatggcttctggatattgattcatagtaagtaagtcttctacattccaaatatataaaggaataaacccttattttcttctgatatgttaatggtggtatttttatacttaaatctttgatttacttatagtttatcttagggtattttgtgagttacagatcatgctttcatttttcaggttttttgtttttttttccagaaggccctaatgtctaataatccatctttatttcactgatttgagatggcttttttacatatgctggcttttcattctgttgatgtaccagcattatactttcagctttatagaggcataaaaagtatgttttaatctctagaagggctagtttcactcctttgcttgattttctgtatgaacttggcaaacattttctctattacaaaaatgtttttggaatctcagtaagtttacatattaacttagggacaaatgatatctttatagtaagtcttgctgttgaagaacttagcttgtctgtttgtttaaggctacttttgtgcctttcacacatttaaaaaggcctctccaaatatgtccatacatggctttttaaattgattcctaaatattttaaatttactgttctgttgtttatcagtcttgtctcccattatgcttcctaaccattgttgcttgtgcaccccaagttctttgtcagggaatccagtgccctttgatagtggactttgtctcactcttcagtaatatctcctgcctctcccttgcatagacgcttcactccgaccaaacatcttgtgatttcatagatgttttcatttctcatttctgtgtgcctttaacctttagttgcctctgcctaagatttttcttctcattttttctggctttttctggtccttttgctctgaaagccctgcctcataccttcttaacttttttctcttaccactgtaataaaagatatttttttgtttgtatttccaaggttagcctttgtttggggttagcctttgtttggattttttccctgttactgttagcgcttctcttgctgtcttttgtatgtaggcctgcattgtccattacagtagcctctagccacgtaaggcacttggcttatgagtgccacatgttgaattgatgatatttggatatattggcttaaatgaaatgtacaattaaaattaatttcacttgtttatttttacctttttaatgtggctaatagaacatatatgaaattatatattactcgtattttatttctattggacagtgctgcactagactaattcactgtttgagggactatctgtctccagcacaaagcttggtatgtcataaatgtttcttgtgactgaatgaaaaagaatttgaagttaaagctgagatacttttggaaacattttgtaattttggctaatttgttttgaatcaggtttaagtgaagatattttggtaatctttgctttcttataataactaactatgctttttttgagatgtcattttaaccttaattctttgaaaggtattactttactcttgcatagattttttttgttagtttgttttgatcttatccctatgtgtttctactttttggtcctaattttataaaaatatccaggttgtagatatatctgttaatacgtaaaatgttgctttttatcagcagatttgactttatttttcatttttctgcagttttgggaatatgatttataaggagaagcgagaatctgttagtaaagaagatctggcaagagctactttagttactatcaccaataacattggttctgtggcacgaatgtgtgctgttaatgaggta

SEQ ID NO: 37983 - DNA, 1083 bp, Homo sapiens
tgcataaatattttaaattttgatgtttcgtgttttaaaatagtctataaaatacacccacagagatgcttatagtaaagctcagttttccccattgcaaataaacttgatgtcaacttgtgccacccactgaaaatatttaaacgtcacgtaattagtaacatattagatgtctctgcttttagcctgaaaatgatcagagccctctcaaagactcttgtccccaccacttcagtttgctgagtagcaggactgtgatgggatatttactagtgtgtgtttagtcttttaaaaaaatcttttggctatctcccctcaccacatactttttttattctctttctcccactttggtttattctcttctttctatggcattttcttcttccctgcagattccattctttccacataaaattctgtacatgtagagtctcctgtttgatttctggtgttctcaaaaagaaaaggaatagaaaatgcttcacaaatccagtaaataaataatatactaatagcaaggacctttatgaaatgtctgcacgaaaaccaatgcaccacaaactgccatctctacacaccccagacttcccaatgtgatgatttagatccttttctacttaggcggatggtgccatttttgccgaattcagcatgttcattgaacagtttctcgaagccaaaagccaactccactgcatttctgcttggtaaggtttggtggccttggcgtggggtagaggttgttgattcaccggcctctaagctgatgataaatctagaagctgggcagcaggactagactgccttcatagaacctctgcagggagtcggcggccccaacactgcaagaaatctatgaaaaagaggcttagcaaacccgtgtgaataaaggctccagaagaattaggggtcgagaagatgtggtgagactccgtgtgagtgggcatcagtgagaactttgaacactagatacagaactcgccaactgaaaatgtgcttctgcttctcgagatgcctgtggactgtttattttcttagtctaaatatctaaatcttctatcatgagcatctattgagatg

SEQ ID NO: 37984 - DNA, 1024 bp, Homo sapiens
aatatatatatgtatatatatataaatgtgtgtgtgtgtatatatataatccatgacccgtgtcccaaagaaaattattgacattttgcctattttcttctatttatgctttttaaagaacattatataacatgctttttaatatgctttcattcaacatcataagcattttacctgtttcttttaaataattattaaataaataacagtttttcatttaaataatctttagttcacctaatcattctatggtacatttggtaagtttttaatgccttgagaaataatttttaaaataggatgcttccctccttatttattagattatttctgtaagttagattcccaaagtgggattactgggtcaaatgttataaacatttttaaggcttttgagccattttggggttgaggaaaaacccttcttgttagagctctacagaagccaagtaatgatgctaaatttcctaatttgccgtatgtcactgtttgctctctgaacttaagtgaactttgacttggccacaaaactacagttctgatttaattcattcattcactcacacaggtttaggtgtcaggtacagtgccagatgctaaagataagagaccaagcgaaaccagagcccctgctctcatgtccagaatagcatctgacccagaaagaccctgatttgcttgacaatagagttagataaacccatttgaaagcatctatttttaccagagacttgatgcttgaatgctgactatcttcttccggttttgttcttctaagttgctccgattttagacaaagatgaccactccacattctatttgaaaaccattcaacttgagttcagggcacaaaactaaaatattttgtctgtgcctgggcaaaccattttgtgtggagcctcatgggcctagcagctgctgcttccttttagtaattgggaagcactgggatttctgataaataattgaaagtgtactctggcaagttgctacagcagttttaagggcagtgcctattttacca

SEQ ID NO: 37985 - DNA, 1072 bp, Homo sapiens
gttatactgttgctggcaagtaatttggggtgtgctaattaccatctgaactgagcagcaattctctgatagggaccaatttgtggtaaggagactttccttgccagggatcccctctctaattttcggaaccatgaaaacttctaccattctccccagtttgacatctcaagggcccctggcctcagacctttttgcatggaaaggctgggagaaaccagctaatttattttcctgagttatgttattgaaacctgattccattatttatttcagaaaaaaatgtgtgttttcatacacttcatatgtagacaagccatgtaatgatatattactctggaagcagcctttgagagcttctagttgaggcatggcaaagagattatgtcctggatgcccactcggattagataaatggtgctcagggtaatatattgaacatgactctgaggtcagaaaagctcagaaaaggcatctggggatatattaggcctggatgccgtggacccaggacagggaacggagcacattccctaggtgctgtcactcccatggaactcatgctcttcatctagcaggttaggagccggcacctagagattggaggcaactaggatgctgctgttgcttacaacacctctgtgcgagttagaaaaaggtgatcccccccccactctgggctgaccctgctctgggatcacagggcttgggatgaatcctaagtgaatgcctcttaagcaggctccctagtgctttggtggagggagaggagcatagagctgagtggtccccagtctgttgtcccagcagggtctctggccactggccaatgccagcaatcaaggaacttctccataatttgccccaatttgcccccatttccccttgttcctcctgaaggatgcatgcagctcagacttcagccatcagccatcagagcatccctgacagtttgaggccttgaaggggatcaggtgtaactgagtggtttaaaagtatgaaaaccagacagatctgggtctgaatctcgactttgtcactttgggtccttggccaactgcttaatttccca

SEQ ID NO: 37986 - DNA, 1026 bp, Homo sapiens
ctagctttgccggtggttgggcccaataaaaactgacaccatgtcataggctttccctcacttgaccacagaggtcctgaggtcaagtgagagactttccaagatgctcaacagccaagtcctctgtccagccctcagggccagcttagaggacaggaacaagctagtgaatcatggggtctctctgggtcaaccacggtgatgtggccttttagggaaacacagtgccctcctggacagactaaggagcagctgagtggacccgcctccagtggaccggtatagcctccatggtgctgtgcaactctgaacggattacattacctctctgggcctcattttcatgaaagtagaattcttgtatagtcttagtggttttcttagtggttatagtccactgggggaactgtaagtatccgcctccctagtgtctagaacagtgcctggcacacagtaggtgttcagcagatgtgtatttaataaaggaataatgaacctcaaaactacaagtctgtctttagttcttaaaagtgaaagatgggccattatagatctgcattctggcatatgactaagggatcctcactagtaacctatgacatgagttattaagggtatctaaaatttggattttatgaactaatatttattgccttactagagttaccaaggactcctgttgagtgatctactctggagtctggttgccaggcattgcttagcaaccttgcaaaactcctactgtgcacatgcccatgaaaagaactggaaatcctgagcacttaaaccacagggctttctaatcaggaactcatcagcgtcatcctgagtgctctgtgggttttgattgctgctcttcttgtattaattgataagttctgcttttgttgatcatctggattttctattatttctgcatttttgccgttttgattgttatgttgttttctctccagtattgtttgttgtcacagagttctgtctcacctggaaagtgagaatgaacagtgggttgcagctgtagaa

SEQ ID NO: 37987 - DNA, 1041 bp, Homo sapiens
agaaatctcagaccccacaggcctggtggggtgtggtggggagattatgtaagagagtctaaagtccttgtaataatagctaccatatgctcagccctgcacttatagaatttatcatctcaaagcacaaccctctgcaagagaggaatcacatacccattctacagatgaagagatgtagatgtgaagtcacatagctaatgggtgactggaagaacctgggacccaccccaggcccctttcatttccagacagattccatgtctggtttgtctctaccatgtttcttcgtacccaggaaacataatgcctaaattatacagtatacaatataactatctgaatcagaatttaaactcagaactccacagcctgggcttttttcaatgatgctgtgatgacatctcctcttctactaggaagccttccatagtgaccagaaagctacaggaatagtcctcgctgtgcagaaggatttttaagtttgtctgtcagtgtctgtcatcataagagatcacctggagagtttttataaaagaatggtggtcctacccacaggtagtctgatttaattggactgtcatggattctgggctccagcttcaggttgagatgaccctctggggctctttctcatctccctttatggtcagcaggcagcttcagtattggatgactagagtctgatggggagaccacagcactccaagtgctgttctcggacaagagagttctttgagaagcagccacagtaaagaaggttttctgggggctttttggttacactggatcatgtgaactatagttttagatctactctgaaaattcatttcatgctgaaaaaccccaagagaatgcaattcacatctctcttcctcccatcctccagcaatttgttttctagcaggagatgactggttcctggaagtccatctctaggggctccggtagcagcaacttggtgagcctagttgcttcctgtggggagtcttgggggaggatgaggagtttaggaaaagggttggataggggaagaagata

SEQ ID NO: 37988 - DNA, 1036 bp, Homo sapiens
gcaggtgttcttgggcctatagcaatttgcctcttcaggagccatttctccattgactcttggtttattttagtggaggatggtatttagaaaccaagatctacttgctaagctgctcattctattgagttgttgcttctagatgcacttggtggacagagctagggaatacatgtatacacacacacacgcacacacacgcacacgcacacacgcacacacgcacacgcacacacgcacacacgcacattctaatctctatgcatctaatcatctctctttttctctgtcttcatgaattcacactgatttcttcaagccaatacaacaagttcatcctagttttctgccttttcgtatttgtaacacttcttggacagtaagaaacccagaacatatttactaatttgcttaatgctcctgcaagtaaccaatctgttattactgccactgctacctattctacggtcgtgtgaattacctcctgacccactcgtgctctgacctgacgtgctgggatgcatctctcttcctcctatatggatgccctcctcccctcagtgtggctccaacaccttgtgctggtccactgcagctgccactactcatggagacactctcctcacccactcagactctgaatccccatgctaggctgtcaccaacactgcctcccttcatgagtccccttcttaccctacctggtgagacaccttgggccaggctatccttgccacatccaccactctgtgtagacacgctccttacctgtctcaggttctagaactcccatcttcaccttctgcagactcctaccttgctcagccacacatgatggcttttagactcaatcaggaagggaaaaaaaggagaaagaacacaaatgatcaattttaacagctgtaaaacactgcgtgatgtggatgtaaccacctagttacaccacctccatgtttgcttaaccgcttcccagctgtattaagtagagttatttatgttttttccttttctagttaccattccaggaatcaaacta

SEQ ID NO: 37989 - DNA, 1050 bp, Homo sapiens
catagtattcatttggcttcgctgtcaaaaatcattattctgtgcagtcgtggccctgggaaggggaaataagaaggccctgttgacgggctgtcttggctctggaattcatgcatcctggccttgccaaggttctggcagggcctgctggtgtgttggagcctgcagggcaggtcaggctggttcagaggcccatgctgaggggtgggtgctctgaagtggagtgaagcctcaagcccatgaatgccaccccagtcatctctggtgtcagctgctgctgtggccccagcaggttctcaaagctcccaagtcctccctacgacacagcccaaatgtgtaaatggcactgttgccctgacagtgcatggaaaggacgttggcatccaattggcactccttctcccttattcaatattaggtttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaa

SEQ ID NO: 37990 - DNA, 1050 bp, Homo sapiens
ttttcatgacatgcagtaattaaatgaaatttaaattgcagtgttcataaataaacatttgtgctacacagccatgctcattcctttatgtattgtctgtggctgtttttgtgcttcagtggcagagcttagtagttgcaacagagaccttatggcctacaacatctgaaatatttaccatatggccctttcagaaaaagttggctgacttctggtcttgcccctgctccatctattagcggtaaaccaagggtctacatcaggaatggcaaataagtgttttcttcatgccaactcagtttggtcagtagtgactggtgggtgtgttgcctttggaaggattctgggaccccacgtggaccccaaaggactggttgtggttggttatgtctgccttgcaggagtgacctgtaagccacttacctatttgctattatgggtctcgagtgtgttcagactgttcctgatcataatcttctgccctgctgctttctttctggatagatgcttcataagtcagttgaaaaatccacgtggcagaattactgtaattattgaatggagctttaaaataggaattacagaggaaggagacaaggatctcttgagtgattgctcctccccctgacctcccctcccaataagcctaagaaaatatagggaaggaggaatggacccaagtaaaaactgcttaaagaggcatatggcaaaattcaagacatccatattatggttttctttttctggtgtattacaatagatgaactgacaacatctatatattacctaaaagtgccctgaacaagattcctttggttgagagatgaagcagtgatcaccaatgctgtttcttattggctgtggtagaaaggaaacttgtgttacttcctccaggccctccctcctacctaccttttttggaaacctcagaacaactgcctagttgtgatcaattataagtcaatggaaaaatcttatctgcttaagctggaggttccctgtatcccagcacaagcagtgagaccacaaatgtgtttgtctcttcaattt

SEQ ID NO: 37991 - DNA, 1052 bp, Homo sapiens
cctgtagtcccagctactcgggaggctgaggcaggagaatcgcttgaacccaggaggtggaggttgcagtgagctgagatcccaccactgcactccatactggcgacagagtgagaatctgtttccaaaaacaacaacaacaacaaaaaaaccacacccagattcctgggccttaccgtctagagattctgattttgtaggtcaggagaagattggggggatcttttctttttgctgttgttttgaaaatcagtaaccctgagttgagtcagatacaaccacacaggcttatagaccacccagataggttgaaggtttgggtgctgctttcccgtcacagatgatggggatgttgcagcctttgaggtttgaaaaggcgagtatctaatgcattctttttattttttattttttttaaaaaaagacagagtcttgcactgtaacccaggctagagtgcagtggcatgatctccacttactgcaaccgccacctcctaggttcaagtggttctcgcgcgcctcatcctgccaagtagctgggattacaggcgtgtgccaccatggctaatttttgtatatttagtagagatggagttttgccatgctgtccaggctggtctcaaactcctggactcaagcgatctgcccatcttggcctcccaaagttctaggattacaggtgtgagccaccatgcagcccctaatgcatccttgtcttgccatttgtttcacctttcagagagcagagggttctagagaggaattagtttgagatgtgtttataaccagttaggaggatttgggttaatgatgtgaagtttacattactttaaaagtggctatgttctcagcctgggcaacatagtgagatcctgtctctactaaaattttttttaaaaaaaattagcctggcatggtagtgcatacttgtagtctcagctactagggaggctgaggcaggaggatcacttgattctggaaggtcaaggctgtagtgagccatgatcatgtcactgtactccagcctgggcaacagagtgagatgctgtaat

SEQ ID NO: 37992 - DNA, 1025 bp, Homo sapiens
tcccaaagtgctgggattacaggcatgagccaccatgcctggccaaaatcttactttatatgctagttttagtggcttacattatagctcttaatggtgatgagttagaatttgttttaaatagttgcctgtaattgggcagttatttctaacttttccttgttatattgtggtggacattcttatgcttaaagcaacttagatgccccttattcttgccaatattcatcacagcaaagacttttcatctctgttttgaactcttattttttggatctgttaagactcaaatgtcttagtaaaagcaaaatttcaaaatccttgttcaatgcttccccctggtggtacctggtgtcagtgagcttttcctcacccaagatacaagggaagaaacattcctcgacagtggggcgctaggataaattgagtggaagatagatgccttcccatctcatacctctaaatatggacataagaacttcagacaagattttgtgtgaaggaaaactgaagactcctttggatatttataaaggatgttttctctgggatggatttagtccactttaagttaggggacatactgatagtgaaagctcttggttcattccatgtaagactcctgagataagttcctaacggaattaataggtatttgtaattcagctcttcagttcttagaattatcttttgtgttattttttctggtattatgtatgaggaggctgtcagaatagtggtcaatagatagcttgacaaatgtttgacaaaagtattgaggttattttgtttttagacagggaggttactgcacttcatagtagttgtggtttgagtctagtgattgagattatttttaatgttactgtccagatgcagtgtatgtagtttcagttttaaaaaatatgtactgattttatgtaaggacttgtaggaagatttgatgagaaatgcattgttagtataagagtctgtgagttgtccataaaccacctacgtaagatgcagagcttttcaggtataca

SEQ ID NO: 37993 - DNA, 1080 bp, Homo sapiens
ccccttcctgtgtctccagtgttctcattgttcaattcctacctatgagtgagaacatgcagtgtttgtttttttgtccttgcgatagtttgctgagaatgatggtttccagcttcatccatgtccctacaaaggacatgaactcatccttctttatggctgcatagtattccgtggtgtgtatgtgccacattttcttaatctagtctatcattgatggacatttgggttggttccaagtctttgctgttgtgaataatgccacagtgaaaagtagcatcttcaaatcggagagtgaagtaatgttttttggaatacccattatgcactaagcattgtgtagggcagtctccatccccacaacaactctgtgtgtttgtatttgttcccatggtaaaagaacttgctcaggctcacacacacacacacacacacacacacacacacacacagaatgagtgaccaaatcaggaatccaacttctctttggcttcaaagcctttgactttcctactccatcatactgcattcctgatcagagccagttttgtgacctgtagagcagctagtgttcagtggtgattcttacatcattacctacattggtattttcaaatggattgtttggaaatactgtataaatagtccaaacattttaggacttgtagaacataaaggaaaaatagggaaaatttgagagaggcttattccctaaagacaacaaacaggatcttgtaaaacactgataccttaaatagatctataatatccttttgaataatactatgagacaaatgttgtttaaattttataccccagtcttataattttaggttttggaaggaatttagagagactgctatccataaatgagttgttactcttttcagagcacaactagcccacttccccttctcattaagtttccatttagccattaggtgggagcttcaaaagggaaaatccaatcatgtataatctctagttaatgggcatctattgagcgactggatcaccagaaagaataattacacagtacctctttgtgcagtaagcacaaaaatcaaaagctaatgcatt

SEQ ID NO: 37994 - DNA, 1051 bp, Homo sapiens
ggatgtgtatagcatttctctaatttctaaacctaattagactcttggatgcttttttctccagacatcttttgcattgcctggaatcctctggatcctctggtcagtgtaacttgagagcagcattttccctttggtgtcttctgaaacctttataaaagaagtggaaaagtatgtaggatgggagaactattgcagcccccatggttttattaaaaacaattttattaaattgtatgtctagccttctttatgaagccttaaggcaatagctgctattttcttcagggggttgtttccttatcaaccatataagtaaacatcatttctctgttttggaataaatgaagagtgaaattttctcactgtgaagagttgtttcatgtatagtgtacagggaagtctgacatttcttgtgtttccatcttaagtaaagaaaatattaaggtggtttaggtcacaatagctctggaggattctggctcctatatttcaaaagcttttagtttaaaacatatatacatctcttggctgggtgcagtggctcatgcctgtaatcccaacactgtgggaggctgaggcgggcagatcacgagttcaagagatcgagaccatcctggccaacatggtgaaaccctgtctctactaaaaatacaaaaattagctgggcatggtggtgtgtgcccgtagtcccagctacttgggaggctgaggcgggagaatcgcttgaagccgggaggtggaagttgcagtgatttgagatcacaccgttgcactccagcctggcgacagagcaagactccgtatttaaaaaacaaaacaaaacaaaaaaaccccacaaaaaacagaaaacaaaacaaaaccatatatacatccctcatatgtttcctctgcagtacctggagacatggggtggggactgacttcccatctctcttccacttaattcctcattcctttccgtgctccacctttcatgtttccagccatttgttctccttaccactcttagaacccagacattgtggccttgcaagacggctttgtaact

SEQ ID NO: 37995 - DNA, 1050 bp, Homo sapiens
ctccagcctgggtgacagagcaagaaccttgtctctaaaacaggggtgtccaatcttttgtcttccctggaccacattggaagaagaattgtcttggactacacataaaattacactaacactaacgatagctgatgagctaaaaaaaaaaattgcgaaagaaaaaaaatctcataatattttaagaaagtttacgaatttgtgttgggcctcattcaaagccgtcctgggggcctgcaggccacgggtttgctctaaaaaatatataaataggctgggcgcggtggctcacgccagtaatcccagcaatttgggaggccgaggtgggcggatcacttgaggtcaggtcaagaccagcctggccaacatggtgaaaccctgtctctactaaaaatacaaaaagtagctgggcatgatgatgggcgcctgtaatcctagctacttgggaggctgaggcaggagaattgcttgaacccaggaggtggcggctgcagtgagccgagattgtaccactgcactccagcctgggtgacagagggagactccgtctcaaaaaaaaaaaaaaaaaaaaaaatatatatatatatatatatatatatgtatgtacacacaacacacacacacatatacacacacatatatgtgtatgtatatatggttaaaaaaaaccacatctttcctctttataagaaaatttacgaaatagactttgaaaaagaagaaaacgtccattggtagcgtgagcatctaccacccagagagaacatttgttgctattttagggccttacttcctcctgtctgttcggtagggaggaatccatcaaattgtgcagtgttattctgctgctgctgattttaacagtggtatttttaatgccctgtggaaccccagcttgactttggagtcactagagggataaaggaggggctagcacagtgtgcctcctacttcgatctcacttagaatggctctggatttatctattctacttaatggggctcttaggaagatttcattttaaaaactttctccttatagaaatagcta

SEQ ID NO: 37996 - DNA, 1049 bp, Homo sapiens
ggcctctattggttatctctcaaccaagctgaactgagtcagtgtttcatttgcctcagatgtcctgattcaaccagttgattgttatagcaaataatcaggaattcagaccatgtggattattgatttgcccagattcctgtggcatgagaatcataccaatgttaataatagtatgtatcatttattttccacgttctttctatgtgttggactctaggaattggattatctcatttgatcttttatggaaaagttatctaccttgccatttttgtatatgaaattatagaggtgaattgacctgcctaaggttacacatttatttaagtggcagaactgggttaggaacataatctggatgactgcaaagccagtgctctagtcaccagtctgtagtgacaactgccattttaacttgcaactgccatttttaggttgaaacaaattccccttaatttttggagttaaaaatttaaagccaacacagcagcatgatgtaatagactggcaagttgtcttgggaatgtcatttgcagcctcagctgggggagagtgttagtgataagccttttgctggggtaggactgattgcttggaatgacagtgaggatcacgtgaattgagtttgagtgcctccttccaagctctagtgcatatagtgctgggcagtaagtagcacaacttcttgacagctgcctttcttgtttctttttttacttttaataggtgtagtgagccacagtggtctgagaatgccacagaacttatcatagcttttgatataagagaatattttttagaggagggagatagcttggtagaaagaaccctggctttggtgcagacaaacctctattctagtcctgttcctactacttaatgactttgtgatactgggcaagttactttattttcccgaacccctgtttcctcatctttaaaaatcataaagggtttttatgaggtagagaaagataattgccacctcttactgattcttactcttggggggtatgaaatccattttttaaatttacttgctcctg

SEQ ID NO: 37997 - DNA, 1065 bp, Homo sapiens
aaagtcttaaggggaaagaggcttagtgtgtattgttggcttaataagcaggtcaataagtatttgttaaaattggtaaatacccatggtatcaggggtattcttcagacatattttagcaatatgaaagaacactgctcacttaaaaaaaaaggacaatcgtctgtactgtgaatttagctaatatgaagaaatcttttcattattctaactgaatagttaagcaatcatggataatagttattctcgaatgatcaacatgggtttccagccatgtccctaaattaaaaatttgaagcttcaagaatcacttacggccaggagccatggctcatgcctttaatgccagcactttgggaggccaaggcaggcagatcacctgaggtcaggagttcaagaccagcctggccaacatggtgaaaccccgtctctactaaaaatacaaaaataagccgggcatggtggcaggtgcctgtaatcccagttactcgggaggctgaggcaggagaattgcttgaacctgagagatggaggtttcagtgagccaagatcatgccaccgcactccagcctgggtgacagagcgaggctccatctcaaaagaaaaaaaaaatcaattactgttgtggtcctagctgtaatttaatgctcttaggttgatgaatgtggaacttttatttttatccattattttcaaattggatcaatgtcctcctgatctattagatctaagacctaagaggaacctaccttgttttggctagcgggtacagactttcttactaaaaggtgggtgtatttcctagaatagcattttctgttgagtagagatgattttcagcaatgtggctggtcacttagcttcaaagtaattattgagtgtgaaagtaagcagttgtaatactttttaaccactgtctgtgttcttaccaaatggaaaacaacactcgtcttgaaactggaagttcccagtcctgggatgatctgagagttgagacttctgattagtagatattggcagttgcatcacacaccagcttgggtgctgcctaggatcaagctgtct

SEQ ID NO: 37998 - DNA, 1078 bp, Homo sapiens
ttttctagcactgagcatttaaacacattttaaactgtggatgtttaagatggactcaaaattaattcctggtaaaagaatatgtttttatttaaattgtgtattagtccgttctcatactgctgtaaagaactatctgagactgggtaattcataaagaagaggtttaattgactcacagttctgcaggcttaacaggaagcatgattgggaggccttaggaaacttacaatcatggctgaaggcaaaggggaaacaagcatgtcttaccacgctgatgcaggagagagggtgagaagggggaagttccacacatgttcaaacaatgagattctgtgagaactcactatcgcgagaacagcaagggggacgtctacccccatgagtcaaccacctcctaccaggcccctcccctgacacgtggggattacaattcgagatatgatttgggtggggacacagagccaaactacatgaatatgttgtgaactgccccattaaaaaaaaattgtcaagttactctttataattaaacaaaataagtcatcacttaaaattatacttggtattattaaggtattaatatgagtactaggtggtcattggagaaaaatcggaaaatatggatgaataaaaatttgaaaagaacattacccttcatctctctaccagagagattacagtgaagatccattttagttttaatgcttttgggtactgatatctttttttttttttttttatttttaaagacaagagtctcactctgttgcccaggctggagtacaatggcatgatctcagctccctgtaacctctgcctcctgggttcaagcaattctcgtgcctcagcctcctgagtagctgggatcataggtgcgtgccacctgcctggctaattttttgtaatttttagtagagacaggctttcactatgttggccaggctggtctcaaactcctgacatcaagtaatctcctgccttggcctcccacagtgctgggattataggcatgagccatcttgcctggatgggttctaatatcttaccttagaataattcaagatgaaaattgttt

SEQ ID NO: 37999 - DNA, 1048 bp, Homo sapiens
acttttggaaatgctattctttatgatttttgttcgccctaatcccttttattcaccaagagtttctcttgtcatcctgccaaaataaggagggaggagagaactagtatttgttaaatacctactgtttgccagatttacaccccctgtttcttttaacctttactgtaaccttgaaaggtagacttgttttccacattttagcatgggaagaagtaggaactggaggtgattaatttttgcccaaggtcacgtagatagcaaagtgatagattttatttacttacattttacttattcatttttactgtaatgcctgtgctctttctcacaccagcatggggtaagaaaaactcttctgattgttctagaggccccacctctgtaataaccacatcttagccagcagcactcgagagagcctgaggctcaggagcagcaggatctccaggctgtggctggccagcagcagattctctgcatttgggtagattgagaagaaaagggggaagccttgactgcctctgcctaaactgcctctgtaaactctcatgttccttcccttccttgttctcccagctccattcttttctagtggcatatggcttctttgttggagttttaggttgatttttatttagtaatttcacagctattgtttattggatgtctcttttaatatagcaggtcttgtacctctccagccatttaaacagctgactcttaggttatataacttgcttgaggtcacatagtattgccaggcgtggtggctcacgcctgtaatcccagcactttgggaggccgaggcgggtgggtcacttgaggtcaggagttcgagactagcctgaccaacacagtgaaaccctgtctctactaaaaatacaaaattaaccgggcgtggtggcgcgtgcctgtagtcctagccacttggaaggttgaggcaggagaatcacttgaacctgggaggttgaggttgcagtgagccgagaaagtgccgttgcactccagcctgggcaacaagatcgaaattctcaaaagaggtcac

SEQ ID NO: 38000 - DNA, 1064 bp, Homo sapiens
gtttcccaggctggaatgcagtagcatgattgtggctcataccttgacctcccaggctcaagtgatccacctcagttgactgagtagctgggactacaggcatgcaacaccatgactggctaatttttgaagttttgtagagacaaaatatagggtttttgtagagacaaaatggggtctccctatgttgcacaggatggtctctaactttttttaagagcatgagtatttcatatagccaaaggttttacccactgttcttaacctttatgaacatgatgtgacatgacagactatattctctgcatgaaacatgctttcttcatgtttatgccattttagggttttaataaatcaaaaaatctcagtttaattaaagatttaaagatttaagttactagtgacattggatgtatttttctaatgtttgtggctattcgtatttcttttgtgaagaaagagaagtgttaaaattagctgtagttctgctctgctgcttctaggtgcatgggggagtgtagcggaaggaaatcactagggtgaggaacttctgattttgtcgtgactggggcactgctgctgcccttttgtgattgaaatggccatttttgttaaaagccagctgtggaagtgtttgcctcactctgcatactgtccatggcaaatggaaattgggtcccttctctgcgtagactctggctctggatgctctctgtgagacactttaggatcagttgctgttggcttcactgacagcttcaaggactctcactcctactactagcctttgctgctttgaggtggggttctgttgggaattccttccccttctcaggtgggcttttatttcttaatatgcactgaaccctatttctcgtccagttttttcctgtattatgtttatagaaataccttgaaaaaacttatatatgtggagggcaccactggacaggtttcaagtgccaatgtagtttgtcttttactttgatattcctttgatgattttggttgcatcagtcagtaaccccaactttgacacctctgttttcctcctgagtcttgtc

SEQ ID NO: 38001 - DNA, 1617 bp, Homo sapiens
gtaatcccagctgctcgggaggctgaggcaaagagaatcgcttgaacccgggaggtggaggttgcagtgagctgagattgtgccactgcactccagcctgggcagtagagtggcactccgcctcaaaaaaacaaacaaacaaaaaaaacccaaaaaaacttaccctttgaggctcgagcagaagttagacgtaaacatggatgtattgggatagtggagcttcatagcaaagggaaccaagtgaacaacggtttgcagacagtggtgtttgttgtctatctgggagacaagtaagtaattctgtgtattgccggagtattgcttgtgtggaagggagtatgggtgatgaatttgaaaaggcaggttataactaaatcttgaactttatcccgttaggtcattggtctccaacctttttggcaccagggaccagtttcctagaagacagtttttccacagaccaggcacggggagtggggatggaactgttccaccttagacatcaggcattagctggattctcttaaagagcatgcaacgtagatccctcacatgcgcagttcacagtagggttcctgcttctgtgagaatctaatgcctgggctgatcatctgacaggaggcagagctcaggtggtaatgcgagtgttaggggacagctgtaaatacagataaagctttgcctcctgctcatctcctgctgtgaggcccagttcttaataggtcacagactgataccagtccacagcctggggttggggatccctgctttatgtcataagatgcaagctaataacctgtggataggtagagcttcacaaacatattttatgtggtccacacggattttttttttcttttttttttgagacggagtctcactctgttgcccaggctggagtgcggtggcgccatctcggctcactgcaacccttacttcctaggttcaagcgattctcctatctcagcctcctaagtagctgggactacaggcgcacaccaccatgcctggctaatttttgtatttttagcagagatggggctttgccatgttggccaggctggtcttgaactcctgacctcagatgatccatcctccttggcctcccaaagtgttgggattacaggggtgagccaccacacctggcctggtccacacggattttatttatttatttattatttgtttttgagacagagtctcactctgtcacccaggctggagtacaatggtgtgatctcactgcaacctccacctcccaggttcaagtgattcttaggcctcagccttctgagtagctgcaactacaggtgcataccaccatgcccggctaatttttgtatttttagtagagatggggtttcaccatgttggccaggctggtctcaaactcctggcctcaagtgatccacctgccttggcctcccaaagtgctggtattatagatgtgagccaccgctcctggccagattttaaaaattgggacatttcatatgaaaacactaatttgtggttttgtttgaaaattggagctcagtagtagctgtccttttgagtcagagcttgtactttcctgtacgtaactcctatgagaccaatttcactttatctaattgg

SEQ ID NO: 38002 - DNA, 1073 bp, Homo sapiens
gtgttagaattattgagatgctgtgttggtctcaagtatggcatatccttaagggatttttgaggcatatttttgtcgtatgctattttcaccttacatattcacttcagaccctaattcctaggcctcctgcgactccactgtaactaagttttgatagtgaaagcatggagacatgaagagttcattatagctacagtcaatcaatactcgacaaattttttgaatgaattactatatctgtgatacaaaattaaggtacaaaaggggctgggtgccatggctcactcctttaatcccagcactttgggaggctgaggcaggtggatcacctgaggttaggagttcaagaccagcctgaccaacatgatgaaaccccgtctctactaaaaatacgaaaattagccaagcgtggtggcatgcgcctgtaatcccagctacttgggaggctgaggtaggagaatcgcttgaacccaggaggtggggggttgcagtgagtcaagattgtgtcattgtactccagcccaggcaatagagcaagactcaaaaagtgcaaaagggagtaaccagcgaaaaaaaaaagtttctcattccttctagccacccaactacattcttgtgtaacctttctatacatacgtgtatcctgtacacattatttttgcacctttttttaagtaaaatatgactcagttatctttcatatcagttcccaaagagctgtcatattttttgaggagataatttaatttaaaagatacatgctgatttattgtacaaatatgccataatttgggtaaccagtttggactgatgcatgtgtagatgatttctagtcttttgctgttacagttaatgctataaagaagaactgtgcatatggaaggtatcttcaggacaggatcttgggcatactgactaggtgcttttataaatctgatagacattgccacattgccctccagtcacattgcagcaatttatactctcacagatcttgagtaacagtgctcttatttcctgacagtctcatggtattacatgaattttaaactgtttgctttttaaattgt

SEQ ID NO: 38003 - DNA, 1052 bp, Homo sapiens
cctgtagctgtttttcccctgcagtttcttctctcctgcctgcgtgtgatcaatgtgaattccaagtctgataatagcacccttccccccacagccctgtgccttaaaacccttcagtggctcccacattgtccctaagataagcgccgcctctttgctgtgccctggccggcctccccagccttcttttcatcctttgccggaatgctcctattttcccccacgagggggtctttgtgtgttctgcttcctcagcccccaaagcaaagaatttttgagtccatatttagaaatgctttgtatattacctgcttcagcattcatagcttactatggtaggagctgttcattttcccattcgcagaagaggaaacaaaggctgagagaggtaacattgctgagttcacattcagggagggggtcgaggcctcaagcttgtgttctctccgggacaccctatgacctgtctgtcccattacagcacgattaggaagagaacgcaggactggtgagggcggggcacacaggccctcatccacgcagagggacagcagattggcctggaggaggcagttgcatggagagctttgaagatgtacacatcctttggcttggattttctgcttctagaaatcctgagggaatctgaaaatcctgaaggagttatcacagaggttcacaaatacttagctaccagaatatgaagtagcgctatttaaaatagataaaacctagagacaccctgttgtttattggataaataacatccatagcatgaaatattttcagccattcaaacacatgtgatagaagatcacattatttatttatctgagacggagtttcaaaactgggagtttcatcccagttttttttttttcttttttgagatggagtctcactctgttgcccaggctggagtgcggtggcacgatctcagctcactgcaacctctgcctcctgggttcaagcaattctcctgcctcagcctcccaagtagctgggactacaggtgcctgccatcacgcctagctaatttttgtatttttaat

SEQ ID NO: 38004 - DNA, 1035 bp, Homo sapiens
cggtgaaagaatcaccatcttctcgcttttgccacgagtggaccttgcatcacagtgctttgcgtttgtcatttaatcctcaggaaaacctgcgcaatggttctgtgctatcacccccgtgtcacagatggggaaactgaggctcagaggctttgtaactgccctgcccgtctcctgccttatctgcttccacccccggccccctccttccggccaggctgtgtcctgtccccgctggtccctccagcctgctgtttcctgcctcccagtctgtttgcagttttctctgcctggaaatacctcccccagatcctgagtttgtgtctaaagtagctccccaccctgcaccccagcactgtgttcttctccctgccttctcagccctgggcccttctcgctgccaggcattccgggggttttgccaggtgcctgtcgccaccacgggaataacatgtggcatgtcaggcaggacttggttgctttcatctctgtgcctagaacagtgtcgggcacataatagatgtgcagttagtgtatgctgaataaaactgtccttcctccaaagcccccagccctccctccatgaccgtcccctcgaggtcacaccccctactgtgcactcttgagtagccccggtcctgtcttcccaacactttccatgttaggagtagatgtttgtttatttgcttactctctgctcccccaactaaactgtggattccccgagggtcctcattgtattctctgatcccggctagtgtctcgctcctgatggagcctggtgagcacctgaatgaatgggtgagtggacagtgaagcagaagagcagaggctggaaccaagttctcccgtattcaggcccagcctcttggcattgtgctgcctccttgtttcacgttgcaagtctgaaaggagctcctggatacagctcatttcaagaccaggcactggtgcccggggtggcctgaagttgtcataatgctgcagcttcttgggatgaatcgtccaaaggcagccatcatctagcaggggaca

SEQ ID NO: 38005 - DNA, 1061 bp, Homo sapiens
gttgtgtaagggacagtttcactgaaagatgcaggaactgcctgggtttggtcacttctcatactgactcttaagaatagctgatgacaggccaggcgcgggggctcacgcctgtaatcccagcactttgggaggctgaggcaggcagatcgcgaggtcaggagatcgagaccatcctggctaacacggtgaaaccctgcctctaccaaaaaatacaaaaaattagccggatgtggtggcgggcgcctgtagtcccagctactcgggaggctgaggcaggagaatggcgtgaacctgggaggcggagcttgcagtgagccaagatcgcgccactgcactccagcctgggcaacagagtgagactctgtcaaaaaaaaaaaaaaaaaaaaacagctgatggcatgtccataacttttagttctcaaaaataaataaatacataaagaaattgtagttctgggaagacatttctttgttttgttttgttttccctaggaatcagactgagaggaaggcatatttttgtaggaatcctaagtgacgtgatctaagcatgaaacttactggtgatttcatttggtagagatttaacaaacacatattaactgtgtggcttttgtgctgttctttcatgtaaggaatctcatttaactttctcaatgaagttggaggcaagagatgattaggccattttacagatggggaaatggaggctcagggagattgacttatccagggtcatgtagtcaattaagtggcacaccaggactcgaccccaggtttacaatcttttcctctgtgttggcaccttgttggagaagcgggaagtgtctgaccttgttacatatccacggtgtattaggactgggtttttcggttttttttttttttggagacagagtcttgctctgtcacccagactggaatgctgtggtgtgatctccgctcactgcagcctccgcctcctgggttcaagtgattctcctgcctccgcctcccaagtagctgggattacaggtgcccgccaccacacctggctactttttgtatttttagtggag

SEQ ID NO: 38006 - DNA, 1067 bp, Homo sapiens
tcccaaggggtaagttgaaggagattacatgaaagtgttctctctgctcttagaatatcagcatgtggtcatttggggtcaccttctggttttatagttgataaagggagcagagacattcttgcttcctaaagtgtctcacttagaagcgggggagggggaacctacagtggtcctgtaatacagagtttcattatcatagcttgtacgttttctgatagtcacccatttctgtcttgggcagttacctggataataattttaacttgatggtgattcaagagcttttaaggctttgatcattgttgtattgctaaacattaacacatagggcctattcaacaaaccctggctttcactgctctgggtttgtgatggctgcatcatgtcacagagatgctcttcctaaatgaatcggagtagttcatattctctttaaattctcataattttgaagttaaaagttgagatgtgccacaacatataacaagtaggacatagtgaaaaggaactttagaaacaataaaatgatacccagtacttctggaatggacatcgagtgagacacttaacctgtaacaagagctctgagaatgggaagaattgcttatctgttattgaatgaaatgacatgtaatagtcttggaagcaaggagactatctttctgcattgtatcagttgtagggtaggaataggttattgtgggtgtttgtatttttgttttttatattttaatactaaatttgctgactaaaacctatgatatacctgcataaggcaagcacgtaagtgaaaaaataactttttttctataacaagcaatccttaagcattttaagaagggaataatcaataggaacagaacttatacttcagtggtaaagataggtttttcagctggggacaaggatggatactaacagtcttatctataggaagtttcataattgctcgaagagggaggaaagaagttttcagataaaacattaagagagagtaaggaaaattaagatgtattaatagaataaaattcagtttccaccaagaaatacttctgatttaatag

SEQ ID NO: 38007 - DNA, 1086 bp, Homo sapiens
aatacaaaaaattagccggggtggtgggcgcctgtagtcccagctactcgggaggctgaggcaggagaatggcgtgaacccagggggcggagcttgcagtgagccaagatcgtgccactgcactccaccagcctgggtgacagagcaagactccgtctcaaaaaaaagtttactactcggctttaattatttcgtttcggttttgggtgaaattattttattactgactggttccttagttgtacagaagcctattatctttagagagactcttcatggtaattaactcagattcttatttgcctggtgaaaggaggcagtgatctaatttgcttgttaagagcttcctacttattttgtgtttgtgtattttattctgtcatccttagcaaacctattggtgacttgacttgctttggaggtgaacagagtattaattgcatgtatagcctattcagcccagtggacttaggttgcccttgggctgatctgtgcttatgttgaatgaagcagaaattcaggcttcatgtgcagcctatactgagtactgtatgaataggaagtaatgacaacaacttttaagaattctctgaattttttttgttttgttttcatttgtttgtgtttttttttgagatggggtccccctctgtctcccaggctggagtgcagtggcacaaccacagctcactgcagccttgacctcctgggctcaagccatcttctcacctcagccttctgagtggctgggactataggcgcatgccactatgcctggttaatttttttattttttgtagaaatgggagtctcaccatgttgcccagtttggtctcttaactcctgggctcaggtgatcctcttgtcttggcctcccaaagtggattacaggcatgagccacggtgtgtgcctagccccttgggttgttttgtttttttttttttttaattttttaatttttttttttgagacggaatctcgctctgttgcccaggctggagtgcagtggcactatctcggctcactgcaacctctgcttcctgggttcaagtgattctcctgtctcagcctcccaggtagctggg

SEQ ID NO: 38008 - DNA, 1050 bp, Homo sapiens
acctggctgatctctaaattttttttgtatagatggtgtcttgttttgttgcccaggctgatcttgaaatcctggcttcaagtgatctgccctgcctgggcctcccaaagtgttgggatcacaggcatgagctactgcagccggccaacttttggctgcttaatgtactgtaagtgaagttgtttgtttatgatgtgaaccttacctcttagcccatttgaagctggaaatgcaacttagcactattaggcctactctccctatctctcacctgacattacttttctcattcctctcttgggcataaaatattacatctcttcacctccaattggaacagacttatgtttaaccgtaggaaattcagacaggaagtacttcatggaaaaggggccggtggatgagatgtgtttgacagtttggctgtggcttgtgaagtaggaaccagaatagatggcatgccaagaaggacctggtaggtaaagtctggtgcctgctctgctgtgtttttaaaaatctgactgttgcttatgaagaatggattagattcagatgaaaccagtgggataccgatgcagtctttacatccagtgactcacacacagcttcttcccatcttagggctttcgtgctgtttcctttgcttggaatctaaacaatgtgtggtgctggccaggtgcggtggctcacacctgtaatcccagcactttcggaggccgaggcgagtggatcagctgaggtcaggagttcaagaccagcctggctaacacggtgaaacctcatctctactaaaacaaaaattagccgggtgtggtggcacacacctgtaatcccagctactcgggaggctgaggcaggagaattgcttgaacccgggaggcagaggttgcaatgagctgagatcatgccactgcactccagcctgggtgacagagcaagactctgtctcaaaaaagaaaaacaaaaaaaaaaacaatgggtggtgttttttattacagttcttaaaactagcatgcccctcccacttgctttaaaaaagttgcttttaga

SEQ ID NO: 38009 - DNA, 1015 bp, Homo sapiens
ataggaccatatagtataatgaaaagatctgggagtcagaagaacccttgagtgttccactcatcttccgtttctttatgaccttaaataagtcagttgacttcccagctttcgtttttaagtatgttagatgaaatcagtagattcagacattaacatggaatcttctttttttttaaatctgacattgaacactaacatagcctcagcatttgatttctttatattttattttgatggtgtggaatcagtaaagtcctggtacacaaatttttaaacatgatttagagtctcataaagttctgtaggagattttaagtttgaatcaccaacatcatcagctgtactcagaagttaaacacgtcatgtcaagcagtgttatgacttaagttatattttctccgagtattgtttatttacttcgtgttgatgagagcgtatactgagcagatgcatctgagcttgctgtgacatttagtggaacctagacatccatgtactgtgttaatgtgctcacttgtacagttttacgggactggatgtatacatgcctgtattaacaaaagacaccatgcagacctgtggttttcccagtcagtaacacatttgcaggaagtttcctaaatttcatatatgcgtaaagatggcaagaaaagcttcattccaatgcctttacaatcattttgacctggtggcgtaagctaacatgtctcatgatggtcttcatattagaaacttaacatttgtggaactttttattatagttcttaaaaatagcaaaaataggttttacagagtaatctcagttgtgtttatggatctctgaagcaggtgtttcttttgttctcttgggttctttggaaccagtttttaaaatcatacggtaagattctaggaaaaaactttttttttttttttttttttaaagagaggctctctgttacctagtggagtgcagtggtgtgatcagagttcactgcagtctcaaactcctgggcggtcaagcaatcccctg

SEQ ID NO: 38010 - DNA, 1039 bp, Homo sapiens
tttgcaccaacctttaataacttgctcatcatcacatagcttataactggcagtcagagcttaaacccagggctgctataaagaatgctagttttctgtttttccgtagtttactttttttaaattgtgacaaaattggccaggcccagtggcttacgcctgcattcgcaccacattgggaggccaagacaggtagagcacttgaggtcaggagttcaagaccagcctggccaacatggagaaaccccatctctactgaaaatacaaaaattagccgggtgtggtggtggcgagtgcctgtaatcccagctattcaggaggctgaggcaggagaatcgcttgaacatgggaggcagaggttgcagtgagccaggatcacgccattgcactccagcctgggtgacagagtgagactcggtctcaaaataaataaataaaaataaaattgtggcaaaacatataacaattaccgtctcaaccatttttaaatgtgtaattcagtggcattgattatattcacaacgttgtgtggtcctatatgtagaatcataaaatatttgcccttttgtttgtggtttatttacttaccataaagtctcccgtgttcatcctgttgtagcatgtatttgtactctatcctttttatggctaaataatattccattgtatgtatataccgcttttttttttttttcccctgaggcagagtctcactctgcctaggctggaatgcaatggtgtgatctcagctcgctgcaacctctacctcccaggttcaagcgattctcctgtctcagccctccgagtagctgggattataggtacgcaccaccacgcctggctaattttttgtatttttagtagagacggggtttcaccatgttggccaggctggtctccaactcctgcccatgtatataccacttttttttttatccattcatctgttggacatttgggctgcttccagattttggtgtgaatgatgcagctctgaactttggtgtacaagtgtctgttttcaatctctgtttccagt

SEQ ID NO: 38011 - DNA, 1036 bp, Homo sapiens
gcctgggcctcctaaagtactaggattacaggcatgagccacggcgcccggcctgctatcaaactctttaacctctgttttcccaatctgtaatacggcccagtaatattctcttgtgactcagctgctccctattctgtccctcaagcatgagcgcccctccggagtggctctggagcgctccggaggggcgctcgtgcttgagcgcccacaaaagtgggctgcctcaccaaagtgacaccctgggcgcgcatcagacaacgctttactctaggccatcagagctttggagcagtggcctctgttctaagcccatctagccctgctccactaacctggggcaagctgcttcccctttcggggcctcgtaccctcatgtgtaagaagaacctgcggtgaacctcatctattctcctctcccacccatctgccagtgctaagtcccttccatacccaaacttgggagggtcctggaatccccagggttcctgaaggctggttcagggagacaaagtgggaaggaaatagacactttctgggaagaggcagtgagggatcctggaccttcagaaggtcggttggtgttatggagatgtgactggttcttgcagggatgggttcccctacaagggccggggggggactgcatacttctgacccctgggccctccttccctcccagcctgcacagccctctgcagtggagcacactgcaaagatgggatttaaaagtttcaccaagattgacaccaatcattcactcatccaataaacatattttaagtacccatggtttgtaaaacactcagtagatgtgaaaatcataccaccaaaggaaattttgagattctgttccaaatacctgggacaaaactgataggtccaactagttagtgtctgtatgactttgagtggattatttctcctctcaaaccctcagttttgacatctctaaaaagggagttggaccctcgtgtggggtggggcggaggagtggcgagcaccccccccccgctctgctggcctctgcgcgcaa

SEQ ID NO: 38012 - DNA, 1030 bp, Homo sapiens
gccaggaggaggagacacgcgcccttgggccgagggctgggctgcggcggggggttcagaatgtaagatgcctggtgttgtcgccaggctcccgcgccccgcgtccaatcggaggttcagaggaaatgccggattgaaaggatcagaagcaagagaccaaaaaacgtttccccccggcctaacaaagccccgggcggcttcggctctgctcctgggtctggtaggaagttgagaaatcggtttatggtagacagaacagagagacaagcagataatctctgtttttaaatctcctttggatttacgaatctttttaaagatctgatgagaaccgctaaacagaaattgaaatgttgctcaccagacagcttttgcgtacaatcggaggagggtcctggaccttctttctgcagcccacccacgacccgggtttctggtgcctttctttctttgcgccaggaaagtggagtctgggatcgagggccttgattttaaaatgggatactgcggaccctcaggaatctgacttcactttattttttcagcacaacttgccggcgcggccagggcggagaggttccctcgtggaaaagttaggaaatgctgcgctaccgcgggcacaagggagtggacgagatgagtgcgggatcatcccgcaggccatcccaggatcggggagggaggccggccccgctgcagaaaggggccttctgggagaccccccagcccaaggcaggagcccgggcgattcccgggaggccgcaggcgctgggcgaagcgctgggcgaagggccgctgccagccgggagagaattcataggtttgttgaggagcagaggcctgggaacaaattcgggcgggcacggcggctagaactgatcgctaccaattcgaggaagccagcaaggcaggttccgaggccgcctgcccacccgcagcttcttggacactgcgcaaaccctgctgcggccaggctggagcctccgatcaccaaaccaacactccctggccttctgtttcttgattcctt

SEQ ID NO: 38013 - DNA, 1074 bp, Homo sapiens
tctctctctctctctctctctctctctttgctttcaatctttagaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctga

SEQ ID NO: 38014 - DNA, 1032 bp, Homo sapiens
aactgtacaatatttgttttttccatcttgtacattgggctcctgacaagattttatgttttcctcaaaagtttaagaatctccaggaaagtgagctgcactcccttggtagtttgtttcccctgatcaggggttttggtcagttggggatgctttaacaaggcgccgtagactaggtggcttgtaaacaatggaaatttacttctcaccattctggaggctagaagtccaagaccaagatgccagcatggtcaggttcaggggaaggccttcttgcaggcagcagactgccaactgcttgttcttctcatgtggtggaaagagagctcgctaacttcctggggtcccttttgtaagggcataaattgcattcgcggaggctctgcccccatgacccgatcgcctcccaaaggccctacctccaaaggccatcacattaaggattagatttcaacataggaagtctgggggacacaggcatttagttgataatatcaagcttttacatctggtaaaggaccctgtgaatccgactcaggaagtggtttggtaaagttggaaaggtattggcttgtgactgaggagaggtggctttcctttgttagcatcccatagccggatgctaactttgctgtatttaacgatgctcatcactaagggccgatactgtctaatgcctggtctacctgaaaatgtgcccttcagtgctctagtggtggtgtatttacatctaggcttcctgtcgataagctgttagttaccattgaatccagggagcactttacacactaatcatctttcccagttcacagcctgtttcttatcttctttgtcatgatgtacatttactcatgtctttcctttgctgtaccctgacagaccatttgcccacttgctgcccagcctatttttacccgaaggcttaaatggcctctgaagtctcaagtctacgggaaaataagtaaaacctgcccacatgcttgtgatggtattggaatatttcagtcctttgagaagaacacttcactttga

SEQ ID NO: 38015 - DNA, 1001 bp, Homo sapiens
atacatgaagagaggttagcccagtgccgggaatattttaagtttttaataaatgttctgtggtatttttattatcggcaagcaggctcagatccacagactgattttattcttacatgaaccttaagaggttgaaattaggactttcccccagttatgattcttagaagaatcttaattgagattcaggcagatgaagtgacttgcctgagggcaaacttcttagaagtggcaggtttgggtcttgaactttgattttgatgccacgtctcacaggttttctgttccactgtgacctcatgccctggagaggaacacaaatgtggggggcagacagcatgcaaatggaggcagcctgtagtccttacctggaaacttcacgggaaacctcacccagcctggacaaggacgggattgacagattgacagctctttctcgattctgtgggtggtggtgcatggccattcttagttggtggagtgatttgtctggttaattctgataaggaaccagaccctgacatggtgactggttacacgatccctgagcagtcggcatcccccaacttcttagaaggacaagtggtgttcagtgacccaagattgggcaataacaggtctgtgacgctcatagatatctggggctgcacgtgcactacaccaactggctcagtgtgtgcctcccctacaccagcaggcgctggtaaactcttgaaccctattcgtgatggggattggggattgcaattattccccatgaccgaggaattcctagtaagtgcaggtcataagcttgcattgattaaatccctgtttgccttgataagtccggctcaaactggacttgaggtctgactttggtgagactcactctgacatcccaggtaggagactataccttctagtctctttccagaaacagggcatcaaaagtcttactttactcctgaaggtttgcagtaaaaattaaatattcagctatgataagtggctatagagat

SEQ ID NO: 38016 - DNA, 1071 bp, Homo sapiens
gagagtccatctcaaaacaaataaataaataaaagaattactgaagtcagaatctcaacatcgtaagggactcggattcctcctgttcttccactctcatcctcagcacacttccattctcaaagtcacctcaatatctcatataattgccgaagcttccgtcatcatgtttgtattccaggcgtcaggaaggaggaaggaaagaaggacatacttcctcctttgaagaagaagacttccaggtagtcccatgtaacacttctaccggccagaacttggtggcatggctatacctaactgtcaaagaggctggggaatgagactccactgaaaccccagactgtggtttgaatccagccagcctgcagatatattgtgattggccttgacaattttgaatttttaaaaacattagacacttaaatgttatgagactacataaaaataagtgtagatttctggctgctctggaaaactcagacctgacaaccccacattccacatggcagtttttggctgaaactcagtagttgtccctttaggtggggccttgctctccatcctctccactccctcaggttgtctgcaggaaccctgtggatgtctagtccattaccctcactccagccccttttttaaaaaaattctttcattattattattattattattattattattattattattattatttttagacagagtctcactctgcctcccaggctggagcatagtgatgtaatcacggctcacagcagcctggaactcctgggctcggtgatcctcttgacatagccccaggagcggctgggattacaggcatgcatcaccatgcctggctcagcctttttaagggagtctctgatgtgcccagatcacctgctttcagaagagctgacctcaggttgctaacccctcctggctccatcagtgctggccactggtgaggcggtgagggggatcacagagcagctctccatattgggctatctattacaggttatcattaatctgcattggcaccttcaggactctaggaagacagagtcagccaccagaagccttgag

SEQ ID NO: 38017 - DNA, 1050 bp, Homo sapiens
ccttgttttctgccacaaaccaacattacccaatatgcccaaatgaccacacttcagccctctgcccatgaaaggaattcttttctcacggccttctccccacacttcagccctctgcccatgaaaggaattcttttctcacggccttctcctggttttctggaagtaagcacagagggtttgcctggcccaggatctgctttgaaagagactgaggggcagtgcgaatggcagggatgtcccttcaaggcagggctcacttcatcctgcgctaacaggcagcgtgagcaggttgctgagcaggccggggagactcccagcaagggctttgcaaacactctgggttcgcttttgcacccaatgaggtgaaatgaaccccgtgggacttacttgagatcaacagttgtcagtcacaggccttaaccccttttacattttttccatgacaaagggaaagtgtgggtctgggagctttaggcccataaagggaattttgataagggagctcctgggacacatatccctgaacactcatgagctatagcctcggacctgaccgggaggctgcgagacggagggggttggctttgactctagcaggatccctggatttgctggtgaatgaataagcgactggcaagaagtagcatttactaagtgctcgtgttctggggcctgagctgggtgttttgcatctttttttctgtttaactgtctcaatggcacgataaagcgagaacaagtgtgtgcgtttaacagaccatgaacgtgaggctccacgcaggtaagagctgccccaggtcacacagtagcaacgctcaaatctgaacccagggctatccaacttcaaagcatgattctctcccactgtgacatgctgcttcctgtggggcagactaaatggattaggcgaaacggcacagacggataatacgagggatacggagatgatctgggcagggctgctggtctccagcaacttaagggtgataaaatgtttgggttaattgctgcagtgtaaaaacaaaactgcatgtgtgcataacgtga

SEQ ID NO: 38018 - DNA, 1032 bp, Homo sapiens
cctagcacttcgggaggccaaggcaggccgatcacttgagctcaggagtttgagaccagactgggcaacatggcaaaacctgggcaacatggtgaaaccttgtctttacaaaaaaaatacaaaaattagccgggcctggtggcatgcacctatagtcccagctacttgggaggctgaagcaggaggatcgcttgaacctgggaggctgaggctgcagtgagctgagattgtgccactgcactccagcctgggggacaaagtgagaccctgtctcaaaaaaaaaaaaaagtctactctgggcacactacctgtaggggtaggtagtcctgctccataagaagcagttaaaaaacaaacacacaaacaaacaaaagattgggcataagttgataactatttacatctgtgtgaggggttcagggagccttactatgtatatgtttaaaatgtgccataattttttaaaaaaaggtatttcattgtatgaatagacttcaatttatttatgcatttatctgttgaaggacatctggattgtttcgagttttttaccattacaagaaatgctgcttaggacttcactggacctgtcccccggtgtataggtatttgagtgctagttgaattctctatccttttccactggtctatttgtctattcttgcagcattaccaccaaggacttaattgctatatcttattttttcctgtttggaaaagacttggctattcctgagcctattctcaaccatacagattttagaatcagcttgtccatttctatgagaacactgtttggattaatgggaattgttctgaacatacagattaatttggcaaggagaaacatctttataatattgagtcttttcctccaggatctatgagtcatttgaattaatgttagggtataacaagggtattgcacataagatcagtatacaaaattcagttgcacatatggagtccaattctctatgtatcagaaagaggtagcaagaaaatgcaatttataaaaggataccacactta

SEQ ID NO: 38019 - DNA, 1034 bp, Homo sapiens
aagtaatatcaccattttattgttgctaaagtaaattcacaatttttatgtaaagaattgcatttgtaaaggaaactaaaatactgtcatagacagaaaactagtgatgcttgccagaaatagaaggtacattataaaaatatatacaataaaacaagcactcattctgttctagagggataccattacccgatgagctcaaggtctgctctgtttgttctcaaggagtgaggagagcattaaagacttgccaggaccaagctgaggcttcccctttgataaaatgagaaggaactaatgagagtgggaaagagccctgctttctatgcttttcaatgtcatttggggcttctcacctgaactcattccatgtagcattctttgagaaacgttaactgcaccctgaacagttagctactgcggcattacacacacaccactgactcgggagcatacaacaataacccctcattcctagagagctgcaggtcagctgatgctctgctgatccaggctggaattgattgggtgactcttctgtctagggtagaacagggttggcaaactttttctgtaaaaggtcagaaagtaaacattaggcattgtagaccacacagtctctgtcacaatgactcaaccctgctgttgtagtgtgaaagctgacacagacagaccagacataaatgaataatcatggctgaattttgataaaactttatttatgaacccttaaatttgaataaaacataatttttgcatgtcatgaaatagtattcttccttagattttcttccaaccatttaaaaatgtaaaaaccattctttgctttagggccacacaaaagcaggcagtagacaaaactgcacttgaagaccatagtttgctgacccttggtctaaaataaaagctgtcatttcctctaccagggctggctttatgggtgtgggacgtgtgtagtcgctcagagtcttgcacaaagaaggacccacacttggttgaatgctgtgcagtagctctcttgaaatttttaataa

SEQ ID NO: 38020 - DNA, 1047 bp, Homo sapiens
tttaatttcagttattgtttgtgtttgtttgtgtgtttttaagagacagagcctcgctctgtctcccaggctggagtgcagcggcgcgatctcggctcactgcaagctccgcctcccagattcataccattctcctgcctcagcctcccgagtagctgggacgacgggcgcctgccaccacgcccggctaatttttgtatttttagcagagacagggtttcaccgtgttagccagaatggtctcaatctcctgaccttgtgaaccacccgcctcggcctcccaaagtgctgggattataggcgtgagccaccgcgcccggcccagttactgtattttttaattctaaaacttccatcggattcttctttatatttttctatctctttgctgaggctttctatttctttactcaactttctatttttcatttgcttcaaacatgattatgactgcttgttgaagcatttttatgacagttgctttaaaattctttcagataattctaacaactgtgtggtgttagtgttgacaactgttgaccctcttttctcattcggtttcagatcttcctggttcatgttataacaagcaatttgattgaaagtggacattttgggtattatgttgcaagactctgcatcttatttactttatttattgatttatttattatttatttatttatttttgagacagagtctcaatctgttgcccaggctggagtgcggtggcacaatcttggctcactgcaacctctgcttcctgggttcaggtgattctcctgcctcagcctcccatgcccagctaatttttgtatttttagtagagacggggtttcaccacgttggccaggctggtctcaaactcctgacctcaagtgatctgcacacattggcctccaaagtgccgggattacaggcttgggccaccacacccagcctctgcttcttatttaaaccttctgttttagtaggcttcttcttgtaactgctctggtaaaggaagaagggtgctgccatgttagtgctagatggggtgaaaatcat

SEQ ID NO: 38021 - DNA, 1055 bp, Homo sapiens
tccaaagaagtaatggatgaaaaggaactgttcaaaagtgtgcatgaaaacttatgttcataaaaaaaccggaacacagatgtttatagcagctttattcatgattttgcaaaaacttggaagcagccaagatgtccttcagtaggtgaatggataaataaactgtggaacatccagacaatgaacattattcagtgccgaaaggaaatgagatgtcaagccatgaatagacatgaaggaaacttaagtgcatgctaagtgaaagaagccagtctgaaaaggctatatattgtgtaattccaactatatgacattctggaaaaggcaaaactatggagacagtaaaaagatcagtggttgccaggggttggggtagagaggaatgaatcagtggaacacaggggatttttagggcagtgaaactactctgtatgatactacaatggtgtatacttgtcatcatacatttgtctaaatccacagaatgtgcaacactgagtaaacccaaatgtaaactataggctttgggtgataatgatgtgtcaatgtaggctcatcaaatgcaacaaatataccctctggtggggaatattgataagttggtaggcaatgcttgtgtgggtgcagagggtatgtgggatatctctgcatctccactcaattttgctgtgaacctaaaactgctctaaaaattaaagtatatatatgtatattttaaagagttgtgcaaacatgcattattatgaccattttgaggtcagttaaatattttaatgtgttctctatccaggaaacatgtggagcttgcagtttggggtcaatttctagccttctaacactcatttcccctttcctaagagtatcttgcatttctcatccatgtaggttagctattattgactccattcccagagggtacacccaattagcttaaaccaaccagtatctctcatcctcctgaccacagagattacatatggattaaccaatgacatatcatccaaatcagccaaccaagacaataagactcaactctgacacttttattgagtcac

SEQ ID NO: 38022 - DNA, 1045 bp, Homo sapiens
accaactgtcatacattgccatcttcttgagaacaaagaagggtatttcttgccccccttccttttccaccttccagcctctttgagctagagaagaaaatgggatcttaagtttatgagttcaaagatctcggttctggtctctgcaccatggaactttgggccattttctccccattttttaccccctcttcctcatttgtaaaatgtggctattgggcttgatgatttccaaatcaatgatttccataatgctaagctttctagccttaggaactcacgattcagattactttgaaagagaagctcttgctttttctctgtagagtttgatttgtctttagtaattggtctaaagcccactgtaggtagtggacatgaacaattctggcatggtaaaacctgttgagtgttgatgcatcccttgtttatttctgaaacagtttcttttaatgcatgtggctcatcactatagtgtggcttctcaaaacattctgcaaaggacagaaatgttcagaatgaattgaggtagaaaggtcatgatttgagttagtgacttccaaggctgtccagtatctgcatggcagaagttgtactgatgttaaaatccctctgtatgaaatgatgtgatgtcttgggtttgcttccaaataagtcagtgtgagtgtgtgcgcatgtgatgagagtggatgtgggtgtgtgtgatgagagtgggtgtgggtataaatgaaacaaaattggccaactgttgaagctgaatgatgggtatgtggggggttattatactattctttctatttttctaaatatgtttgaaggattccatccataaaaggctctttggagaccggctccagcctttctctccactctcatctttcagtccacatcctgaggaccctctggcacagtgacattgccttggtggctgggacttcacatctcttggccttgacacacagctctgtctgcctggggtcattttcctggtctttccttacagttcgtgactcctgcttctgagatcccacagcccagttgcctt

SEQ ID NO: 38023 - DNA, 1027 bp, Homo sapiens
ccatgtgtcttcccagtgaactcgaggaggaaggcacaatcaggaagcggggccgtttgctaaaggagctgagagctgggatcatcagggaagagtgtggggtttgcagtcaggcttcaccctgatctctgtaaccttgagcaggtcatgcctactcccctggtttccttttctttaggaggagataataatagcatctttgctgtatgattagagcactggttcactcacagggacatgtaaaatgtctagtacacagtaggtgctcagtaagtgtcaatagtgggagtcattgaggaaatgattaccacctgctgttttcggttgaaatgtggccttatggcccccatcctgctggcacccacagctctgggcagcctgctgtgccactgctttgctgtctcctcctctgggctcccaccataccagcagtgtgtcctccttcatggccctccatgctggacagtcattatctgcttagatctctgtcttcgctgcaattcttagcccctggaagggagggcctatgggaggaatgcttgtggctgattgaatggtgtctgtctgtctgctgcattgagcagcgagtgctaggagagtggggtccaagaaaaggtaatcaacatctattcagttcttattggatgtttacactttatctcatttcttactaaaaccttacaaggtgagtatcataccctcattttgccgagaaatttgaggcttatagaaaagaagacttgtccaaggtcactcccacccaggcaggaggagagctgggattcccattcagtctctgcttctaaccactgtgccaatctgatctaaggcaaagaagggagacatggccctcctacacatctgagagccacttgagaggatgcctctgtgtgagaggcactcatgtgtccctgctggtaagggaccttgatcctctgagcctgcagtgtggaagagacttggggggtccctggaatctaggtctcagacatagggttcttgctagcagcaggagtgcatgttttag

SEQ ID NO: 38024 - DNA, 1053 bp, Homo sapiens
taatacattgtgaaaaaacttcatttctaagaacaggaaatgaacaatttaataatcaagtgatttcagaaactcttgggttcctactctgtgtttacatagagctcaaggaattaccaggtggcagtgggagatgcagggctctaatttgagatgttccaaattggtaggcagggcacccgggctttagttgcagcctcatccctaacttgctgggtgattctgacacgtctctctcctggatcagatgatcttccaggccctttctcccatgcctctgttgaagcagtctgcagcatttgaactgctgacaaccccactgtaccctcaaacctccttctctcttggttctgtgactcagttctttcctatccctgcttccccttactgtttcctctcctctcctcttttcttctcttcctttgccttttctgactcctcttcttcctcctgtctcttccccataactctgacctcagcccctgcctctttttactttctaatctttccctgggagaactcatccattctaggggttttaatgaccactgacactgatgacacctagacctctatattcactcatccagcaagtattaattgagcacctactatatgccagtcaatgtgttaggcactggggatttataggaaacaggacagacaaagccttgccttcatgcagattacattctgaggtatgtatgtgtgtatgtgagtgtgggggtatatgcacacatgcgtaggaaaataagcaataaataagtaaaaaaacacatttaccttctcctggataccctttcctggatgtctgtgggcacccctcaaacttaacatgccatttctgtatcaccaaactatcaccttctccggccacctctgcttgccagcatgcattcatcagacattgtttaccactgccacccctccaccagtttgcaaagtacctctactcaccactgagtcttctcaatgcttacatccctgtggctctaagtagctcttcttcagcctgctgggattctttatctgaaattcccgagtctgcccaaa

SEQ ID NO: 38025 - DNA, 1038 bp, Homo sapiens
aggttacatcagtagtcagctagtgtgtgctagaactggatgcaccttgaattatggctaattcgtactccctttttttttgtttttcgagacagagttttgctcttgttgcccaggctgcagtgcaatggtgtgatcttggctcaccgcaacctctgcctccgaggttaagcgattctcctgcctcagcctcccaagtagctgggattagaggcatgtgccaccacacctggctaattttgtattttttgtagtttagggtttctccatgttggtcaggctggtctccaactcccgacctcaggtgattagcccgacctctggctaattcgtactcttaaagtttcaactgaaatatcactttgccttcagggaagctcccccgctaccccaaggttagaggtaggttagaggcgtattttatatactttctgtaggaagcacttttctttctatattgtaattgcatgtttatttgcctgtgtctcctgttagactgtgaattccttgatggtagggatggtgtttgccttgtttagtgttgagtccctaatgtctagtcctgtacctgctccacgtagtaggatcttagtaaatatttgttctgtaaatgaatgaaactgtggagctgaaattcaggtctgttcaattctagccttccactatcccaggtgaacaatgcaagaccaagtgagataggttctgtgagtgggaggccaggagtttgctgtgaaattccacggaaagaacagacatactatatggggggttgaaggagggagcttgtgagcttgatcttgaaagatgagcagaattttaagaataagcaaaagggaaccacataactgacaaagcaggtgtgagtgagcatgacttacttggagagtggttaggtcagggttgttgggggagtggtggcagataagggaaataagagagggcatgataatgggaagatgaagtctaatttgggaccagattataaaaggcctttattttatgcttagtatcttgggttttattttgtaggcaatgggg

SEQ ID NO: 38026 - DNA, 1049 bp, Homo sapiens
cacccagagataccgcctgcagcagccactgcccccgccgcccccacccccacccccaccaccctactaccccagcttcctgccctacttcctgtaagtatccgcacatccgccccaggtccctgatgccctgttctcctggaacctccagtggttagacctaaacacagctccaggggccccagggcctctgaagccacctggcgttccccccttaacctgacaggcacgccagctgggctcccttccccgctgcaacgttctgggctctgtttgcaaggagggagtcaggagagcggctctgtgtgccccactcctgaccttgaccctgggcccccacacttgtctctctctagctcgatgctgccaatgtcaccaacagcaatggggcccaccatcagcctggacctggacgtggatgatgtggagatggagaactatgaggtcccatggagccccatgctgggaggtggggtttgggagacctgcagccctgggcgccgctgaccccgtctcctgcccgcatgcaggccctcctgaacctggccgagcggctgggagatgccaagccccggggtctcaccaaagcagacatagagcagctcccgtcgtaccgctttaacccggacagccatcagtcggagcagacgctgtgagtaccctgccccacctcccacccctctgaacacagctggctgccgtgggacgcccctctcaggggagtcacactccactgagccttcccatggccctcagcgtggaggtgacgctccgcgcccctccacaggtgtgtggtctgcttcagtgacttcgaggcgcggcagctgctccgagtcctcccctgcaaccatgagttccacaccaagtgtgttgacaagtggttgaaggtaacactgcccaggtctgctcctgggtattcctcatgcagtgacggggggatgggctggcctgggctgtttccctccttgtccttgtcatcatctcggaagttctggctccagcggaccaagtccccccaggtggctgcacagatgtggtgggttggggct

SEQ ID NO: 38027 - DNA, 1047 bp, Homo sapiens
gatttacagaaaagtataccatgaaaagtatgcctccttcctcttccagtcttcaagtattcctgtcatcctccgcagaggcaaacactattactagttgcttgtgtgtgatcttgttttattacgcatatctctttacaccttgggttgtagttatttgagtgtgtatgctgtctccattagtaaactgcactctccttaagagcaaggacagtgcctcataatttcctatatctccccaaattacttgcacattgaagattgtcaataagtgtttgcttaattatttaaaggaaagttggaccagagagaagacaggcttctctggtaacatgtcacagttttgtccttggccatatcctttacaaccatttttccctagtgacttggataaagatgtagaaagtatggttgtcatatatgcagaggacacatagctgagaaggagagctaataacatcagatgacagttaagactgcagatgatctcaacaaataggagtgttcagctgaaaagaacaggaacaaatacaaaatcctgcatttaaggggagaaaaaaaaaatacccagcaacttagttaccaaagtacagaattaagagacttgtcttggtaacattgtatggtatggtatggtgtggtgtggtgtggtatggtatggtatggtatggtatggtatggtgtatggtatggtatggtgtatggtatggtatgctatggtatggtatggtatggtattaattttttgagacgatctagctctgtcacctaggctagagtgcagtggtgctatctcagctcactgcagcctcaaccctcctggctcaggcgatcctcccacctcagcttcctgagtagctgggactacaggcaagcaccaccatgctggctaacttttatattttttgtagagacgggggtttcaccctgttgcccaggctgttctcgaactcctggtctcaagtgatctgcccgcctcagcctcctaaagtgttgggattacaggcgtgagccgctgcacccagtgataacattttatttgaagat

SEQ ID NO: 38028 - DNA, 1050 bp, Homo sapiens
aaatgaattcattgtttgcttacttctcccagttatgatacatagctggtaccactttagatgcaggggacagaaattgacttataacatttggtgggtgccttagggcattaggcttactcctctcttggaaccccactggagaaaggctgagatggtaggagccataggaattaataaacaagaggtcagggaactgagaggctggagtactggatggatcatatcttgggttgaagttacaaaaactgcaacttcatatggttcagtctaatatgtagatattgaaatcaccaagaatggtggcaaatggggatgagaatccagttgaagaggtatgccagaggaggcttggatttcttttggtgctcaaggtagacagaattgaggcataataggattggtcctggttaatctcatgaaagaacagcactatccaatgggaacttgtgcaatgatagaagtgctctatagctgtgctgtcaaatatggtagccacatatggctattgagcatttgaaatgtggctcatgggactgaggaattcaattttttttattattttttgagacagagttttgctgttgttgcccagactggagtgcaatgacatgatctcggcttactactgcctctgccttccaggttcaagcaattctcctgcctcagcctccgaagtagctgaggttataggcatgcgccaccatacccagctaattttgtatttttactagagatggggtttcaccatattggtcaggctggtcacgaactcctgacctcaggtgatccacccacctcggcctcccgaagcgctgggattataggcgtgagccaccgctccttgcccaattttaaattatatttaattctaattaagatttaaatttaagtagccacatgtctcagaaactgatagataatttgtttttttgtttttgtttttgttttgtttgagacagagtctcattctgtcgcccaggctggagtgcagtggtgtaatcttggctcactgcaacctccgtctcccgggttcaagcagttctcctg

SEQ ID NO: 38029 - DNA, 1119 bp, Homo sapiens
actcaaacatcttacgtgattatgttggtagttcctaaatagaaatctttacaaccctaaaaagataagcattgctgggtccatttacagatgagcaaacaaaggcttaggggcttgaagcctataaatacctgctctggcataggattcaaaggcagttagactccaaagacagtactgcaatgccagactgccttctttgctgcaaaaaagccacagaggccccctgcctactcaaaatgtagcgattttctttcaagcttagagataagcctgttctcttaagaggtgcacttttactgatctacttccttactagtacttgtctataatatttatagcttaatctttaacagctgaaatttttgtttaagcaatttgataatatatacgtagaacttaaaagtaattcatatcttctgacccatgaattaaagtttgaaaatctactctaaaaacgtcatcagaatttagatgaaattgtatagacaaagatggtttatcaaagcattatttataacaatgaacaacttaacccaatgttcaaaaacaagacgaagtattatataaggattcaaaataaagactgaaagaaaatacagtattctgaaatattaaccataatttggaggagactaaaagcagagagacagatgataaagcagtgttagtagaagtggacggacttgagaatcttttggtgagagaagcaaaccttgtgactggtcaagatgagagaaggcaatcttaactcaggtttctggctaagccaattgtagggtactcaacttagaaagcccctctgagtaattcagaagatcactgtgttgtttaactattgcttgtacttccttactgacaacccagttggtatttatttagcagcaactataacgcagatactgttctgcaagctgagggtacagtactaaacacaagtcagtgttcttataaagcttacctttttgtgagggaaacagataataaatacaatttaagaaaaacaaggcaagaagaggggatggagagtgactagaacagaggaaaaagggggctcgattaaagagaaagatcaagggagacttcttgaggtgatatttgaatagagtcattctaggt

SEQ ID NO: 38030 - DNA, 1852 bp, Homo sapiens
atggagcttattttctagtagtgggaggcagacaagaaaacagtaaatatacaatatttcaagtggtgataagtactttagagaaaaaagtaaagcagagggagaggggaatagggaataccgaggtctcaggaggtagcaatataaaataggtgatcagggaaggtctccttgagaagatgacatttgaacaggggcctagagtaagtgagggaataaactaagaagattgtgaggtggggagagtgctacaggtagaaggaacaataaatgcaaaaaccctgaggtgtgaacaggttgaatgtggctggattagagtaagtaagggagagataaacagtgaaaccagagaggtaacggggaggagtgcagatggacagagcacagggttcttaggccataataaggactttggcttttccttgagcaagggaggaaccactggagggacttgagcaaagaataatatttaagcaaaggatcactccactctggttgctactatgtggacagtagattactgggttgtgggacaagggtgaaagctgggaaaatagagtcaatattttgtttttggcactatgataaagtagaagaaatgtcagttttagaactaggcagctcagctgtaatatttcctaactggctaatatttgacaagttatctctttcaggatcaggttcctcatttgtaaaattagtatgaggattgccatgagaatcacagacactttgtaaagtaccaggcattgtgactagcatgtaataggtatgcaataaatggtggctgctattattattgactgtgctttcctatctgtgtagtctttctgaggtctgtgtttctgtgtgatggtgagacataaaagataagccactagttgggtagaactaaggaaaagaagaaaggcaaagcataagagtcaaaggggtaagaataagttagggagaaatagattataggagagttagggaagctgaaggcattaactgtatacactttgagtctagatagagggtgtggcttagagtcaggatactgctaggagtggactttctcttcggggatatctcctggaaaaataatggtggatgggtgggtaggtaggaggaggtaggaattcttattatagatatgcctgagagttaacagagaaggaccaaggcctaaaataggcttgacttgtgactaagcaaaaatgtgtaagacctcagtatctctaagtaaaacttatttcttaaattagacaaagttgggacttgttctgttctatatatgcctacctaaatgtaatttgtaccctgtccagtcttctcacttatattaatgtggcctttgtggtacccaggataattaagtatattgctgcattgctactggtacgtagctactgagatattgacaattgtgaaatagcctaggtttcatagaagtaataaggattttggggacagactgacctgtggggatatatacaaatcaaatatgggccctgatctcactgacatttcagttcaattaggtagataagacatgaacatgcataactgtaatgcaaggtcagaactactaagggacatacaaataaaaatactgtagtgtttcagaggaaatacaattagagattgagaggggagggtattaatgtaagagaacggtaggctaaaatcacataaatagaaaaatgtgaagagtgtgtaggaaagaacaagcaattcagtgtagttatagtgtgggcattatgaaaggaaatggtgggcagttggagaatgacaaatgtaacttgaatcatgtgggttaacatttgtatgaattatgtgggtctacattatggaacagcatttttttcaa

SEQ ID NO: 38031 - DNA, 2041 bp, Homo sapiens
tttgtattttagtagagatgggattttaccctgatggccaggctggtctcaaactcctgacctcaggtgatccactaggcctcccaaagtgctgggattacaggcgtgagccactgtgcccggcctgggatttttaaaaaagtttttacaatagaagttagatcctctccctggtctctgcgctgcaggtaactgggtaaatattctgccttcatgaatcatgcacactgcctggttctctggaacctgatctgtcacaattgaccaagattccctaatgccagtggtggtaggaaagatgatgacactccctgctgcagagtgactgacgacagatcctgctccataatgtcaaaatggcctctggattgttttctcaggaagaaacagaatcttctaaatgggaatgagggaatagaatattattaccatagtcatcctaacatacagaagaagcccttagttaaggctgatttcatacccatccatgactgcagacgagactgttctttgggtcaaagagcatgaaccctgtttagaatttatggtgtacacgtctgtgctactatatatcaaatagatggaatcataatagcctttctcacattgaatgtcctctttttggtgttgctgtttgctgatatctgtggatgtctctaaacagtcttagaagtttgcattaaaagggtgcagcacaccaacatggcacatgtatacatatgtaacaaacctgcacattgtgcacatgtaccctaaaacttaaagtataataataataaaatttaaaaaaataaataaataaatttttttaaaaaggggaaaactggagttttaactactagaccaagattacacattaaaagaatgactacataaataaatatagtaggaaaatattttaaaaaaaagtttccattaaaagaagttagatatactgtagattttaaatcatgtactagttacaagtcacttattagacagaatggaacattttatgtgcacaaagatagtataaagggtgtggactcttgccattgggatctgtgtaggtcatttgtcctaaaatttcttgtttactggaaggtgatatggtgtagtacaaggagctcgagcattgcaattagaagacatggctttaaatcccagctccaccatgttttgaatgttgtgcaaattaatcactttactcattcactaggcagctatttatagtttgtatactttgtgccagtcattgttttagactcttgggatacaaagataaataagaaaaacagtccctgcactcagagggttctggtaagggaggagacagacatataaacagataattataatgtggtctgacaaaggtaatgatggattcctagggcattaaggaagcacagaagagaaatgcttttctgaatttcagtttttcatatgtaaaatggaggcagaaatacctattttactctgttggtttgcaggtgaaattagataaagaatataaaacgtggtagagatttgtcacaagtagaagtatcatgtggaaagtcatattattttactgctttgtaatatattactgtttattagtttactaatgacagagaattgctcaatagtatttgaggtatttggaagtacccatggcataactgtatgtagtccctcttgatttctgacaatagtcaactttctttggaaatagtgtttctgaatatcttgcctgagagtttcccttagttggagtcttagataaatatcctattctcagaggagctaatagaagttattcagagtcctccagagctagtttagtcagttaagtttttcagtaaactatgttaagagtcgtgtggtgagaaggggaagatccagaacaaggaggtttctaagctacacataattgggtgggggagggatggagagtttgatttgcaggacatgcttttgttttcactgggttcatttctcttgaagtgaggtgtatttttttttttttgaagtctgaagttaaggaccaacaacctttaagatgtcgagattcagtatctaa

SEQ ID NO: 38032 - DNA, 1025 bp, Homo sapiens
tttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccgttttagctgggatggtctcgatctcctgacctcgtgatctgcctgcctcggcctcccaaagtgctgggattacaggcgtgagccaccgcgcccggccaataatttttttaaacaattacactgagaaggtttgagatatgctttagcctaaggcagagatggaggtgccttataactaacttactagtgctttgattgcatctaaagaccaaggctagtcattataaaattctgttaaatggacactaggtgtcagcattctctttctctttctttctctttctgagagttcaataaaaaccttgtcacccctgagttcaaaggaagagacaggttaagtatttattgctgttgtattttagtcctttggtagtttggttaagtcttgtttttcataatgactatattccctattattgtacaactttccttttgactgaaaactcaactattcctgatttttaaatgtatttcatcatttacctgaatggtagcgagattcataaagagatgcctaacttgtttaggttattcatatcttattaggaaaccttgaaaacttcagctggtagctttatgtctagtggaagaagcctcacagcccaggcacttcctcagaagtctgcctaaggcagcagtagctgctttttctgtgatcttctgtgcatgtatgtttaatgagttggtatttgcgtcaactctaccattaatcaatgaaaataatttttgaatcaatgaaaataatctttccttatgtagtccctattcattacatttctgaaaagataatcctgtagccagatataaaaaccatagtggcagatttgtag

SEQ ID NO: 38033 - DNA, 1028 bp, Homo sapiens
aaagtcttaacttttctccctatcacctagccagccagttcccctctctggactcaaatttgtgttactagttctagtgtatccttccaagatactttatctggtacaagcagaatacattttcttttccctgccttcttttacacaaatgatttacacattattttctacttttttcatttaatatcctaatgagatcattacataacagtatataaagaatttcttcatctttttttttttttggatgtgaaaaataccatgtgtggattagtcagagtttactgttacagatagtaaaatgtccagaagacatttcatccacatggaagatatttgtattatatgataattttctgtagctgtaattggtggaccaaaaaatgtatttataatttcattagctgttgccaaattgccctccatagagatcatatacatttacattcccactggcagtgtatgaatactagtttctccatacctacagtaatgcagtattgtcagacttcttgatctttgccagtctgagagatgaaaaatggcgtctcagtgtagtcttaatttgcgtatctcttactatttgtgaggctgaacttttttctcacatgtctaagacccatttgtatttccttttctgtctgttagatcttatgatcattttttcttttgataatctattggtttgtggatacactttatatagtagagaaagtagtcctttgtgatatgaagtatggatagtttccgagttattttttcccattacataatggtgtatatttattattttgcttgtagtggttttgaataatttattgaaaccaatcttcatcttggtacatttagtttgctttttctgaagtagctagattatattgtgtatgaaagcttatatcttatttttccctttgaatattataaagcaataatataaactctttatatataaattgtaattttaaagagtattctgttttatgactatactgttttttcttgctatttctgttaccagactttgactt

SEQ ID NO: 38034 - DNA, 1030 bp, Homo sapiens
ttagtaaagacggggtttcactgtgttggccaggctggtctcaaatccttgtcctcaagcaatctgcctatctcgacctcccaaagtgctgggattacaagtgtgagccaccatgcccagcccacaagttgtcatttcatctgttgatggaatctgggttgtctttggtgtttgacattatggaaagagctgctatgaacatacatatacaagtttttgggtggtaatgttttcatttctactgagtaattaatagtagtggaattgaagcaaagttaaaaagagaaaaacaagttttcctgtacttggctgactcactccaaggccagcaataggcagggccctggcagagccttgataacactatctgaaaagccagagcccaaaggaatgagctccagatactctcccagcacactgccccccacaccccgccccagagtgaggataagaaaagaaaacaaattcctttctcataactatttctacaaatacctgtgtttcacaagttttgtaagttcctgttttccctactgtgcagctgcatgatcacaagctatgcctgcgttgcgagacctgtcgcaatttaattaactgcctttgttctgcttctgtaagcctgcttgcctgccccatgagtttcgcactgtcacattcccaccgcaccattcaaactagccaactccctttcagaagtgtgtataaaagtcaagccctgtctttgttgagggctcagcctttggatgttaatctgctgggctggtggccacctaaagaaaatcctcctgttccacgcattggtctctccagtctccagattcctgcaacagaatgactggcttacatgacagttatactttttttttttttttttttttaaagaaactgccagttttccaaagtggttatgccattttacattcccattagcagtatatgagaggttcattatattctgcattcctgcccacatttgtattgtcactattttcaattttagccattctaatggatatacagtgttaggcca

SEQ ID NO: 38035 - DNA, 1079 bp, Homo sapiens
ctttggaccaggtcgaggctgattgccctactgcactccagcctgggtgacagagcaagaccttgtctccaaataaagaaagtgctaggtacctatttaggggtaaaagtcaatcatttataaaggattgttcttaaggtccctgtgcccccaagctttcaaagcaattttgacaagtttggtacccagactgtcaagattttaaattaccttgtcagtgatttttcttcagatagatcaagacgatggatgtgctgaaataaaatggcaaataatatctgaaattgaggattttcaaggacactgcccaaaatgttacctgtgaaataaataagtctcattactggggcacctgtcctgcttctgcatctttctggagacattttgttccttaattgtcattaagaagctgctgttggcatccagacttgattcctccttcattggcagttagtggtaattcattttagctttagttcaataagtgaagatagaccattattttagtgagttcttcatctttgaagggtagtaacttaaaaaaaaatagtagttgaactgtatacaggcttgcttgtttaaatgaactgatcagggacctttcttatttacgtttttagaattactgtggaaaacagtaatttaatgtggctaaatctcatgaagcactggaaattttggaatttgtatctgtggggagcctgtacttaatgcttcttattgatccatcatctgctgtgattctttgaaaacccaccttgagcctgcagtggttctatgctgggtttttatttatttacatgccttttagaaattagacatattttgtggtatagctttgtttgctatcaaatttgagcatattggtttaagtatatggtacatgtaatcccagcactttgggaggctgaggtgggcaattgcttgcacccaggagctcaagaccagcttggataacgtggtgaaacccagtctctacaaaaaatacaaaaaattagctgggcttgttggcacatgtctgtagtcccagctgcccaggaggctctggtgggagaattgcctgatcctgggaagtcgag

SEQ ID NO: 38036 - DNA, 1058 bp, Homo sapiens
ggctgaggcaggagaatcgcttgaacccaggaggcagaggttgcagtaagctgagatcgcgccattgcgctccagcctgggcgacagagtgagactccgtctccaggaaaaaaaaaaaaggccagagggaaagatgacaaggagaaagctgataggtagtcacctggggcaattgtgccacaatctaatcaagataatgactgacacccactgcggacccaaggccatgtggacatgagccggtgaaatggtcaggggctgcaggagagactttactgggacacctttttgtggaacccaagctctgtgattccaaaatctatttgtgaagtcccaatgggagcgagagttcgactgggagaatatgggaatgtgatacctgatggaatggaaacggtgagggttgagcaggctttatgcaaagcgactgcagctcctttacctgaatgtactatgggggtggatattgggtctggctgaggtgtttctcttacctagcatgctaaagcggaaggcatgtgaatctccccacctgccaatattgattggatgtacttgatggaaaccagtaagattgcccaagcctgtgcaagttgttcatttgttgtaccgtagccccgctgaggagcagactggacctgagggcaaaagccggagtgccacctagtggcaaccactgggattttggaccaggaaatttccatttgactaacttgctattggatttaattaaagtccaattgcccctatgacttaaggacataaaataaccttgaaacctgaaatacttataatttcttgggtgatgttggggaaatactctgataggagggcagtgcccagaagggtccatcatcatttggaaatgatttttctggaaacatgctatctggggaatgcaagaaggccgtcccaagtgggtgcctcttcccccacaggcaacttcagagccacctaaggagtttcacgggccacatgggcagtgagtgccctatgaacagctctctattgaccaacaagagccgcctggtttatggatgacaggcggctttcaaggt

SEQ ID NO: 38037 - DNA, 1054 bp, Homo sapiens
cttcgcgaatccgccccattagagcgaccgacaaaaactacaaattccagcatgccccgagtcgcggacggccctcgcgctcccgccggctccaaccatccctctgctcctcattggctcgcaagcctaacgtgctgttccgtgactggttacagctcttgtcgctcgaaagaacccattgctggggctggccggcgtgtgccttggagcctctaaggagatgaaactgcactcaaccaggatgagaggctgcccggccaatgcagctgccgccccgtctgctgcggaggctttgctttttgactccctggcgacagtaaagttgaagagcttccggccggaggccaatagatgggacccccggaaggcggaagttctagggcggaagtggccgagaggagaggagaatggcggcggaaggctggatttggcgttggggctggggccggcggtgcctgggaaggcctgggcttctcggccccggccctggccccactacacctctctttcttcttttgttgttggggtctgtgactgcggatataactgacggcaacagtgaacatctcaagcgggagcattcgctcattaagccctaccaaggtgaagcccttggggcgggaatgagtgaagagtgagggcgaggctgaacagggctaggggaaggcgtgccctttctcctgagcagagcatctctgtgggtttcctgcctctggtgaggccagtcctggcgtggcctcttagcacctgtctcttcccacaggggtcggttccagctctatgcccctctgggacttccagggcagcactatgctcacgagccagtacgtacgtctgacccctgacgagcgcagcaaagagggctctatctggaaccaccaggtgagtggttctcaagaggataggcgtactgtgcggttggctgctagtccctgcctcccgagcagctgagaccccagcttcgtttataggtttgcacctccgtccctggccttttcctcatctcggtcacacccaccaataataagaggcgatgggtattgggtacttacta

SEQ ID NO: 38038 - DNA, 1178 bp, Homo sapiens
tcccgccactgcactccagcctgggcgacagagcgagactccgtctcaaaaaaaaaaaaaaaaaaaaaagaaggccagaaggccgggcactggtggctcatgactgtaatccatcccaacactttgggaggccaaggcaggaggatcccttcagcccagaagtttgagaccagcctgggcaacatagggagaccccatctctaccaaaaaattaaaattagccgggcatggtggtgcacacctgtagtcccagctactcgggaggctgaggtgggaggattgcttgagcccaggaggcagaggctgcagtgagccgtgattgtaccactgctccccagcctgggtggtagggcgagaacctgtcttaaaaacaaaatcaataaataaaatacagtaaaaaagaaggccaaaagcccctgtggggggtaggtgcaccagacactgtccctttggtttctagggtgaccatcgggatgaggaggaagagacccacatgaagaagtcagagtcggaggtggaggtgagagctgggggcaccagccaggtgaggcagacagggctatctcagcttgcctggcccagccccaaccttttcctcgtgccctcaggaggcagcagctattattgcccagcggcctgacaacccaagggagttcttcaagcagcaggaaagagtcgcatcggcctctgcgggcagctgtgatgtaccctcgcccttcaaccatcgaccaggtagtcctaggccccaccccccgtccggccccactcctcaggttgcggccctgagcctctctgggactctctcagaagggaggccttgcccaagcaacccttggagaaggcgagacccttcatccagcgtgcatccgcccaccacttcccaggtggcaggaccccaagaagggccagggatggtggtgaagtcgcttgtggctgaacagtggggagtgctagggcctgtggggcagctctggcatgggctgaggcacagcgctggccacggggagcagctcggctggggtgaattaggtctggcctggaaggccggaatgcatgcgtgctgggctcttgccccgggcctgagggagcctcccggagcttgcacccaggtgtccccgttccgcttctcagtgtgctgcttccgcctctcctgaagctcttccctgccctgtctgctg

SEQ ID NO: 38039 - DNA, 1031 bp, Homo sapiens
ggttagtgtgtgtttggcacccgtgggctctgcctgcgtggcctggtgcccgagtctggcctgcccggtccctcttagctctcaccctttaggtgtcgggggttcctggggcattcagcctgcttatgctgggtccttcgacactgcagggcaccacctaccagaagacggatgcagctgtggaaatgaagcggattaaccgagagcagttctgggagcaggccaaggtatggaaccctgagcccggcctggctgagccacccctcatggaccccatggggcaggtctgagtccctcactgcagtggcatggcccatgccacgtgccccgcccccagcgctgggttagggaggggctggaggggcagggtccaggcgcctaggctcggggcctacccttgttcgcaccggggcttgcagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggtgagcctgcccgcccggagcgctccaggggcccccgggcgcaccctgacgggtgctggctgcttatcgttccaggaggaaacagcagactttagaagcggaagaggccaagaggcggttgaaggagcagtctatctttgtaagttctttgccaaggctcccggtctctgggtcagggaagtgagaatggtccctgtgttcctgggccttgtggggagatcagtggctcagggacagtggtggctgttctggggagctgcatgggcacagggtgccatggagcatgaggcctggcacctcatcacgtggggctctggcctctggccgtggaaaaagactactttggagaagcttgtgctctagattggaagagaaactccatctagacccagaccctcactgaccaggctccccctcccctgccctggggtttctcggcgattagacactgttctgcact

SEQ ID NO: 38040 - DNA, 1024 bp, Homo sapiens
agtttcaggcaagaggccagtgtgcagaggcaaggtgagaacgcaagggagagcagtggcggagacggttgggaacgaggtcagacctgctggcctccagcctctgcatggggcttggctcttgctgggagcaatgggaagcagtacacagtttcatgcagggggagaaggcctgtcttgggttgcaggggcacgctgtggcagctgggatcagagagaggagcttgtaggccagttgttatgtggtcccacgggccagatggccatggcttacctcacttcagggaggctgtgagaagcactcagaatctggatgtgccttgggggtgggccccactggatttcctggtggacctggtgtggggtgtgagaggagggtgtgtttggctgcagcagacaggagaatggagttgccatccgcgtgatggggatggctgtgggaggagaggtttggggtgagggaatcaggaactgagtgctggacatggcaagtctgaaggcgcagtggtcgtccactcagagaccttggagttggagatggaggtgtgggagtcctgaacagttagatgtagtgtttaccgcgagaaggaacagggcttgcggccagccctcctgtgttcccgtgacccagggcagggcaggaggggcctgagcctgccgagtgactgggacctccttccaggagatcatgcacgccctgaagatgacctggcacgtgcactgctttacctgtgctgcctgcaagacgcccatccggaacagggccttctacatggaggagggcgtgccctattgcgagcgaggtacccactggccagtgagggtgaggagggatggtgcatggggcaggcatgaatccaggtcctctttctctctgcccccattctcagactatgagaagatgtttggcacgaaatgccatggctgtgacttcaagatcgacgctggggaccgcttcctggaggccctgggcttcagctggcatgacacctgcttcgtctgtgcggtgagagccccgcccctc

SEQ ID NO: 38041 - DNA, 1019 bp, Homo sapiens
aagtataattataatgctagaaagtaaaaagagtggaatcatgtaaaattctcagttaaaccagaaaagacagaaaaagaagggaaggtaagaaaaacaaggacaagtgcacctgctagaaaacagcggcagacatggtagatattaatccaactatctcaataatcactttaaatgtgaatggcgctaaatataccaactaaaacacaaagactgccagtagattaaaaaaaaaagacccaatgatatgttgtctgtaaaaaaacccattttaaatataaagacacaaatagcataaaaataaaggtataaagaaagatataccatgttaatactaatcaaaagaaaactggagtagcagtattgatatcagataaggcaaacttcagagggagaaaaatgatcagggataaagaggggcattatataataagagggtcaatactccaagaagacattgttaaatccttaatgtgtatgcacctaacaacagagcatcaacgtatgtgaagcaaaaactaatagaactgcaagagaaatagacaagtccactattatagttggagacttcaacactcttctatcagtaattgacacatttagcaggcaaaaaaatcagtaaggatatagctgaactggacaatactgtcaagccactgaatctaattgacatttacagtatacttcattcaacagagtacatattcttctcaagctcacaggaaacatccaccaagatagactacatacttggccttaagatacaccttacaaatttcaaagaatacaaaccatataaagtgtgctctcagaggaaattaaacaaaatcaaaaacagaaacgtagatgggaaatctcaaaataactggagattaaacaaaacacttctagataccagatgggtcaaagaagaagtctgaacagaaattttaaaatgttttgaactaaataaaaatgaaaatacaatgtatcaaaatttataggaagcagtgaaagtagtggttggagataaattataa

SEQ ID NO: 38042 - DNA, 1068 bp, Homo sapiens
ctgtcacccaggctggagctcactagcacaattatagcttactgaaaccttgaactcctgggctcaagctatcctccagcctcagcctctcaagtagctgggaaaacaagcatgcgtcaccatactcagctaatttttttattattttttgtagaggtgggaatctagctaagttgcccaggctggtcttgaactcttggcctcaagtgatcctcccacctttgcctcccagagtgctaggattacagacatgagccactgcacccagccacagagttgggtttttgaaaagatcaaaactaacaaactcttaactagattaaaaaagagagaagattcaaattactaaaaacagcattgatagctcagtgatagaatttttaaaaattactaaaatctgaaatgaaagagggggcattacaaccagtgccacagaaataaaaaggattaaaagagaatactaccaacaattatacccccaataaactggataacctagaataaatggagtaattcctagaaacctaccaagattgactcgtgaagaaataaaaaatctgaacagaacaatagctagtaaggagatagaatcagtaatcaaaaacctttcaacaaaaaagcctagaacaaggtggcttcactagtaaatttggccaaacatttaaataaaaattaacaccaatcctcctcagacttttccaaaaaacagaggagagataacttatttcagcttattctgtgaggccagcattaccctgtgatatggtttggccgtgtgcctacccaaatctcatcttgcattgtagctcccataattctcacgtgttatgggagggacctggtgggaggtaattgaatcactggggcgggttttcctgtgatgttctcataatagtaaataaatctcatgagatctgatggttttataaaggggagttcccctacacaggcctcttgcctactgccatgtaagacgtgactttgctcctcattcgccttttgccatgattgtgaggcctccccagccatgtggaactgtaagtcaactaaacctttttcctttataaa

SEQ ID NO: 38043 - DNA, 1308 bp, Homo sapiens
caggcgcggtggctcatgcctgtaatcccagcactttgggaggccaagacgggcagatcacctgaggtcgggaatttgagaccagcctgcccaacatggagaaactccgtctctacgaaaaaatacaaaattagctgggtgtggtggcacatgcctgtaatcccagctactcgggaggctgaggcaggagaatcacttgaacccgggaggtggaggttgcagtgagcccagatcatgccattgcactccagcctgggcagcaagagtgaaactctgtctcaaaaaaacaaacaaacaaacaaaaaaacattgaatgaaccgtctgtaataaacaaaacaaagacagctagtgcagagttggtgctacacaggaagaaggtcttccacattctgacctttaaggatccccaagtttaattgccaactttttgtctgctcacctaaagcaattggctaaaacaaattacttagaattctgtacttagccaaactatcagttaagtgtgaggatagaattaagacatttccagctatgcaggaatttgaaaatatatccccataccctgtttcttaggaggttacctgaggtagtatatcaaaggaatgaggaagtaatcaaaaaaaggggggaggcatgggattcaggcaacatcagatttaatccaggagagtattgaagtcccaagattacaatgaatagcacacctaggaagcagttagtccagataggagtgaaataacagagggctttaagtaggaacaatctgggagacatcagcaaaatggtagactaggaagctccaggcccttgttaccccatggagacaccgaattaacaaccatatacagaccagaatatcactgtgagaactctagagccgaattaagaagcttcagtgcccaggccaatgcctaaccaagaacataatctatcaaaagtgctaggaaagtttgtggcattttgcgcgccaacatccctctccctcccctgcaaagcatagttcaactaggagaaaacctcccataccttggctcttcccttgggccagaaacaaagagtggaccatgcatgcaatgtactgacttgtctggggggtgcctggccgcccacctcggcctcccaaggtgctgggattacaggcgtgagccaccacacctgtcctggagtgggaggctgagatgggaatatcacctgaggtcgtcgggagttcgaggccagctcagccaacatggtgaaaccctatctctactaaaaatataaacattagctgggtgtggtggtgcacgcctgcagtctcagctactcgg

SEQ ID NO: 38044 - DNA, 1115 bp, Homo sapiens
tgagaagaatgcatattctgttgatttggggtggagagctctgtagatgtctattaggtccacttgttccagacctgagttcaagtcctgaatatccttgttaattttctgtcttgttgatctgtctaatattgacagtgggtgttaaaatctcccactgttattgtgtgggagtctaagtctctttgtaggtctgtaagaacttgctttatgaatctggatgctcctgtattgggtgcatatatatttaggatagttagcgcttcttgttgcattaatccctttaccattatgtaatgcccttctttgtcttttttgatctttgttggtttaaagtctgttttatcagagactagcattgcaaccctttttttttgctttccatttgcttggtaatttattcctccatccctttattttgagcctatgtgtgtctttgcacaagatgggtctcctgaatacagcacaccaatgggtcttgactctttatccaatttgccagtctgagtcttttaattggggcatttagcccgtttacatttaagattcatattatgtgtgaatttgatcttgtcattatgatgctagctggttgttttgcccattagttgatgcagtttcttcatagtgttgatggtctttacaatttggtatgtttggccaggcacggtggctcacccctataatctcagcactttgggaggccgaggtgggcagatcacaaggtcaggagatcgagaccatcctgggcaacatggtgaaaccctgtctctactaaaaatacacagattagctaggtgtgatggcacactcctgtagtcccagctactcgggaggctgaggcaggagaatggcttgaacctgggaggcggagattatagcaagccaagatcatgccactgcactccagcctggcgacagagcaagcgagactccacctcaaaaacaaaacaaaacaaaaacaatttggtatgtttttccagtggctggtaccggtttttcctttccatatttagtgcttccttcaggagctcttgtaaggcaggcctggtgatgacaaaatctctcagcatttgcctgtctgtaaaggattttatttctccttcacttatgaa

SEQ ID NO: 38045 - DNA, 1047 bp, Homo sapiens
ctctctctcccttagctcggccagaagccaggtcacctatcctcggtcactcaggggccaggacctctctccctgcccctcagtcaaggccctctcagtccgggaggcgcttcacacctgggcagggtgggactgggcgcgcctcacttcacgctttcgtcggttggaagcaggtggggaagtccccgcggcctcggcgtctcgcacgcctggccccaacacctgccgaagccggctgcgactccatttttctttttttcttcctcctgggaaacggaggacccgcgccgccacgaagcacagcgaccctggccctgacctcagccgcccgccgccggtgggcggggcttggcggcccggcggggcggggctcggggcggggccggcggggcggtggcccgggttgtagccgccgccgctgccgccgcccccgccgccgccacctcagaagcaggaaccgaagtcgtcgccgccgccgccactgcctgggtcttcggtcggggcccgcagccatggaggattacatcgtgatctcggacgacagcggctctgagagctccgggggcgcccgcccgggccggtcgcggaggctgcgccgggccctgtcgcgaacctccggcgcgctgccccgccggaccgtggtgagtgagcgtcgcctcgtttgggggcgcgcgtcttcgcgaccctcggctgggcccgccgcccgcttcccgcccctggcgcctcacagctgcagccacttcccgccttgcctccttccgggcctctcgggccccggggagcgcggcgggccggggcaggggccagggcagggaccggggaggccgggcctcccaggctcagcgctgaagcccgagaggactgcggctggaaagcggccgagcacatggacgagctcctggcgcgcctgctgcaggggctggggtctcaggccggggccgcgggcgtcctcggagcctcggcgggacgtgggggctcgggtgtactggccgggccgatgcaggaaagcgggagcgcgtaattcttcggcctgtggtggacacagat

SEQ ID NO: 38046 - DNA, 1051 bp, Homo sapiens
gagaggtgctattgcccaaaacggctctcctggggaggagaaagctaggacatgacctgatccctagctacccctgagcctctctcctctgtccacaccaaagatctctcccagcccagttattccctgaaactattctcaccaccttctgaaggtgcctcctgcactcagccccctcaggaggcacaggtaggagcccagaggctgaggccagcaccctggcccctcaggcctggcctcctgagatgtcgtcaccttcccttgcaggggtgttgggctcttcattggtgtggatctgatcaaagatgaggccacaaggacaccagcaactgaagaggctgcctacttggtatcaaggtattttcttcttgaaacaagttgcttcctggagtaggagacaccacaggtacctctttgcagggccagtggaaaggagcctcatctgtacccccagcactctgggccacagacttgattgaaagagggctggggctggcgggtgggggcagttgttgggggacagctgatcctatcagctgaggacagagataagtggtgttagcagttctgtacccagtgcctgactacaaaggctgcagatgagacacaggctattcccagaccagagcagcacctctgcctagaatgcccaagctagcagggcactcagacccaggaacccctaatgccaccttggcctggagaagggaaacaccttctctattcataccagggagctgtggcagcactagactcagggttcccatgccgcacgacaggtggttgggatggacaagactcctgctcctaagctgggtcgggggtgtctcagaactcagactccaccggtcccaatgccctggtttgcttgtcctttcacttggaccccaagtcctcaggacttcttctccttctagttgaattgttattcccttttatctccattccccaggcctaccccttcccccacgcccaccatggaaagctcttctggtatttgacgtgtccttattcaaattgtgagacacgcgtggtattgatgtaaatctct

SEQ ID NO: 38047 - DNA, 1044 bp, Homo sapiens
agtacacacatgtgccaccacgcctggctatttttattttttgtagagatggggtttcaccatgctgcccaggctggtctcgaactcctcaccttaggcaactcacccatcttggcctcccaaagtgctgggattacaggcatgggccactgcacccagctaacatgtttgtaacatctgatttaaagtctttatccagtaaggtcagtgtcagcttcctcgggcgcagtttgcattgattgctttttttcctcccgtgtctgggccatgcttctttgcatgtttcagaattttgttaaaagctggacattttaagtaacataatgtggcaactgtggaaatcatattctcctccctccccatggtggttcctttttcttgtttaatgtcttttctgaactaattatgtaaagttgtgttctttgtcatgtgtggccactatagtctctgcttgattagcttagtggtcctctaaccattagatctccttaattgcctggaacccgtaagtcactcagccaagagtttataactgccttagactttacttcctcattctgcagaggctcaaggtagccagtggtgagagcttagggctttctagatcttacctgagcatgcacacagcactgggcataagcacatccctatgcatatgaatggccttctagactcccaggagtacgtcacagcctttcaaagccccctgtagccatctcatagtaacagaaagcagatcagtggatgcctgggtccagtagtagcgggacggttgcacaggaagtgatgaaaatgttctgcaacttcactgcgagggaggttacacaggtacatacatttgtcacctcacgttgaactttatactttaaacacagtttatatataaattatacctcaacaaagctgatgtttttaaagatgtagtttaaaaacgaaacaaaaaacgtggtttgcaggagacaccttgctcgtgatcctctaaaacacaggtctccactcagatacctgcaggatgaggacagggtgggcgagggaaaggagcca

SEQ ID NO: 38048 - DNA, 1401 bp, Homo sapiens
ccatgtgacacatagagcctcagaggagctcactgtcggggaaagacaggctcacagacacatggtcatgacagcgtggaggatgagtggaagtagtgtgttcacggtgctgtgagagcacaaaggacatcccaggcaagaggtgggtgaagagctgtgggacaagcagtagaggcttcatagagaaggcaagaccagatctcagtctggaaggctgagcaggaaatcaagtgggttgtgtaaggggaacaacaaaggcccagtggagcagcatcctgacttttgtttatttctttgttttacttgaccctcaagtgtacataattagatagaatccttggttcatggaagactctcaacatctgtctgtgcatagccctcttctagttattcagttaacctttattaatgttctaagcacctgggaagccagcatccctaatgaaagcttagaccttgataatatcatgtatctctccagatgttccccccaattccctcttgttgccttctccacccatcactctgaataaccatggtaaccatcactctcaatcccatattatttagttgttatttgagtttatatgaagtctatcatgctgtatatactctggggatttttttttctactaacatatcactaagaatcctccctattgcctgtcactgaagttcatttgctttgactgctttataatctttgtataaatgtaccacagttcagtcatccattactattgctgtgctttgaggtcgttccatgttttttttgttttttttttttttttgcaattatgaacagtgctgctttgaatagttttcataagtctctgttgtacatgtagcaagagtttttcttaggactgtacctgagggtggaattgctggcccatatggtatgtgtttacccttcattttaaaagataatgacatttgttttctaaagtagttcacaagttaacaccccaccagtagtgtatatagtgtatatccttttttgtttttgtttttttgagacaagagtttcactcttgttgcccaggctggagtgctgtggcgcgatctcggctcactgcaacctctgcctcctgggttcaagcaactctcctgcctcaacctccccagtagctgggattacaggcatgcgccacacctgggtaattttgtatttttagtagagatggggtttctccatgttggtcaggctgctcttgaactcctgacctcaggtaatccgcccgcctcagcctcccaaagcactgggattacaggcatgagccactgcatccggcattctttttttttttttttttttgaaacggggtctcactctgtcacccaggctggagtgcagtgacgcgatctcagctcactgcagcctttacttccagagctcaa

SEQ ID NO: 38049 - DNA, 1042 bp, Homo sapiens
ggtgtccctggtgtctctttgtgtgtccagattttctcttataaggacactggtgagattggatgaggggccccctgacggcctcatcttaatgtaatcacctctcttatctccatatccattcacatacgggccattgcgagctaccggggattaggggttcaacacataaattgggggtgggggggtgcagctcagcccataaacatgccccctctggctcgctctcccagggcatccatcgtagcacttagaaaaatgatcacttcttcttttttggctttgtggtggcgtgtgtgtgtgtgtatttgtatatacacacatatatatataaatacacagacacacatatatacaaacacacgcattcattttcgtccacagttcctggctcataactcccacagcccttgttacactcttttgttacaacattgggtgtgtcaggcctcaggagacaatcactctaacctcctgcccttccttttacctgcccaagacaggactctaatcttccctacctttctgatggtgggtcataaaactcattccagagacggtcccaccccatatcctgctagaaggaatgctgctgtcatgaagcttccataaaaaccaaggggactggattcagagagcttccagataactgaacatacagaggttctagaagggtggtgcgcccagggagggcacaggaagctccatgcccttccttcatacctcaccctatgcatctctttatctgtatcttttataatatcctttataataaaccagtaaatgtatttcccttagttttgtgagccactccagcaaattgaacctacagagggaattgtgggaacctcaacttgaagccagtcggtcagaagttccaaaggtcacccgggcgcggtggttcacgcctgtaatcccagcactttgggaggccgaggcgggtggatcaggagtttgagaccagcctagccaacatggtgaaaccctgtctttactgaaaatacgaaaaattagctgggcatcgtggtgggcgcctgtaatc

SEQ ID NO: 38050 - DNA, 1249 bp, Homo sapiens
gggaggaccacttgagcccaggagtgtgaggatgcagtgaatgccatgatcacaccatacactccagcctgggtgacagagtaaggccctgttaaaaaaaaaaaaaaaagtcctccttaaagacatgggctttctagacagggttcttctgctgaagcggctttccttctgccagaatctcaggaactcctggatctgcctttccagaaccagcttctctctccctgctctgccttcagactgccctctttctacctctccctctagaactacatctcttctggctgggtttatagcttggggctgggggaggcccagtgggactggctgagtggagccagccgtgtgacggaggcggccctcttccagttgggcactgccaccctctcgtggtccaagcagcacatgagcagaaccaggtgctcaacaccaacagccggtacctgcatgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgaccgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttaaggatacagccaaaatccctgcctgtgggttgctcagtaaggaaggaaaacatcaagtgattcttcaaagaaatacagaattgcaaggagggctctggaggaagtgtacagggtatcatgaggcctagaaaaagtgaggggacctgacctgggggttcagggaaaccttccctgaggaagggctgttaagctcagagctgactaggagataactagaagaggaggaaggaagggtgctgccactgcatcagaagtctcgtcaaggctgggcacgatggctcatgcctgtaatcccagcacttcgggagatcgaggtgggcggatcacctgaggtcgggagtttgagaccagcccggccaacagggcgaaaccccgtctctactaaaaatacacaaaatttagctgggcgtggtggtgggtgcctgtaatcccaactactcaggaggctggg

SEQ ID NO: 38051 - DNA, 1081 bp, Homo sapiens
tgtaataaagtcatgtgccccataaccacatttcagtcaacgatgtaccacatatatgatggtggtcccgtaagattataataccatatttatatgtttaggtatgtttagatatataaatactttcaccactgtgttgcaatcatctatggtattcaggacagtgacaagctgtgctggttttgtagcctgggggcaataggctacaccacgtagcccagtgtgtagtaggctctgccacctaggtttgtgtaagtacatgctatgaagttcacacaatgacaaaatcacctaaggacacatttgtcagaatacaaccctgttgtttagtgacacaggactgtgacttcctctaaattattcctataaattctttgtttcctaataccgtctggacaactgaatggaatgaaattaaactaacattgatggattgtttgctataaaccaggctgtatgctggggtcgtgcacagagtgttatctcattgaatcctcaccagcatggtaggaagtggatcgcctgacctcattttacagatggaaacacttaagcttcacttaaggagaagggatttgctcaaggtcacatagctaatatgtggctgggctgaaattggaaccctggtccacctcacttctgaacacatgtgctcccctcctgtctgctttgtctcattgatcatggatggggcaacctggttcatggctttgtcacattgagagatgtttcacaggtgctttcttcccaaacacatcgacagagccctgagccctggtccaaaatggcctagcttttgtcctttggccttagtagcttccgtatcagttcttcagtgatgaggagaacatgtaggagtcgtatgaggtgttggtgcagttccgaaggggtcttggaggaactgatagatctgtctgcagtacagttggggaaccaatgactggctacctccaccgagcctctgctctggcagcaaagtcaaggactgtccaatcttactagtcacacactgattccttcccagtcttccctccttccttaccagccatccatccatccttcgatgcattcacccgtctga

SEQ ID NO: 38052 - DNA, 1986 bp, Homo sapiens
aacagacattttacaagtaaagatgaatcgtctcttgaccactatatcctttgccagtcctcctttccctcctagtacaaattaagtttgtaagtgaaactaataatgtgcttttgttctcttgtagttttacatcataataaattaacccatacagatctgaagcctgaaaatattttgtttgtgaagtctgactatgtagtcaaatataattctaaaatggtaagttaaagacttgttttaatttgggtggttgtctttaaaattaatttaacttgatgatctttggatgaggaatttcacttctgagccttattatatcctgttgtttaaccaaaaagaagtaatccttctttgcctttctcatgagcttactttgacaatcaagaagataattcatgtgctggccttttgagtagcgctataaaatgtatctattgagtttcatgtttactcaactgtgtctctctagaaacgtgatgaacgcacactgaaaaacacagatatcaaagttgttgactttggaagtgcaacgtatgatgatgaacatcacagtactttggtgtctacccggcactacagagctcccgaggtcattttgggtcagtagacaccaggctttctaatattataattgaagaagagatttttgttctttacagctttactggtggggtggggaagtatgatcttctcagcaggattcagaaaacgttttctattttcataaaaaatgtgtggacattgctataaatacttttcctgagtggtaaacatgtgatactgtctgggaaagatattccaggtggtggttatttttgaacaagtaaatcttaaatgatcataagagaacaggctgtgttagctaaatgcatcaaagaaatgtgattttgaagttatatgagtacctattttcatgccatcacaaaagcacatggctggtaaaaatactgaggaaactggttggcagatgtctagaatataggatggataaaggtcaagagaagaaagaggcttctctaagagctcctgtgataacccttgatgtgagaaagtctgggaaagaaaatgagttaaggtgcagagttttcaaataagaagggacttattaagggagtgttatgcctcaacattaaaagttatagatcaggtgtgttaataaatcagggaagtcagagattggcttgggagcttggagacattgggaaacattcagatcaggcatatcaagagagttgaatgtaataagctgattacttagcctaaagttaggtccaactgaggttagattgtaaagcatttttgtggaatcgtattttaatactttttactttttttgtgtgtccaacgggacttggtagttcagaataggagtgtaaaagcaaactcttgatacttacctagagtagagtagtaaaggagtgaggaaatcaagaatcctgtgcagctcttgcccacagaacttcccttgatgacggaaatgttccatttctgcactgtcccatatggtagccactagtcactgtgcgtgactgactaccttgtagtggggccagtgtgactgaggagaactgagttttgagtttacattaattttatttcagatttaaacagccacatgtggctagtggttaccatattgaacaagcacaactctagagcttgtcttttaaatgcgtaataatagggtttctgcgtagtacaaattgaaaggagctactgtgtaagggtaaaagaaagcaatatgggaagagatagtggacagagaggtattttcagagattagaaggcaatagattcctcattttaagaatcagatttttccccaaatatttggcattttttctttgttattggtatatcaaacagtggtgcatcgtacagtgtgctatcctagattgagtaaaatatagtatatagtaaccccccccttttttttttctttgagatggagtttcactttgtcacccaggctggagtgcagtg

SEQ ID NO: 38053 - DNA, 1062 bp, Homo sapiens
tgaggcccttgaccctgtatataagatttggcaatttcggattacagaggcaataaagcatgtctaatcttaaatgttaagagttagcttcctaaactataaagacattttattatctagggcctagagaataaagtttgtgatttgaccctttctgcctcattttaccgttttcctctaggacctctattttgtggcttgaaaacttttgtaagagaagctcttagaacttttgcgaaacttcacatttctaaaatgacaaaattttttatcataaattatttgggaaggatgtaatttccaacctgttgtaaatattaatattaaaaaataaaacttacctctctctaaatgcatttcagggaatctaaataccatagcagcttgatacctaccatcatccataaacaaactcttcttgaatacttagaaatgttttattattgaatttattgtcatttcactttccataaatactatcctaaattatccccacattttgcttttctgcaacaaatatgtgaatgtaaattgaactttaaagtattttgaaatattttcagacttacagaaaaattgataaaatagttcaaagaattcccatatattccaaatgttaacctattttccaaatgtttacattttataagatttgctttatcattatacatacatttgttttcaaattttgccaactaatctgcagactttattcagatttcaccagtcatcccattaatgtccttttagaatttcttgaaagtctaagtcttggtgtatttaatgaaatgtatcttaaaaaaaatttttttttaatgagatggagtctcactgtgttgctctggctggtgtggaactcctggcctcaagtgatccttctgcctcagcctcccatagtgctgggattacaggtgtgagcctgtagtcacgtgtggcacacacctgtaccacatctggcctggaatgtttcctttattggggcagttgaggcctctaaaaaaatgagtacatatagccatagataaatatctgactgtctagcattgtatgttttcttttttc

SEQ ID NO: 38054 - DNA, 1069 bp, Homo sapiens
gcttaaaggagacaagaagcatcagggaaaattgggtcagacagtgcttccctccactcagtctctcttcccagagatgggtcaggagcaattcccgctaagaggctcctaggccagagctagagacgccgcctacagcccaggtgccaaggagggcacatctggaggggggtgcctcttgcttttttaaccagctgcatgaccttttgaatgttggcatgggtgtctgagcctaccactcctttactgagaaatgagaatgaggtattctccatccagcattttccaaagcatgggaaatggaaggtgattcggtggtgcataaacatagctggggctgcactgcactgagcggtcccttcctagttccctttatgctttatggtgacctcaggaagaaagcctcacttgctaccagctttagcctgtctcacatttgctcatttcccttcagctcagagcttggcaggcaggagtctctctctagaatttgatgagttaaagtgtgactttgaaattgactttaaaaggactttaaactttttttttgtattcctattttagggttacctttgttcactgcagtagctttccatgagtggtaatagtataaggtcttctaaaacaaattttaagtgtaaaaaggagttaatttaaaggatatgactaagcaaataataatgcaggtgctgttcaggtgtagccaagatcgtgggagtagcctacagtgacttaagtttatgaaaactgtgtttactctcaatggttgattgtcattcactggaagacaataggtctcactacttgattgctactggaaatggccgaagaccaaatattgtaaaaccacagtgttcatcttggcggagaggcatcgccagtcattacctcaggtgcatcactcttctctgtggtccgtgatgatacttaaaaatgtacaaacctggggcatctttaagatcagttggtcatgatgactttgaaatttttctaggctattttgaaattttcctaggctatttgcatagtcaatctcttggccaggattttatttcaattttgtatttac

SEQ ID NO: 38055 - DNA, 1032 bp, Homo sapiens
cccagcccatctcagtgagccacaggcctgccgctggctgctacctggaagggtcacaccagcttttaagcaagaagaggaaaccccagccttttaaagtagaattaggatgatttctatagtttctgcccggccagctgctggtccagtcttctgagcccttgcagtgttgagggcagctggggcccggcaagcagggcctttgccatcctctctgcaggcagggtggccctccctcccctcctggttctcagggtggccctgggatctgggcttgtagtgcatccctgccacctgccccggttggggaggaaaggccctgtgaggctgccttggggattaaattttcaggactcagcactcactctgatttctgatttcctcccttctcgaaatagggctgatcaaattaagcctcgtcaacaccgtggtctgggtgctgtgtggggagtatgaggagccccttccctcctcaactgcagctgggatattctagggcaggaagcatcatgggacaggagtgtgtggggtccaccagggccaattgtcaccacccccaaactcaggcttctggacccacggagttcacacaggaagacaaatgggaggaacccccgtccctgcagggttggatggcctggcctctgggctcagagtggcggctgcactgggggcctctcggtgctgtctctgagtctgcaccttgggatttacccgtgggagaggcaggtctgagagaagatcccacagccaggcgtgaaggacaggagagaccagaaacaaaggttgggcaggcctgctcctcagccccatggggggctggagcagagggaaggaggacatgtggtttgggggcccagcagcctgaggggaaagggaggtccctgacactcactgggagagagggctgagggtctggcaagttccagggtcttgagctgaggggggcgtggtgagcattgcatcacctctgcggggggctcttctctgggcagatccagggagcctggctgctgcccgcccacatggggt

SEQ ID NO: 38056 - DNA, 1070 bp, Homo sapiens
tattgttacatttcatacatgtgtgtctattaatgtagatttataattattgctttatgcatctatagactaaatcatataggaaaaaagagaagagttacaaacgaagattttggggttccctttattagtattcttcatttcatcatatggctttgagttactgtcttctgtccttttatttcaacctgaaggactttctttaacacttattggagggcaggtcaactagaaaacaaactctctcagtttttgtttctctgaaagtgtcttaatttttcttgtatttttgaaggatagttttgttggaatttttagccgcaggacagtatttttttcagcaccttaaatatgtcatcccgttggtttctggcctttattgtttctgatgacaaatcagttgttaagctcattgagagcccttgtatatgtggcaagctgctcctctctcgtggatttcaagactctctttttgtctttgtcttttgacaatttgattacaatgtatcttgatgtaactctttgagttttcaaacttggagtcattgagctccttggatgtgtagaatcatgttctttttatcaaatttggggaatttggagccattgttttttcaaacattctttatgcccctttgtttctctattctctttcttgaactctcattttttgtattttggtgtacttgatctcttaggttctgttcctttttcctcattctttttccttctacttctcagattggatgattgctgataatgtaagtttgctgattctttgtttgcctgctcaaatctgctattgaactgatctattgaaatttttatttcagttattatgcttttcagctccaaaattgtttgtggttcctttttataatttctatttctttattgatattctctattttgtgatacattatgttcttgctttacttacgttatttgcccatggtttcttttagttctttgaacacatttaagacaatttatttaaaatctttgtctggcacatgaggtgtctaggcttcctcagggaaggtcttttttatttcctgtgagtggaccat

SEQ ID NO: 38057 - DNA, 1485 bp, Homo sapiens
tggtctaaagaatggtgattttggtattatagtcttaccctacaaaatccttttgcagaccaagttttacaggaaaactccagtgattttcaatcaaacattgcataggtaaatattttctcaaaaaatataaattcccaatagcaaatactgatatgttgtaataatgctttctatagcagtcaatggctctgacttaactccatggaggctgccatttgggcacagtgagttgcctttagtccagcttggttgtctcacttcctgcccaccatgaataggaaaagcaagagacttcccctgtgctcccttttctcaaatgccattcgagggacacattgtgaatgtttatgttaaattttttttaaaaatgccttgtttagctttaaaaatacgaagtaattttgcaatttttgaaaaacactagttttcctttaaacttaatttttcatgttgatcctgaagaatccgttaaaatggtagcacaagagtctggcaagttggtactgcagagaaaaggggttaattgaggcttgtttggagtcgggattcccctttcccaaacatgcgtctcgccacttggacagcagccatttgtactcgtatactttttaaactttttcttggaatactatattttatttgactggtagtctgatattactcctaacttgtcaaattgatctctttgcaggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcactctgtctt

SEQ ID NO: 38058 - DNA, 3184 bp, Homo sapiens
tagctgaaaaggctctaaagaaacacaaggaaagaatagggcacaggtggggatggatggttggttggatatgtcacttttcttatggtaaacaattaaatccatattctctctgcttaaaagaagaaattaatgttttgtagtcctaggtaattgatgttttgccatgatttccaaacttgtgtcagtcccacgttacacgcaaactaaattttaggtttgaaatttgtccctagttaattggtctgcttgacaattttgtgagtcttattaaccccaatcaatagagttgagagactatggctttaaaaaattaatgcaaacctggctttagctgtaataacacccacctagaataaattaatattaccataagaaaatgtgatactttctgatcttgtttttaaagttgaaatgcaacaaactttttcttgctgtatataaatattctgcatagtattaataagcatagctttcaagaaattgtcacaaaaggttttattctctttgcttgtgactatttttcattgaagcatgcgcttacctatgctgattcttactaaaagcataggctggggtatttattggcgaaaggaaatgtgtagtgtgggctggactgttggtggaggctggctttttagcccacttgctatacatgctgccaatggatttaagacttgaaatgttgaaagttgagtggaattatttccctcctaaaacatttatttacagtactcctctctacccctaaggttgggctctgcctcagaggagtgagttttttttttttttctataaagtttacattgtcttactatttattgagtgaatttctggtcattgcctatgcaaatataagaaatctggctttaaatattagtcagtttcatggctatgactagattgttttcttgtataactaaatacctgtataaaatgaactaatgttttctctcccctccctaccccttccttatgaacaatgctttaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggtacgtgaggattcgtaaggttcggcaagtcgtctgttcctttgtctaggtgttttatttgattgattgtactttgtctttcaggctatggaggctatgatgattacaatggctataatgatggctatggatttgggtcagatagatttggaagaggtaaggtaagaattgaatttctcagttgaaggatgcttacactcttgtccatctagacctcaattactgtttttcaggaatgtctgatcacagatacggggatggtggctctactttccagagcacaacaggacactgtgtacacatgcggggattaccttacagagctactgagaatgacatttataatgtaagtgtgagatgaactcacaagtcaatatttcagtatggcagtaagtcagccttattctataaatgtgagcactatgttagaaattttaggttttttttgtaacgttagaaagttggttgaattctttgaaatgccttgtgttgtagtttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcgtaagtgtgattgagcatttgtgggctcttaacaggtgattgtgtgactaacatttacaatagagaaatggaaaaataaggatatatgagaagtttcctctccagtaatagattaattcttgggggatgcgggggcagtgtgttgaaggtttgggttttaaaaattagtataacggatttgtgatatgcacatcttgaagtgtatatccttaattgacaatacagatgaatatgtaaaggctagattttggagttaaagtagatcacctaagagaagtagctagaatttctttgccaaagtatttgaagttcacagatctgcttgtttaaaaactttataaaagtgcttattctgttttgtttcaccaacaaacattttcaaactttttttttctcatttcagaacacagatatgtagaactcttcttgaattctacagcaggagcaagcggtggtgcttacggtagccaaatgctaggaggcatgggtttgtgtaaatatcactttagtgtcttttttttaagctaaccttgtatgccttttctctcatttcagaacacagatatgtagaactcttcttgaattctacagcaggagcaagcggtggtgcttatggtagccaaatgatgggaggcatgggcttgtgtaaatatcgttagtttttttaaaaaccaaaacgtttatatctgtataagtcaattataagttaagttaatctatttatttaataagtttagcataagaaacttaggcaaagcagtttcttgatatttgagttttgtatctggcttacttaaatccttgtgagttatgaagttccttaggatagataattcaaattaggtttaagtagtcttgggggaggggactacggagtgaaactacttaaattttctaagtataaagtttaaatcaatagcaaaacaggattaagataaatgtgggcataattaggtgtattgacatgcctttgatgtatcaaactgagggggaacccactaaatccagtcaagcagtttcataagatcttcacaaaatgcctctacttacggaatcatgttgattttagtcctgctgatgtgtgtaccgttagcactttggtttatcaatatttgactggctcaaatgatggatagaagggtggcctggttatagacagtaggcagaaggaggcagagggttacagtaatgtaagatcaagactggaaaatgatagctatagaattacaagcccggtaccaccaggtaccacatcacataagaaaaaaggttctaatgttttcttaacttaacagcaaaccagtccagctacgggggcccagccagccagcagctgagtgggggttacggaggcggctacggtggccagagcagcatgagtgg

SEQ ID NO: 38059 - DNA, 4193 bp, Homo sapiens
gccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgccgccatttcctttcctctacgctggctctcggcccgggcccccacggttcggggcgccgacagctgttgctcaggacagctttgggggtccggtcgccggacgaggaggtgttggagtcgccggggtgggtgcatccgcccggtttttgctccgtgggggggcggtgcgggcccgggcgcgcctcggaggcgaaggacagcttaattggcgctctcagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctggtgagttagaactaggacgcgggagttcgagttcgaggccggggcgggcgggctggcgggcggccgggctggggcggggcggggcggggcgggccgggccgggccgggccgggtgggacccggggcgccccctggcgaggcgcgggcgactacactcaccgctgtgctgctcgcgcccggcggcccgctgttacgcaatggaaatttcgaaagccccgcccgtcctcctggcccttgggggagtgcggcaggtttggcagactttgttttctttacctatctttgaacaccagcttttcttttatgggtgtctttttttctttttcttttgagttggagtctctgtcacccaagctggagtgcagtggcgcgttctcggctcactgcaacctccgcctcctgggttcaagcgattctcctgcctcagtctcccgagtgtctgggactagaggcgcgcaccgccacgcccggctaatttttgtatttttagtagagacggggtttcactattttggccaggctggtctcgaacatctgacctcaagtgatccgcccacctcggtttcccaaaatgctgggattacaggcgtgagccaccgcgcctggcccgggtgtcttttttcgaaaggataaattggcataggtgggatttcctcctcaatcttgagaaaatggccgagtgattagacaaataatagtaatgttttgcaatatcttgaagtgtaacctcttgtttccagttttggtgttttcttaaaaaggagcattcttcggaaagttaaaatgtcacgtcttaatttcagttttcctaatcaagatttgataattgaagagtgttttcttatctagttcttaatctggctcactatacagttgaagacactgaagcccagggaagtgtttttgcagtacataggtttcctgaatattttctatcagaatgtccttgttcctattattagactgggaaaaagaaattagactgattaaaattctatttggatgaaattaacagcttttggcaagacgtttgtagtattgacttactatctgaatttagcgttggtaacggaaagcgacctgtaaaacaagaaccaagtacgctggaagccgccttgcagggggcaacactgggtttggcttcagctgtgcaacttggagcattttagcttggtaacactgatcccctttcaggtgagtattgggcttgtaatttgaatttgaatgagaaaccgtaatgtggctactggtaaggtaaaacggataaatgccccagaccaaaacagctcgcaacgaagtatgtttgccgtaaagtcacacagtccaggcttgataatcttctgagaaattgataaaagatgtgtgatgtagacatgagtagcaaggactaaagagataaattcattctgaaactgctttgaatattgtatgttgttgatgggttggaaatatatcaccttaggaatgagtttgtttttttttaattggagttttaggagttggtaatatcgtggtcagtatatataggcttcacaagttatgtaatttgtagtggggacatggaatagacatttcatctgtgtcacccagaggtggttttaggttttaaattctgtattaacggttgttttctttccagactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaaggtttgatttacattgccctagttacagtaaataaagcattaaacaatagaggtctcaccccttctgaattttaggtatttgactgcatggaaatggtcatctaagggagtttgtggcagctcttcctagcttatctaaagacccaggaagtctgaactttgttatctaattttccaaaagtgactaattctaagcacctctttcagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatgtagtcatgtttgttgctgagcagtgagttttggctagcttatggcaaggtgatttaatagacgttaaagttgagtagcttaggtatttcagtaggttgtaaattgccaatgaattaatgttttcttcctagagaccttcaaataatttaagcccatcttaaaggtggaaatgaagtacttccaaaatgttaactttgcctatatttagtattatagttcagagtagatctttcattgaggattgccctcaacagcttaactactttcctcacattggtgtccagctaagtacctcaagttaaaggtaagatccctttaccagcagatcatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttcctgggcctaaagtatttgaatgtttttatgctgaagagctgataagattgcatgtttaacaatgttagataagatatcgtatattttaagtattaatatttatgatgtgatacgctggaagcaggaaatcctttcatggtttagtgtagtatgttaaaaattgatatatgtatcgagtcctaatgtcagaatttttaaaatcaagtctgttttgttttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtatacctttttaaaaacttgaagttccaataacttaaagcattgaaatataaaatgaggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggagga

SEQ ID NO: 38060 - DNA, 1029 bp, Homo sapiens
tggatcacgaggccaggagatcgagaccatcctgactaacacggtgaaaccccgtctctactgcaaatacaaaaaaattagccgggcgtgttggcgcatgcctgtagtcccagctatttgggaggctggggcaggagaatggcctgaacccgggaggtggaggtcgcagtgagccaaaatcatgccactgcactccagcctgggtgacagagcggtagccgggcatggtggcatgtctcaaaaaacaaacaaacaaacaaaaaaactgcaggccgggtgcagtggctcatgcctgtattcccagacctttgggaggccaaggcagacggattacctgaggtcaggagttcaagaccagcctgaccaatatggcaaaaccctgtctctactaaaaatacaaaattagccaggcatggtggcaggcacctgtagtcccagctactcaggaggctgaggcaggagaattgcttgaaccctggagccggaagttgcagtgggccgagactgtgcattgcaccccaacctgggcaacaagagcaaagctctgtctcaaagaaacaaacaaacaaaaactgcaatttgagcaggcatggtagctcacgcctgtaatcccagtactttgggaggctgaggcaggcacaacgcttgagcccaggagttcaagcccaggagttttgcaacatggcaaaagcccatctccactaaaaaatacaaaagttagcagggtgtagtggtgcctccctgcagtcccagctacatgggaggatcaccggagcctggggaggtcaaggctgtggtgagccatgatcacaccaccaatagactccagcctgggcaacagtgagaccgtgtctcaaaataacaacaagaaaaactgcaatcattaagacaaacagtccaatttttaaaataggcaaaaagacttgaaccactaaaaaaaaaaaaagatggccgggcttggtggctcacacctgtaatcccagcactttgggaggccgaggcaggcagatcacttgaagtcaggagttc

SEQ ID NO: 38061 - DNA, 2071 bp, Homo sapiens
gaggggcagagacccaaggtcacagaggtcccggaacgccagccacagccacctgggcaggagctggggcggcgtgagggacacaggcgcgagggcacccccccaccctgctgcctgctgccccgcgccggcctgggcgaccccggcgtgacacccggtcctgggactcccttcggcgcccagaacgcgtcggcagcatccggcctgtgggagggagggagggagggagggaggcgtcctgaggcagcccggcccctgctgccctgcgctcccgtgcggccccagcccgtcctccgcaccccgagcttcccgggctggcccccgccctccgcgtgcgcccagcgctcttgcaggcggagggtgcgggccgatccccccgcgccgccccgctggccggtcttggcgatggtggggccgagtagggcctgagccctcggaggcgctcttcccccggcctggaggttccgggagagtggcctcctgcctgcctgcctgctggaggcctaagcgggctgagtccagctgcccctcggcctccccgccacctgcttccctgtttccctgtcccggagcgccatcccagagaggctgcggaggagggcgagggaacctggacccttccggaccctccgagctccatctacccacgccgagctctgccagcacgcccgcctgccgcacttgttctgccagagcagaggcctgggctggccttggggctccagggccagagaggcatcacccagggactctgcggggagcctgcctgacacgggagggatggctgggcagaggccgtgctggcggggtatattatcaagggcaggcatggctggggcagaattctctgtaggtagggtgtgtcacctggggaaggacattctgggtccttggcagggtgactataaaagcacactggcatgaaggcctaggtggggccatatctgaagggctggggcatgctctttgagtcgtgggtagagccgtgagcccttgccctttgtcctgagccagtgtgtgcctcccgcagcagccacatgcccgcggattgatgtcaggagccacctctgcaagcctggcttaccacagggagccaggctccaggacagcagagtgagggagaggcactggctccatggcacccactgtgtctggggggcatccaggaggctggctctctgagggcctggggaacaggagagcaaagaaggggagcacttagattcacgagcccagcccctaggggatagaagcctaaggatcctgtgaggtatgagtatggggtgacataggcctcccttgtcgaggggctgtcactgtttctgtggtgacccagtagtaccaggtctttggaggcctcaagagaagctgggaatctgggctcttatgtgaacccatctcgttgtcacatgtagaaaatctgtcttaaacccctggtgaaaccagacgtagccagtcggaggccagattggaacctggcctccactttgcagccagcgggggtccaggaacttgagggaaggacccaggaagtggaatctgcagggaaggaaggaggtgggcagggaaccagagaggaagggcagcaggtgtgggcatcatcctggaaacgcaaggtcaagcccaggacggcctcttagaccaacgcaaaatggaccctggagaagggtttggggcccaatttcctatctagcccgtgcagcagctctgccagcgctcaaactgtggccctcggtcaagcacctgctgaggatctgcccagggaggcagacccttgggggcagcccggggtctcagccatgcagcgctcccagccttcaggctgtccgcctccccaggcctggacttcagcaatgatggacacccttactcctaggaggttgcagggtctggagaggaggcagacacctgccacacacatgcatggtgacagcagaccgttaacgggcctgatatctgcctatgcccctctgagcctgtcccttttccctgagtacaaggcacaaaggttgtgccccagcttggctctttaatctttccccaaccaagagggaagcagggggaactgtgg

SEQ ID NO: 38062 - DNA, 1084 bp, Homo sapiens
gccaggttgatctcgaactcctggcctcaggtgatctacctgccttggcctcccaaagtgctgggattacaggcgtgagccactgcgcccggccgacacccaactttcagagcatctttggttcctggggtgagagaagccagaccccagcaccagtcctatcccacagggagctcggtgctgccacctctgcagctgcagaacccggcaggctctggagagctgccccccggtgggaggtagcagaatggagccagcgcacccctttcccgatgtctcgaggcccttctgctcaaaattcttttgtaggcaccggtaacctgattctaaggtccccaggagatggatcacctgatgacatgagaatgtcttgtttttggaaagcctggtcatgcaatttagcagaaggtttgcggtgaggtggaaggcatttatttgctttgtcttgctaaccctcaaaatcaaagcctgtcccagcctgacagcttccagcagaaagtgtcagaaccagaggcccagccaaggcccaggcagggcaggcggtcctcctgggccctggcattgttcttacacatggagggcatggccatcttctctttcagggacaggctggcctgacatggaaggtgaaacaaggcagcagcccctgcctccaggagaactctgcagactgcagtgccggggagctgaggggtcctgggaaggagctatggagtcccatccagcaggttacagccacatcctctaaatgggcgcaatttgtcctgccacctagaaaaagttcacatgtggacagtgagcagccaaggtctcttcagagggaccccaggccagctggtccagcacaggctaagcaagggacccccagagcacaggcctcaagagaaggcctcagcaggcccactgccgctgtccagcttcctcgggccacacaccccgtcacatctgggtctgagaggccttgcgggaagacctcatgggacgcaaggactccctgggcagagggtgggcccctggtcctggaggcacagaatcctcgacccacacgactatgtgacctctttataactggggaagacttcga

SEQ ID NO: 38063 - DNA, 1028 bp, Homo sapiens
cactctgtctacccaggctggagtgcagtggcacagtcatagcctactgaagcctcaacctcccaggctcaagtgatcctcctgcctcagccgccaagtagctgggaccacagatgcacaccaccacactggctaatctttaaaaaatattttgtagaggccaggcgcagtggctcacacctgtaatctcagcactttgggaggccgaggtgggtggatcacttgaggtcaggagtctgagaccagcctggccaacatggtgaaaccccatctctactaaaaataattagctgggcgtggttgtgcacgcctataatcccagccactcgagaggctgaggcaggagaattgcttgaacctgagaggcataggttgcagtgagctgagattgcatcactgcgctccagcctgggcaacagaaaaaaaaaattttttagagacatggtctcactatgttgcccaggcttgtctcaaactcctgagctcaagcaatcttcccacttcccaaagtgctgggactataggtgtgggccactgcgcctggcccatttgtcttgttcttgaagcttccagtccagcaggccccaccgcatatccagtgctgcagagtgcagggtttgctctgcctgtcagaggagccagggcacagcaagggcactgcagttgggagtccactgggcgtcagtcactgcccccacccccacatcagccaaggtcggtctccgctggccttgcaccacgcacagagcactggctcatgccaagaagcagaattcaaactttgatgttgccgccaactagttttgtgatcctgggtaagtaagtggctttgaatctccaaatcctagaagaatgaccagagagtctgccacgggccagtccctgggctgcatgttgtaatggtatcattgtgtttcatgctccctcaagcctgttgctttgttttaaaggtgaggaactgaggcttgcagtttttgtgcagtcatggcaagttcagtggcaaagccaacgtcaagtttcagggccgc

SEQ ID NO: 38064 - DNA, 1025 bp, Homo sapiens
gccatttgattcttcattcagcaagtatttcttgagtactttctgtgtgccaagcacaaggggaacagtggaaagtaagcccattgtcattcttgccctcacagatgcacttgtgtggaaggggaagagaaactaatgcacacatgcatctgcataatttaaaactcggctgagcacaaggaaaggaaagcactggggactgtgagaagatgacagaggaatcagggcagccggggaagggcagaggccgttggtggaggtggaggtgtgggatagtgggctcaggaagtggaggcaggcaggggcaggctgtaaatgctctcatccagctgtttgcagctggcattcagtacgtcttttcagtccatccgtattgcccctcctgaactctaggaccccaaactgtcctgcatcctttgccttactgaacttgctcttttcctgctccagccccagtgccacctctcccttcacctctcatctttcctctccttctacagccatgtgctttctttctgaccttaaacccaaatttgctccctcttcaggcctttgtgctcactgtggagttcccctccctcttctcagtatcctatggaagttacatagtcatgtgtttatgcacggattgtccatctaaggctgtaagttccgtgagaacagaggctttttatttgctggtgtatccgcagcacctagcacagtgctcggtgtttgtggagtgagtaaggaactggcccaaccttgttgggcatttaggttgatttcccttttgactgttatgcacaactctaccgtgaagcttttcacaaaaacctctttatccacgtgaccagctgtttactgtttacttaggacaaagtcctaaaagttaaattgctgttttttggggttttttttttttttgacatggagtctctctctgtcatgcaggctggagtgcagtggcgcaatctcggctcactgcaaccttcgcctcccgggtttaagcagttttcctgcctcagcctcctgagtatctggga

SEQ ID NO: 38065 - DNA, 1352 bp, Homo sapiens
agctctgagcccagaggaagccgagtcagccctggaggcggcccattatttcacagaggacagctcctcagaaggtgagcggccactggaacacccgacatgcccagccagcactctgcagccaccgccgccttcctgtggggctcgggcagtggccagcagtcccacctgggctcagggagcaggccgcatggggttctccccaggggaccacgggctgggctctgccatgctggcgggggctggggccgccccctgtggatgtcctcactcctgtttctcttgtgtctctgtcttcctggaccttggctcctccccactctgcccctctgcctctcctctgctgtcccttccagcatctcctctggcctcagatctggatcttttcctgccctgggaggctcaaggtcagtccctggaaggcaggggcgccccctgtacctcctaacactcttcctgcactatcaggaagcctggaagctctttgtcccagggacctctctgggacttcatcctctggggcataagttctgagaaggacccagaagcaagccactcctctgcaccgcctccgtgtctgctgtaggtgggcggtaaataaggcccccacactaggcgccaagcaggcccagggcaaggcctccacagccacatgttagagacattctgtcttcctgtgagtaggaaacaaatacaaaatgctgtcattggagcgtgtgaaagacacagtgtggctgagtgggggctggaaagaatagtggatgctttcctaggaaaaatcttcatgttccacgtcacgttttttgttaaggaaaaacacgcatgttgagtgcctgttagaactcatccctgtgctatgtttaaagcctgttgggagcatctgatcccaggtgatgggagcatgctaggccctgggctttcgcagtcgagctggtgacatgcagcacacttgcaaaaccgaccataatgccacctggtggtttcacatgggggataatgcacaccaaggaaccgactcaaaagagaaccaaaaatagtgtgtaccaagatgcccatggcagtcctggtgacagtggcagaggctgacttgagcttgaggaccttgatttcaaggacagaaactacagaagcaggtacaccttctgttgtacatggaaccagcaggccactctaggcttgtcccgcatgcttctgggagcggcatgttggtgcagagccctggcctcagaccgcatgtggcccccaggaagcagggcctccattccagggtgagttgcctgagcccagagaggtgtgcccttcactgccaccagacagccagcgagagcagctcagaactggggtgctgccga

SEQ ID NO: 38066 - DNA, 1908 bp, Homo sapiens
ccgaagacattgagcagatgcggtttaaacagaggctgaaagtgatccagtccttggaggacacggccaagaggagtgtggtatgggtgccagcagggctgggcaggggctgggctgggggggcagcagtgccttccccacagagcagggtgggtacagggctccaccgcacccagtctcctacactgctttggtatgtacatcatggtaggattcatgggaccgggatccaggggtgtaggtgggaatgtggggagaggttccagtcacttttctctgctggtggatgtgtcaccgggaagcttctcagatggctcccaccctgaaagccacatgcccagccctctgggccgagcccgcccagcctggcttcccatgtgttccctgccccactcccaggtagcaacatgccgccatcctccgcacaccccaaatggcatgtgtctgccacaagctgctgttctcatctctagaggggccaggccctccctgccaccctgtgctgcaagacctgtttgtggtctctgcccccaaaggcagggacttcctccattgtttccacattcccagccctcctgcaggcttgtaggacactgtaaggacattgggtcgcagcaccacagactgactgctttggccaattaaagtacaggagcattggctggcaggttctcggcctccttccacagagctggcaccagggtctctgcagggatccagatgacgggagccaaatgagtatccctcactctgcgacctcagctgcacgttgaggacagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagaggctcccccacgcccatcctgggaaggggcccggagtgtgagagagagactcccccacgcccatcctgggaaggggcccggagtgtgagagagaggctcccccaagcccatcctgggaaggggcccggagtgtgagagagaggctcccccacgcccatcctgggaaggggcccggagtgtgagagagagactcccccacgcccatcctggaaaggagcccggagtgtgagctgagtggtaggtggggggccagggatgggctgtgggcctcgctctctcccgaagggtccgcccttgagtgctgggccactgagagggcggttcacacccttgcccttgtctgccgaggatgctctcacagagtgccgtacttctgtgccaggagcttgtgatccagctatataccctgtttctccttccttctaggtccgagctatacctgtggacattggtttctccattgaagagctggaggacctttacatggtgtttaaggtgacagctcagagccagggcaggacccgttcctagcttcctagcttcctgccagaaaagaaatggatctaagagtatcctcttagaagtagatagaaatagggaatagaatagaaaaacagaaacagatctaagtgcatcctcagatgcagttgccatgaacctcctgtggtagaatcgaatccctcttggagtttaggcaggacctcttaaatggcagcaaatccattcaagtcatcttacacagaagagggaatacattgcccctgtattgctagactgaaaagtctagcaatgcacagcttcaggcatggctggatccaggtgctgaaatgtgccgtcaggcttccccatctctgatgtcctctgcactgctcttcctacaccatgccaggact

SEQ ID NO: 38067 - DNA, 1054 bp, Homo sapiens
tatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggtaaggggcctgacaggggcccagagacagcatctgccaccagaggttcacaggagcaggtccctgtggtcccaggcctgtgtggtgaccctgccttgtgtcccaaggaaggagcccagcagaaaaagatgtaatttaaaaacagtattaattgctcatcgcatccccatgccgaatagaagtcgtcgtctttgtacttttgtctgagtcccagcagcatttgattgttgtatgtgtttggtgaaacaggcacatacagaacataaaatgtcccatcttcactgtttttaagcgtgcagctcagtgctctaagcacattcacactgttgcacgcccgtcaccgccatccatccccagacctctcttcatcttgcaaaaccacagctctgtgcccattaaacatgccccgatcaccattagcaaccactgttctactttccattgctatgaatttgactactgtgtctcatataagtgaaataacacagtatttgccttactgtgcctggcttatttcacttagcaagatatcctcaagggtcatccatgtcatatgaatgtgtcagaatttctttctcaggctccatcatattacatagaccacattttcttttcttttcttttctttttttttttttttttttgagatagaatctcactcttgtttcccaggctggagtgcagtggtgcagtctcagctcactgcaacctctaccacccaggttcaagcgattctcctgcctcagcctcttgagtagctgggattacaggcatgtgccaccatgcccagttaatgttttgtatttttagtagagacggggtctcgccatgttggctaggctggtcttgaactcctgacatcaggtaatccacc

SEQ ID NO: 38068 - DNA, 1029 bp, Homo sapiens
tctccaggcaggcagtcagtctgcgctggggccgtgcccactggattcaggcagcttgtcgtcaacatttgtttaagtggacccaaaatccatttctaacatcacaggggccagaggggtagactgtgggtgtgaacctagcagagttctctctttttttttttcctttttccttttatattaataacaactttattgaggtaaaattgatacgcaatacactgtacatatttaaggaatacaatttggtacgttttaacaggtatacgcccatgaagccatcaccacagtcaagatcagggttctctcaaaaaaacacagaatgtgaagtgttttaggagggcgcccagcaccctggcagctgccccagccctgggtggagtgggaccgtggccacgggaccagagccagtgggagggtgtgaggggtagagagcccagcccaggccagagcccaccatggggaatcgaccacctgcccagccaagaagttcaggcagtcagctggccctggtcgagctgggctctcccccactggactttgctttctgccaagacagcatcactctcaggccggtgtggcaccatgatggcagcagcaggccttgcatgctccctgggttatcccaacactcctgcagaagggccactcatttccttggtagcaaccgggtgacgcagtcgccctaaacccaccctgagcccagcccaacatcacaggccatcacccagccctctgtgcagcccaggaagcatgggcccgagggtgggcaggggtgtgcctccacgttaggatagggcctctcctgtcctttgcactgacccccctcagaaaagggccccacagggtgagcccagaacccgctccctgagactgactcgctggtgagagtggggttaattactgaggactcggtgtccagcagccagagaggagctgagggctgagctgcagccacagcctcctgcccagccagacaggctcttctccgtgcaccgtttgcccccatggcccttcttgcaccgggcc

SEQ ID NO: 38069 - DNA, 1023 bp, Homo sapiens
atacacaggtgtgcatttctgttagcagccgcatgctttagtttaagctccacacctccctgtggggagctcctcacctaggtttcaaggtgaaacctggggttaggcctgcccagggtggaagagctgcccggggccctccatctgagtgggatccagggcaggtgctctgggctctgcttgcccatcagtaccgagggatgggttgcacattgcccaggccagcatctaggtgtgtccttttcaaagcagtctcaggacacattgcttgctggccacttctccgctggttatgtgactgtctcaccttctgcctgctcactcagcatgcatcttttattgaactctgaggtccctgagcatgacttgctcaagggaccaccccagggatcctgaatctgatgtggaaacaggcctggggaggccccaaggcttccttgagagtgtgctggtcctgaccttgtcccctttcctcctgtcctcctaccttgtttccccagagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtcagcatcccctagttgagaggccaaggcctttccagccccgaggtgtcagtgggctcagggaccagcctgtcctgctctgccctgtctcactggggggtacctgggaggatgccctagcccaggcagtcacatgtcactcagtgatgggacaggtggagggtgtaggacaagtgagcccctccacaggcacctgccctgttggggaggcaggtaacatggtgggggcacactgcttgccctctcaggtcacttgcctagtggagacagggtctcccacgcgtgagtttccatcaggcctgccttctgggccct

SEQ ID NO: 38070 - DNA, 1023 bp, Homo sapiens
cacctccgcacgttcgttcctttccccttcagccactggtgggggagacactcaccgtgtgtggttggtctggaaggcagtggacacctcagtggcctggtccctccacatggagggcgtgacacagcccagacaggcctgggcacacaggaagtgctgcccccagagagcagttccctgggatgggtctggggtacagatgggcatcaggagcctcgccctgccaggccctaacttgcggtgtgtctatctctgtgggcacagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcggtgcgttgccctccagggctggggtgggctcatgtgagccaggttcgctgaccttggctgggacctgcctggtccaagtgtgtagacctggagaaggtgtccacattcacccctcatgggctccccacttgggaaggaagccaggtaaacagatcattgcagtcccgtgtggagaggcagcaggagatagcagtgatgtcctgaggataccactaatggggaggaagctcttcacactttattcctcttggccctatgatgggaaggggctcttaccatccctaggtatcagacaaggaagctgaggcacagagaggttaagtaacttgcctgaagtccctcggttagtgagcagtggagccaggatgtagccacctcagccagggtgttctgacacccccagaaaggctttggtaaatctgggctcaagtgcacggcctccgtcccaccgtgattgacagctctcctgtataccctgagactccttggccagaggcctc

SEQ ID NO: 38071 - DNA, 1047 bp, Homo sapiens
cccacacgactgtgattcagcctggacgtttaattttttgtttttttaccaggaccatttattactttgttatgcacatatccatcagcttaagagggaaaagcagcttgaagattctggtcacttagatttagcaaatgaggtcacccactttcatctcgcttctttgaatgtgcgtttaaggcctggggaattcatgatttttcttttactttaccaaacctcttctaggttcttcccgcaaagagatcacaaaacactgggaatggctggaaaataacttgctccagacactgtccatcttcgacagtgaggaagatatcaccaccttcgtcaagggcaagatacacgtaaggtttacccgccactctctgttctcacccttccctggccagcagtgttctcgtgtattatcctatttcatcttcacgatgtagggtgcgtccccattttacaaaggtggagactgaagtgtcagcgctccttctcttggagttgaaaggggcagaggaactcgtgacccaggaaaaccccttcttaccctgggtgggcactggaggctgctgaagcctagtgcggggcttccattcctacccaagtgccttggaaggcgtacgcagatagacggttctgtttgccagaagagatgctggaaacaattggatattttgagttgttttttataataaaactaacgttattttaaaagacacatgccctttacccaaaaattccattcttggcgtttaccctacagtgtattcatatatgcagaatatacagtttaaagggccaggtgtggtggcccacacctataatcccagcactatgggaggccgaggtgggtggatcatctgaggtcaggagttcaagagcagcctggccaacgtggcaaaaccccatctctactaaaaatacaaaaattagccaggcatggtggcacgcgcctgtaatcccagctactcaagaggctgagacaggagaattgcttgaacccaggaggccgaggttgcagtgagctgagatcgtgccactgcacaccagcct

SEQ ID NO: 38072 - DNA, 1040 bp, Homo sapiens
ctcagaaatcaggacaggattgtatttccttaatggtaaacaaatagatgcatggtacaatagtgtccgcacatagacccacatatttatggacaactggtttttgacagatttagaaaggtaattctgtggagaatggacaaccttttcaacaaatgattctagaacaattgtatgtccatatgcaaaaaaaaaaaaaaaaaaaagttcatctgtacctgacagaatacacaaaatgagtcagaaccctaaatacaaagtacgaaactataaaatttctagaagagaaaacggggaagtctttgtaaccttgaaataggcaaagcttccttaatatgatactagagcacagtctaccaatgaaaaaatgattaatcgacttcatcaaattaaaaactgccataaagtgaggggaaatacatgcaaaaggatttttatctggaatatataatgttctctcaaaagtcaataatacaaaacaactcagaaatataggcaaaacacatgaacagacacttcaccacagacaatgtacacatataggcaaaacacatgaacagacacttcaccacagacaatgtacacatggccaataagtacatgaaaagatggtcaacatcattacaatagggaaatgcaaattaaaactgtaaggaggctgcgtgccgtggctcacacctgtaatctcagcattttgggaagccaaagtgagaggattgcttgagccaagaagtttcggaccagcctgggcaacatagtgagacctcgtctctacaaaaataaaaataaaaaatcagttggtcatggtggtgcacccctgtagttcctgctattccagaggctgaagctggagaatcacttgagtgagccccagaggtcaaggctacagtgagccgtgtttgcaccactgtactccagtttgggaagcagagcaagaccttgtcttaaaaacaaaacaaaacaaaacaaaacacaaaatctcaccataccaagtgttggtgagaatgtggaggaactataattttcatgtattgctgttg

SEQ ID NO: 38073 - DNA, 1598 bp, Homo sapiens
aaaaaaactactttaaagttcatatggaaccaaaaaagagcccgcataagccaaaagaacaaaactggaggcgtcatgctacctgacttcaaactatactacaaggctacagtaaccagaacagcatggtactggtaccaaaacagagatatagaccaatggaacagaacagagccctcagaaataataccacacatctacaactatcggatctttgacaaagctgacaaaaacaagaaatggggaaaggattccctatttaagaaatgacgctgggaaaactggctagccatatgtagaaagctgaaactggatcccttccttacaccttatacaaaaattaattcaagatggattaaagacttaaatgttagacttaaaaccataaaaaccctaaaagaaaacctaggcaataccattcaggacataggcatgggcaaggacttcatgtctaaaacaccaaaagcaatggccacaaaagccaaaattgacaaatgggatctaattaaactaaagagcttctgcacagctaaagaaactaccaatagagtgaacaggcaacctacagaatgggagaaaatttttgcaatctacccatctgacaaagggctaatatccagaatctacaaagaacttaaacaaatttgcaagaaaaaaatcaaacaaccccatcaaaaagtgggcaaaggatacagacagacacttctcaaaagaagacatttatgcagccaacagacacatgaaaaaatgctcatcatcactggccatcagagaaatgcaaatcaaaaccacaatgagataccatctcacaccagttagaatggtgattgttaaaaagttaggaaacaacaggtgctggagaggatgtggagaaataggaacacttctacactgttggtgggactgtaaactagttcaaccattgtggaagacagtgtggtgattcctcaaggatctagaactagaaataccatttgacccagccatcccattactgggtatataccaaaggactataaatcgtgctgctataaagacacatgcacacgtatgtttattgcgtcactattcacagtagcaaagacttggaaccaacccaaatgtccaacaacgatagactggattaagaaaatgtggcacatatacaccatggaatactatgcagccataaaaaaggatgtgttcatgtcctttttagggacatggatgaagctggaaaccatcattctcagcaaactattgcaaggacagaaaaccaaacaccacatgttctcactcataggtgggaattgaacaatgagaacacttggacacaggatggggaacatcacacactggggcctgtcatgggttggggggaagagggagggatagcattaggagatatacctaatgtaaatgatgagttaatgggtgcagcacaccaacatggcacatgtatacatatgtaacaaacctgcacgttgtgcacatgtaccctagaacttaaagtataataataataaataaaccataaaaaataaaaaataatcccacttcaactaaaatttaaaaataaggacaagcaactatttgtgcagatgtgaagaagtcaatat

SEQ ID NO: 38074 - DNA, 1054 bp, Homo sapiens
cagacgtttgagatagccacatagagatgggaaggaaacactgggcctccactgtcccatcctctaaccaggatcagctgggaaccaggaagagctcactgtggtgaggaggtaagtgagaggatcccagcagccccttcaacactgtggatacctacagacctcaccaccagggttcccaccagtcctcacaggcactaagcccagctgagtccacccggctatgcaccccacagagaaggagctgacactgtgcctcaatccctgtggcccacacagctgctgtgctataccatcttggaattggagctgtgactgaagtgtgtcttgctccaggggtgagtagtcatggctcccctttgtccctaaggctaagctgccaccaaaccaccccagcacagtggccccacatctccaggctgagctgggagcaactgttggctctgttcctcgggggccagcagagatggagctgctccacctgttcttcccccagctgctttggactggagctgaagcagtatcctgccttttgggaaaacagtaccttgaacactcagagcaatcatgcctccccagtgtctcagttgaagcagcgccacgcctcccaggaagtggtgcattggccatccagagtgatcacacatcccagtacctaagctgaagcagctcccagcatcacagggaaatggtgcctggcccacccaaaagagtatgctccctgggcctgagctgaagcagcacattatcctttggggagttggtgccttggccagactgagcagttgtgcatgccagggatgagctgatatagtacaccatgtcccagagaaatagagcggtgactgagctgagacaccttgcccttacaggccgtagaactctagtaccctgcttgcttgaacctgtactagtcttcaagaagctcagctgcttagataaccttcctcttggagagtggaattatcactgtgctatcctcccctcccatgctgggtccacacaacagctctgctcccctaagctaggatacttgctgtcattgcactggact

SEQ ID NO: 38075 - DNA, 1109 bp, Homo sapiens
aagcttcttgccataacatgtgtatataatattctttgactttataagtatctcagggttgctgaaatgaaatacactcttattgcccattttcatcatgaaaggtcagtagctaattggagaatgcatttgcctgtcagaatgtggaaatatatggaacattcctgtgtcagagaaaggttaaaactttgcatgagtacagttaatctttgaaaactggtgggttcaaaaggtttttttttttcttccacattggaagagaggaagtattgtatatactgccaagatttgtcctacagaaaaggattatatggccccaaaacagacttcttttgtcattttagatggcagagtgaattttgttcattatgtttcttaaggattaacaattccagaagaactggaaaggggaaatagatgtttgagctgagaagttattatcttaccagttttaaaaaaatactgcaaatactctgataccttgtttttcatgtcctgccattttgtaaataaataacacttttcatatacagagactgtattatataccttctaaatattacatgtcaggggcttaagatctgatttttttaaagcacaaaatatgctcttaagatcatagtgtttgcaagataattcatttctatatccttggggtttagcatggggcctggcacatcacactgcctcagtaaatatttcaatgaattcaagaatgagcttaccttctgttgcaatgacagatgcagtcaaaatactgtgtggtataggagttattctttgggggcagagtgatattactctcagggagtcaaggacacttcacagagaaggtaggttgtgaccttggagctgaattttaaaggatgaattaagacttcatcagatggagatgaaggagagtcaggcaaatggatcattttccacagagagatgaaagagttgaatgactgaaacatcaggaatagtgggcaggagacttgtgagtgttgagctgatattagatgaataaattgtcactagactatgaagggcatgaatcacataagaaagttaggctttattctataatcaatatggtttctgttggtgttgttgttgttgttttt

SEQ ID NO: 38076 - DNA, 1027 bp, Homo sapiens
ctccgcctcctgggttcaagcaattctcctgcctcagcttcccgagtagctgggattacaggtgcgtgccaccatgcccagctaatttttgtattttcactagagttggggtttcgccatactggccgggctggtctcaaacccctgacctcaggtgatccacccacctcagcctcccaaagtgctaggagtacaggcgtgagccaccgtgcccagccctaaatttaattactaatagcttgctgttgaccaaaagcctcactgataacatagtcgattaatacatactttgttatatatgttatatgctgttatataagaaaatgttattaaggaaatcataaggaagagaaaatatatttactgtttattaagtggaagttggtcacatcaccataatggttttcatccttatcttcttcccattgagtaggcttagggggtaggaggaagaggacggttggtcttgttatttcagggatggccaaggaggaagaaaatttgcctgtaagtggatctggacagttcacactggtggtattctcagctgtaaatggaattaactcttgacacatggataaacctcaaaagcattatgctaaacgaaagaagccagacacaaaaggctactattatatgattccatttatatgaaatgtctaagaaagtcaaacatacagagacagaaagcacattagtggctgtgtagggtagagctgggcatgaagattaattgcagtgagcatgagggagctggcatgttggcaagcatcagtaatcccagctacatcggagactgaggcaggagcacccttgaccccaggaggtcaagtctaagcctgggcaacacagcaaaacccccatcttttaaaaaacaaaaataaaacaccaaaaagggaacatgtatttttaaaaacggcgtgagtgaattttctggggggtgatggaaatgacccaaaactggatgtgatgatggttgcacatccctgtaattttactcattgtacacttacaaagatgagtcttg

SEQ ID NO: 38077 - DNA, 1124 bp, Homo sapiens
ttgtttttcttcttagaaatcattgctttataggtaagcattctgcctctgctgaagccatgtaatttccaacataatcctattagtattgccatttgtttgttgggatgcatgttttttccccatagttgaatttcttcttttttgtaagtaatggtgatagcagtctgtaaagcttggacttattaaataactggctgtgattaaatccttagttgttttgcatttctacattttgcttaataactttgacaaataatgtatttgatttggaatcattcgcccaggttatgtcatggattctcaaggattgcctgtctgggaaggattctgttttcatcaggataaatgttgaaattgacttagtaattaatataatttcagtagtaacaatgcttctttatttcttctggaagcatttaggatatttctgattgtttaataacaatagttgcagtttattgagcacttactatataaatgccaggcgctgtgcgatgagtttttaaatatattttttagacagtctttacaataaccatgcatgatgtatgttctctcccatcttacagactaggaaggggactgaaagaggtaagggccaacagaagagggctcacaccctagttttgttgatgttctgttagtttcaccactctgtctccttaagttgaaatccagataaaatttagttttgcattcatgagaattttagagtttggcttatttaaagaactaacttttcatcgtgtaatttttacataattatttttagcaagtttcttgcaaagacttgcccaccttaattgagagtcgttggtacttccccacacatcttgatagaatggtgcagatggatttcaactttagtgccctctgacttgttttcttcctttcaaactaagccttttagaagtaagatatactttaggaggccaaggtgggaggatcacctgaggtcaggagtttgaaaccaccctggccgacatgctgaaacccctgtctctactaaaaataaaaaaattagctgggcacggtggagggtacctgtaatcccagctactgaggctgagacaggaaaattgtttgagcccaggaggtggaggttgcagtgagctgagatc

SEQ ID NO: 38078 - DNA, 1073 bp, Homo sapiens
aataagacaacactgagacaggaattgttttctctccacgtacctcctgttacctcctcccgtatcttgatttttagcctaggcctctctaggttcatgcgcttggcttcctattggtatctttacttcagtgtcacaaagacatctccaaattgataagctccagatggagctttgattcattttttcacctccctatctgctaccactgctctccagtctttcccatctcaataaatgacatcgccatccacccttgttatttacacaaattaggaccatccttgcttctttggctcacattccacatctaatccatccttcatgatttacctctagaatggatcgtacgtatctgttgtttgacattttcacggctgccgccttagttcaggcaactatcatttcctactctctttttcttggtctctctgccttttttcttaacttctttcaatcttttcttctatagtagccaaaataatcttaaaggttcacccagtcatgttactgcttgcttaaacccctgcagtggctcgtcatcatccttagaacggacatcagaagtctctgtgcagtatgaggtgttcactacctggtctagctccagccccttcctcctccccacccccaggtcatttcacccttactcaccttctgaaaccattctgatattctttcagttcccagggcttctatgtcttctttacagtgtgtgccctctggttggcatcccacagtgtttgctatattagtggaactttacaaaaattcttgggttctgtaaaatggccagttaacgggacagattgagaatcttagaatgtaatggccattagtagtcaacaagtcaagtcccccatctgaggcttcagcattccagtcagatacttgtacaggttaagattgaacaaatgtgacagaagtctaccacattcatctctggcaaacccaatgttagaaagtctttttcatctggaaaaaaatggttcaggtatttatagacactttccttgtctgattcaagtcctctaacctttaggcttcatatccctatttattttgaccattct

SEQ ID NO: 38079 - DNA, 1026 bp, Homo sapiens
taataatacatcagcagaaataaaagatttagaagataaaattgaaatgctttcagaaagtagagcacgaagattttgtaatggaaagtaggagagaaaatattttttaaattggaggacaagtccagggggtccaaaaatgagtgctaagaattctagacagagaaaatgaaggagaggaaaccatctgtgaaatgatttaagaaagttttccagcactgaagggcacgagattccagcccgtgagactggaaagtgctccacacgagggacatagaaaggcccgtgtcaaggtgcgtccttgtgaaatttcaaaagacttgggactagggtgaccaactggctttgtttacctgggactgaggggtttttcttgggatacgggattttcagtactaaaactaggacagtcccaggcaaaccagcatgacaggtcaccctacgggaacaaagaaaattctacaaagttaagagagaagccagaaaacaatgccttcaaaattgtgaagacaaacgagcacagatctagaattctatgccttgctgaactataaactacactagcaagtgtgagtaaaatgagaacgtttacaggcatgtgagatcttaaacatttacttcctaagcacctcttctcaaaaagctactagagtatgtgctccattaaaatgaaagaccaacccaagaaagaagactttaaatacaggagacgggagcccaacacataaaggagaaggaatctcttggaggatggtgaaaggtgatctcagtgtaacagcttcgtaccacatccagagggcaactgagccccactgcagcagcgtgagctaggaagtagatgatcatcaccaagacccccactcccttcaagccatcttttaaaaaaatgggctttattttttagagcagttttaggttcgcagcgaaactgagcagaaagtagagatttcccacatccccctgcctccacacatgcagagcctcccccattatcgacgtcacccaccagaatggtatgtttgttac

SEQ ID NO: 38080 - DNA, 1075 bp, Homo sapiens
gagaaaatgagaggctgggaattagagacacaagtgtagacagctcttttttctttccttttttttttttttttttcctttgagacagagtctcactccattgcccaggctggagggcagcgatgcgatctcagctcactgcaacctctacctcctgggttcaagcgattcttctgcctcagcctcccgagtagctgggattacaggcgcccgccaccacgcctggctaatttttgtatttttagtagggccagggtttcaccgtcttggccaggctggtcttgaacacctgaccttgtgatccacctgcctcggcctcccaaagtgccgggattacaggtgtgagccactgagcccgaccgacagctctttatggaagtttttgctgcaaataggaataagaaataaagcgataggtagggccaaaggaaagcagctactgtgttaacataggagaaaacaccatcatttaccaacgtggtggaatgtattggtagagtgcaaaatgtcgatgatgttggagaaggaagagttgagggagcttgtccttgagtcaggggggttagggtctagagctgagcaggcttagtgtagccgggagcccagatggttgctgtgtggcaaatggcacacagatgctgggtgggtgcatcctgggaagtctgtgggagtgagcaggcagaagaggtatcaaaagtataaggtgggctgggcgcagtggctcacacctataatcccagcactttgggaggccgaggcaggcagatcacttgaggccaggaattccagaccagcctggccaacatggcgaaaccccatctctactaaaaataacaaaaattagccgaccgttatggcaggtgcctgtagtcccagctacttgggaggctgaggcacgagaattacttgagcccgggaggtggaggttgcagtcagccgagatcatgccactgcactccagcctgggcgacagagcgagactctgtctttatttatatatgtatatatggcagaaggaaaaggtgtgagacagttttcacattttggctaaataggtaaataaaatgtgggcata

SEQ ID NO: 38081 - DNA, 1036 bp, Homo sapiens
taagctataaagtattggactctttggcactaaaaccccagattgctacaaaccgaaggctaaaatagaggtcagcaatcattcatattgtgtaaaatgtcacccttagctagcaatttatttttccatatttgtgtgtttagtgcactgttagaattccttttcctcacttttgttttgttcatggcacttcataattttatcatttcattttattttcagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttcttt

SEQ ID NO: 38082 - DNA, 1084 bp, Homo sapiens
tttaaacattatatgtttatcatttaaatcttacagaatctaggaagcctagaaacaggtcacttagcagcatggcagtgtaattgtacctgttgtcaatgtcgaaatggcttcctgcttgccctgatgacagccccacagccttcactgaggcatgccgcctgcaaccccccttgtggcccatcagttggggtgtcttacaggcaggtgctaggcagtgctactgaacctgcaacttcctgggtaaagtatcctcatgccttacgccatgtcagtggcttggcagtttgacattgcaggtgcactactcttgtgaaaagaatgggtgtgggttgtttacaagtcacagtttctcaagtgagtttgcaggccgaagtccccaggcaaaagtcaaattcctaaggcctgaggaaggggctagggtggaggatcagcaggaagaaaatcccttagttatgagggaaaaggttgcagaagttgtgttaaggctttgcaagtcaggtggaatatgatgcatgtcttcattctgcagacacttcccaagtgtctgctcgcgccaggcgtgcttctgagtgctgagagctcacacagagtcagcactggggagggaagagaggtggcaaccagaacatgagcaggtgagtttttgtgccacgtacagatggagacagcagcaccagtgctggcgtgtctttgtggcgaaggtgagaagattggaggtggatgatcatggaattgctcttccaaggagagaaagagccatgggaagattccaggatcagacgattctagacctgtgctgtccagtatggcagccactaaccacaggaggctgtggagcactcaggatgtggccgtgctgcagttgtaaaatacatactggacttcaaaggctcagtactaaaaagagaatgtaaaatatctcagtatttttcttatgttgattacattttgaaatgataatattatggatatattgggttaaaaaaatatactgtatgattaaaattaatttcacctatttctgcatgctgttgagcatggctagtagaaaatgtaaattatacacatcgttcgcattata

SEQ ID NO: 38083 - DNA, 1038 bp, Homo sapiens
atgacccacatatccatttctcttatcctaaaattctgccgtgccagcttccctgcatcactggtgggagtggccagaccctgcaccgcaagggttcagagcaggcctgtgggctcagcagaggccgggatttgaataacagtgtgactgtactgtcaggaaaaacatttaataagctagggagcgataatataattaatataattctctctaagctgattttacaattttttgttattattacttgtacggctgtgtaagcagactatcatgatagatttttttttttcacaatttgataccaatacttcagtagcaaagaaaatgaaataaacttcttcctgccaaaaaacagtacatttttcataaaaaagaaagatggaattgatgtaataggtgaagaacaattaaaacttgtcaaataaggccagtaagaaaaccccaacagttaacaaaatctgttttcaatgacatattacagaacaattaaaaagctacataaaaatcagtgttacctacttattagaaatacattttaattcacctgtagatccaaaaacatttagacatacagacaaaattttgtattaactgacaaaaaaacccacactacctattggattcatgttgcttaaagggtatctacagaattctcacctcaatattttcgtgttaaataaggtggaaatcaacagtccagagatggtcattagaaatgagccactgacaaacacaatatatttataacttgtataacatttcattcatgtgcatgttttgagcattgtggaatatttaatttgcatcaggctttccaaattccttaaatttataagatttgttctcagtgggagttctcagatgacttttgaaataattattaaaatgaaaatttatttgcaaactactagggtttagatacagaataccttcttgtatttaaagatccatctccagtttgcatacatcatgtctttcaatgtgccggagagaaacaaaggcatccccacgttctttacatttatagggttttttaga

SEQ ID NO: 38084 - DNA, 1035 bp, Homo sapiens
agaaacagtggactagccctgaaacagagtcatgcatgtgtgggcttctgacttatggcagtggtggcctgtggagcaatgaggaaaggctagccttttaaataaatggacataggaatgttcatgtagaaaaaagtgaaatttgaccccaacctcatattatacacaaaagtgaatgtcagttgaattgctgtaaatatataaggcaagccagtaaagctatttgaacataatataggagaatgtcttcatgatctttggggtagggaaggactcctttaaacacaacataaaaaaacatttatctgctggatgtggtggctcatgcctataattccagcactttgggaggccaaggtgggaggatcgcttgaggccaggagttcaagaccagcctggccaacataatgagactccccccatctccactttaagaaaaaaaaaaattatcatagaagattgatcaattttgtattaaaattaagaaatgttgtttattttaaaaaaccaagatcaagaaactgaaaagataagcatagatgtgagaagatatatgactgaaaaaaaatctcttgttcagaatatgtaaagaacaacagtcaagaagattataaagatagacaaacaaatagtcaataggttgtcacaggaggatacccaaataacctataaacaggaaaagtgctcaatgccgttattcatcaagatagtgcaatttaaaactgcgacgaaataccattccacactcagcagaatggttagaaactaagctgttggtgataccaagtgctggtgaggatgtggaaccacccagaggcagctctcagatgtgacccctcgtgtactggaaccacgcagaggcagctctcagatgtgacccctcgtgcactgctggcagctgtacaaatttgtagaaacgctctggcaaagagtttgacattatctactgaaatacaatggatacgttcccactcttagttgtctactcatcagaaacacatgcataggggatccggagctgcgtacaggaatggt

SEQ ID NO: 38085 - DNA, 1120 bp, Homo sapiens
tgtgtggcaaacttcttttacttgtgttgggaccaataaaaggctgcttcctagaagtaaaggtaactcagagattggcccttataggcactgccactcagcttcagattatcatctcatttgctgaacttgtatgggggtaaacaaaaattgctagtgcccccaggtacctagtagaaataaatttaaattctttgtggaagaagacagcatcatattagataaaattatttctagatagcaaacagttttatacgtgcaaggcccagtctaggcacacaaggagatatgacaacatgaataaaatcctgcagaaacagcagacaaaagaaacagatccataggagatattggcattattagatccacatttttaaatagctatgatattacgttcaaggtgataaaggcaagattaaaagttttggtggagaaatgaaaacttcttttaagaggaataaatcaaaattctagaagtaaaaactatagtaattgaattatgaatttaatatgtgtaacagcatgctagatataactgaagagagatttagtgacctggaggagaggtcagcaaaaagtatccagaatgaaagctgcagaggcaaaaatggtagaagagcccaaaacagagaaggtgttagttttctattgctgcataacacattaacacaaacttagttgtttaaaacaacacctattgattatctcatagttctatagtcagaaacctgggtgggtttgcctgggttctttgcccagcatctcacaaagctgaagtcaagatttcgactgggctgggctcagctcacagatggaggttctggaagggtatctgcttccaagctccttcagcctgttggcagagtctagttccttacagctttaggtctgtggttcccaatctcttgatctctttcagtcaggcgctgctgtctgctcccagaggctgcatgttttccttctcaagtgacctcctccatcttcaaggcagcagtggcatgcccagtccttcccatactcacatctccctgattttccaccctttccatgagccagagcaaactctgcctttaaagggctctcgtgataagaataggcccacctggataatctgcgtttt

SEQ ID NO: 38086 - DNA, 1081 bp, Homo sapiens
aaccatttacacctagcttgcccacagggggcaagctgatgagacgcacagagtgatgtagtcttttcatagccagtagtaatgcatacattcttttctccaaaggtggttattttctagtccagccccttaaagtgtggtcttgctgggcctcaaaattccttcctttcataatggtctggtaccactgaaatgtctgcatttttttgtgtcttgcttaagttcagaacttggtcagattgactttatcaacttacagccacattgtcttacataccaataagttcagaactctcttacgtgagctgcgtatgtacttccggtaagaatgcacgttcattctgtttttctttgaagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggtaagtatggtctgttttaatagcgtggattgagtttttgctgtaataaaaagtaaaactaaagtgtcaggatttagaaacattgatgattaaaaaaaaaactctgttataggtttatgagctaaattgaatcaactgcttgctctagttctgtgtagtcaggctgtagggtacaaacccatattcttagaatgctgcaggaatttaaataggtagcaagttttcttttttgtttgtttctttttcctttcattttttttttcatttctcctgtcattatgatatcagagtagtaggtatgacagtgagttgtaacagaaatttggagttttattcatttcttcatcatggccaccttttcccccctccccttttattcccgatcactcctgttcatttccaggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagccc

SEQ ID NO: 38087 - DNA, 1027 bp, Homo sapiens
agagacggagtttcaccatgttagccaggatggtctccgtctcctgacctcgtgatccacacgccacagcctcccaaagtgctgggattacaggtgtgagccaccgcacccggccagatttttactattattattattattattgtttaatatagagttgaagcctcaccatgttgcccaggctggtctggaactcttgggcttaagtgatcctcccaccttcggcctcccacagtgctgggattacaagtgtgagccatcttgcccagctggaaaacagaacaatttaatgaaaaaaatgtcggcagcaagcattgagacagagggtgattgtgagaatctgcttttaatcacaatagttagttgatttaaatatcgcatgtcctgggtactctgaagctttagtgtgatgaaaggttcacttgagtctgtggatcactgaatcgttgtcatcgttagaggaaaaagtgttttggtaggttttggtagggggagtcagcaaggtgaaatgtgcaggactgtgtgctggtcctggccagcccatgtgcaaatagcttcactttctaaagggatatcagaatggtgctttgggaggaacttgaatattgtggtgaaacactcctaaattcaaatctgagccatgctgggaatttggacaacttccttactggacaacttcctctaagcctcagtttcctcatttgcagagcggggatagtaatatgcttctcactagttgttataagggtgttgataaatgtgtacctcagagccaggcccactctcatgcctctagccttatctgcctgaagcccgtcttccatacaagtgtcaaatgatcattctgcagcttttcatttaacatgtgttgtttaatcagtttttaaatgtgaaatatgtacatttgaaaaacagaatagaaagttataatgggaagaaagtttctcatttcccactatttctctacttgccagcattgtgtatgtgcgtgtgtatgcgtgtgtgtgtgtttacgtagctgggcatt

SEQ ID NO: 38088 - DNA, 1059 bp, Homo sapiens
ccttagggtggtacaagtataattctagaacattcccagcccaggatgccaggaaagttcagtgtaaaagactctaacagattttattgagttgttccctccctcgcttaactgtggtctttacattgaccacaatttgaccatgtccccacagggaactttctggttgttgtttttttctttctttctttcttcctttttttttctttttgagatggagtctccctctgtcacccaagctggagtgcagtggcgtgatctcagctcactgcaacctctgcctcccgagttcaagagattctcctgcctcagcctcctgagtagctgggattacaggcacgcaccaccatacccagctaatttttctattttttaagttcagacagggtttcaccatgttggctaggctggtcttgagctcctgacctcatgatctgtccagcttggcctcccaaagcgctaggattacaggcgtgagccactgcgctggcctctggttgtttttagaagagttaatgttatgaaaagtttcacctaggctgggcactgtggcttatgcctgtaatcccagcactttgggaggccaaggctgtggggatagcttgggcctgggagttcgaggttgcagtgagccgagatcacaacactgcactccagcctaggcaacagagcgagaccctgtctcaaaaaaaaaaaaaaaaaaaacatttcacctaaacatgaatggtgataattgcacaactctgaatatactaaaccactgaatcgcatgctttagatggcaggctgctacggtacatgacttatgtctccagaaagctgttaaaattttttaattgacattaaaagatgtattagtccattttcatgctgctgataaagacgtgcccaagactgggcaatttacgaaagaaagagggttaatggactcatagttccacatggctggggaggcctcacagtcatggtggaaggtgaaaggcacatctcacgtggcggcagacaagagaagagagtgtgtgcagggaagctcccctttataaaaccatccgatctcat

SEQ ID NO: 38089 - DNA, 1063 bp, Homo sapiens
atacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtg

SEQ ID NO: 38090 - DNA, 1050 bp, Homo sapiens
catggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctca

SEQ ID NO: 38091 - DNA, 1061 bp, Homo sapiens
agggtagaccagaggcaggacagtcaaggagttatggtctggagtggcagctggctgggaattggggagtgtttcagatcctttcaagtaatgtggtctggtagagcttggaggattggtgggaccatgcctttttctcactggtttgtgtcctggttccttcccagagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtataaggatattcgtacacactctctttactcagattcacctgttaatattttgctccatttgctctctatgtgtgcagagtatgtttttgttctgaaccatttgagaagttgcatctatcctggtcctctacttctcaatacttcagtgtgtattacctaagaattggaattaatcagttatcactgatactttaacctactgtccatattccacctttgtcattttacccaataacgtctttttaaaaaaagttttttgaggtttcattgacatacaattgatatcaatatgtgcaaagaactgcatataaagtgtacaatttgataagttttgacatatatgtgtgtgtgtgtatatatatatatatatatatacctgtaaaagtatcaccacaatcaagataataaacatatccacccttctagaagcttcctaatgcccctgtgtagtaactaccctactgcccttctctgcctccatccccaggcaacaactgatctgctttctgtaatatagattagtttctattttcggcagttttatgtcaatggaatcacagtgtatgtgctcttttttgtttttcccaaaaagacccatattgtgtaattatttggagattgtgttgtgtatgtcagtggtttattcagttttattgctgaatattattcca

SEQ ID NO: 38092 - DNA, 1565 bp, Homo sapiens
ctagaacatcttcatggaacacgccctcatgatgcaatggccttgtggcacttactgtggaggcctccacctggggatcctcagctcgcctctctggccttcctgacattctttctttaggcagtcccacaactagtatgttaggtgggctgggggctggtggaaagggaccacaagcatatacccattgtaaggttagttcttcattaattaaccagggattcaaaatcttaccagaagcaaaatggtgggtggggcagagaaaaaacaaattcagcacatcactgtgaagctgtccttggcgctgggagttcttaagggggtaggaggcaagcagatctggaacacttatttcctgtcaggacacaaccattttattttttatttattgtaacttttaggttcaggagtacatgtgcaggtttgttatgtaggtaaactgtgtcacagggatttggtgttcaaattgtttcatcacccaggtaataagcatagtacccaataggaattttttctgatactcttcctcctcctgcccttcaccctcaagtaggcctcagtgtctgtttttcccctctttgtatccatgtgttctcattgtttagctcccacttgtaagtgaaaacatgcggtatttggtttttccgttgcagcattagttctcttaggataatggcctccagctccactcatgttgctgcaaaggatgtgatctccttttttatggctgcatagtattccatgaacacaaccattttaaactaagggattaggtgactgttatgaaagaaactaagtaatttgtgctttaaggaattcatacaaacaggctgtcatggttcctgaaccagcctcagtatcaccagggcagcatgtgagaggaagttgaggcagtatcttggcactgtttttagccactgctctataccaggcctttatatgagtgcttttgcttctaaacatacgcttttggtttttaacaaaaggaacctgactgtatatacatgatattggcacatttgcatttagacagtagctcacctttctgtaaaagtccacatacatctttctgcattctttctaagggtttcctagtacactcattgtatagttataccatactttacttaaccccctcatgataaatgttttggtggtttccagtttttgttagtatcaacagtgttgcagtaaaatacatttttctctcctgtatgttatcctacaaatacatttctaaaggcagaattgctgagttaagatttgcttttaaatttttgctacatactggaaaattgctctccaaaaatattgtaacaatttatacttttgacaatagtgtatgaaactttgtttctccacaccttcacaaacactaggtattatcaacatttttcaccttttaccaaactgatggttaacaaatgctctttttaaaaaaattttattttgaaacaatctaaacttgccaaagaagtatagtataaaactttttccttcctgaaccatttgagaataagcttctgatatgatgccccatcacctcagaatacttttgagtgtgt

SEQ ID NO: 38093 - DNA, 1047 bp, Homo sapiens
gtcatattcattgttgtatccctagtacttaaaaaccggtacatggcacatggtacctgtcacacagtatgttgtcagtaaatgtttgtcaagtgaatgttgttcattgttattccagtttgtttttgtttttttttaagagagtgaataggtgtccttttcattttcttggtttagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttca

SEQ ID NO: 38094 - DNA, 1056 bp, Homo sapiens
tcttcccttctgagacttgtccctatatttagtgttacactagcctaatagactaattgtgtcaatgactccaagccagtccctgccgggtttgattcagaaaatcagcctcccttttagtatcgcctttgctcacctcctcccctacgacaactagaaatctcttctccactacttggcatgagaatgttctatttcagttttttactttaaggaaaaatcacctttcattcttatttctatatttaagcaatagaaccaactcacgttaatcatatacattcctaatattcataagacaaatgcaacagtagctagaacacaaaccatattctcttctcatctgcatatcacttctctgttccttagtcccatctttcctttgtacattttgcccctcctaggtactctttgttctgggttggtaagcattttgtcactttctcttgtcttgtttcctttctttgctcatctccaaatcaaagacagtatccaaggatttaaggtgtagaatccacgcgtgaaccttgaggtggtagattgtcttgtggaatatggttggactctgcaaattgaaagtcgttccgggctagttgcagtctgttaataggaaggggttttcggccagagcaggccacggctcctctctaacgagttgtctcggctcttgaaaagtggctcctgagtctcggaggcagagacagcaagaatgtagggccggttcttaactgtttgcattcacttttctaggccttggcgataaagcatgaacaagaagctcggaagagtgcccagaggttgttggtcgtatgtagtttggaaggagtgggtggcgttctatgtctgacgcttttggctgatgtaaccaggctattagactcatgctgcgtgttgaaaactggttagaaagggcttgtccattcagcctttagaacttttaagaaattcaggagtttctgggtctttatatggaagagttgtgttttgggggtaattccttacttgtgtcatcagggacacatgacttagctaccaaatcagtcttgattggattat

SEQ ID NO: 38095 - DNA, 1001 bp, Homo sapiens
catgaaaagattcagcgagcaactagacagccggctcgttggtctaggggtatgattctcgctttgggtgcgagaggtcccgggttcaaatcccggacgagcccactttttcatttttttttttccatttcaactgaagttcttcttgttcaaatcctggatgagccagctttttaaatttcaactaaattttgtgttaccttgacagttttgatcccgaaagatgtccagcggaggcatcaccaagatttccgggagtgctggggattggaaagaatcgtggataggagactaagcgagccgtcccggaagcaacagttgctgtgaagactttgggcacagacctgcacgtgagagtatgctcttgagggttgtgggggctctccttttacagctagggatcacttgtcgaacgtacccggagagtagctgctagcagacaatattatggcgacagaggtaggtgtgggtttccgtagtgtagtggtcatcacgttcgcctaacacgcgaaaggtccccggttcgaaaccgggcggaaacatgccacagtgttttttttttttttcccccccctttcttttgagatggggtttcgctcttgttgcccaggctggagtgcaatggagtgatctcggctcacagcaacctccgcctcccaggttcaagccattctcctgcctcaggctccggagtagctgggattacaggcatgcgccaccacgcccggctaattttgtatttttagtagagacggagtttctccatgttggtcaggctggtctcgaactccggacctcaggtgatccgcccacctcggcctcccaaagcgctgggattacaggcgtgagccaccgcgcgcggccccgaagcggttattatctcattacacgctcttattacactggagactaacctagaagatcccactagtatgtccacctggtggtcacagcggcacaaagagaagagggcatctacgcttttgctttccattcccaac

SEQ ID NO: 38096 - DNA, 1057 bp, Homo sapiens
cggggatcgaacccggggcctcatacatgcaaagcatgcgctctaccactgagctacatccccacctactctcagcagctctcccagatggtccctattggtcgcttaactcaggacaccgggagtggaaggcaaccggtacgcgctgggtctcagccgctgcaaaaacccggcatcgcagggcaagagttgttccagcgtcctccgctgactccaaaccagcgggtcttgaccaagggattccaagagagaggattaggcccggctaagcacctgggagcagctgtggaaaaaggagagacaatcatcaggcacgatgccaaaaatgaactgtgacctgaaaaagagaagaaaggaaaattgtgcaggatgctacgttttgttttttaaaagtgggggttgaggcaataaaatacggaatatttgattaacgtaatccagaattgtaaagttgattgctcgggaggaagaaaggactgggacacaggcgatgggcctactttccaccgtgaactgcggctcctcttttgaatttcgaaccaagtttaatccaagaaaaccttactgagcttgccaagaactgctctaaaaacaggattcagccgtgaacaaacctagtacagtccatctgaaagctgacattccagaggagatagagtgcgggcacagagccggccctgagaagggagcgcgctaagagacgactttacacagtgtgcgcgttcggggcgggcttcgtgggcagagacgtttgaaacaagacctgaatgaggtgggagggagcatgcaggtggtgggagaaaagaggtccacgcaaggggaacagccagcgcagaggccacggggttcaggaacagcaagaagatcggggacactgggtcctggaaggccctgagaagggaagtcgggaaggagggagcatccgggggcagatgaggtgaggcgaggtcttcgcctttgggtgagaattgctgaagttcccggtgacattggcaagggcggtttctgaggagggtgcgggcgaaagcttgatccaagtggcctccagagtgagcga

SEQ ID NO: 38097 - DNA, 2707 bp, Homo sapiens
agaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggtacggactaaggtagatttcaggacccgagattgcagggctgggggattccgcgtgtcgtgtagggaattccgcgtgtggtgtggcaggccggtggcgcgcgagttggcggggactgacagacttctctgccccattgtgaattggggcgtgcggacccgagcctaggcctcaacccgggcgaaccacattgcagatgagaacctacgtgtacatcagctcgcagctgctaggagggttggagagttggaaacttttaaaatatcttttgccttctccttcgtagtgtggccgggggcctacgggccgggcggggcggtgatgaccccaacatgccatctgagtgtcggtgctgaaatccagaggctgtttctgagctgccgcccggcccaaggctcgtggggaggcaggtggactccagaggacctcgtggctcaagtgtcggcctactttttctgcccctggttctccccgtccctatccctgtgttcctgactgcgtttagacgcttcttgtgcttccgctttgctgctacactgttaagaattgtctgacttttgaatcatgtctggctgttaatcgtaaaatttgttgagtgggacaggtttcagtaaaagcatccaatcctgtagcgcctgaagtggcttttccagcattcattactacatttctgtcggccctcagaggtaggcataggaggccccagctactctacagccacaaactgctgtgcatttggttgcagagaagacacaaagtggctgttgagttcgtctgagtttcaggaaagggtgtctgtatttctggcacctaaattaagttctcaggatacaggctgggcgcggtggctcacgcctataatcccagcactttggaaggcagaggcgagtggatcacttgagatcaggagttagagactagcctggccaatggtgaaaccgcatctctagttaaaaaattagccagacgtgctggcaggtgccagctggccaagtaatcccagctacttgggaggctgaggcgggagaattgcttgaacacgggaggtggagtttggagtgagccgagatcatgccactgcactccagcctgggcgacagagcgagactccatctcaagaaaaaaaaaagttatcagggtacagtttacctctacgtgcgtttttagtctggaatagagccactcagtcctggtctgtaactgctcttgtctgttgtttccatccctccttaagcgtccttagttgttgttaacccactcatgaccttgacacttagtgaattatccagtgtgttaaacgggctgcgggttcctcactgatttttcttctgttttacctcctttagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagtagctgctcacttagctctggggccttgggaagaatctgggcagaagtgaggtggatgcaattggctggtttcccaggggagatccagtccatttgggaactggaaagcagagcacacctacagaagatgtttggcctccctcactttaaataagttactcagcattgctgaggagtgtggctgaacatttttgccaggtgcaaaagttctgagtgggcagcagtttgaacatgttttaccttgaaagctcaggtaattggcaggtggaattagagggtcctggtgatgacagatggcattgtcagccaatccccaagtgggagtgaggacatgtcctgcaattctgaagggattctctgtcacttggctcttctctttcatatactcagtcacttgactctgtgatcagagccaaatccagggttgtatgagtgatgcaatgagacagagacaaagcccaggaaatgagtctgaccgttgaatgagagtgtttgctaagtctgagaatgacaaactcctccctctcaggggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggtaaagtgagccatctccaaggatctcttccaccctcttaaactttgctttttttttttttttttggcgacagtctcactcttgcccaagctggagtgcagtggcgcagtctcggctcactgcaacctctgcctcccgggctcaagggattctggtgcctcagtctcccgagtagctggtactacaggtgcgcagccaccacgcctagctaattttttgtgttttagtagagacagggtttcaccatgttgcccagggtggtctcaaactcctgggctcaggcgatttgcctgcctcgccctcccaaagtgttgggatta

SEQ ID NO: 38098 - DNA, 1050 bp, Homo sapiens
gctcattgttttaaacttaagtacagattttaaaaatgaatgccagctttgatgtaatttaacactctatatcttaaatttttccccacaaatccctgcacgaacaggaattctggcaagttatgcttagtaagagatgtgtgacctttgagactagctgttgtcacttgacattcagttgctgcagactgcccggaaaggtcagttttctgtcttggcctctatcctctcaaatctccctctctgatcttccaggaacttaaaatgcagaaacctagtttgagataacattaacatgttagaatttcagctcagttccccaaccagctagccttgccaagtcaggaaatgtaaaagttcaagttctcagagttgtaataaccccacagacctactgtggtgtgttttgcatgattttgtcatgattagaggcgtcctagagtttgtatcaaatgcacacactgcgtgttccccaagtggccagcgtggtatgggttagtgaattaagggctttggaaatactcacttgcttttgctttctctctgggatttcttagaaaagtcattttaacctctcttctctcatctgtaaaatgcctatctcacagggttttttatagtattaggtgagatgatataagtgaaagtgttttttatgaacactaggcatttctggaaatatgattatattttctgtctattcaagtaaagagtattaatatgttttgaaagtgaatggttagatgcatattaacttatatttactcatcttgctttaatatatattacattggcattttgtactttgacatcatgaagcaagtaattacagattttttttttctttttctgtgaagtccaagggcatttgatctctgccaggctatggagtcggtatacatcattgcagtagcgcctttgtgacattcagtggttttagaatctagcaggtctgtaaatttcttgaggtttttgtggggagaagaagctttagcaatacagagagcctatattgaaaacatcggtaaaacgtccttgccttattctatc

SEQ ID NO: 38099 - DNA, 1049 bp, Homo sapiens
tagctctgtttctgtcattagcaagatttggggagattaccttagtcctggggcattgtgcagtgagcgtgagtggtcaggacctgaagctgggtagccaaggctctgtccatacctgccgtgtctccgggctggggtgctgctggtgcagcagatgaggcacatgtgagagcagggctgctgctcctgagaggctgcctttcctgggccccaggcagacccctgctgcacacctgttctctctgcccatggtgattattattttgtgtgtctgacagagtctcactctgttgcccaggccagagtgcagtggtgcagtctcggttcactgcgacctctgtctcccgggttcaagtgactctcctgcctcagcttcccaagtaactaggactacaggcgtgtgctaccacgcctggctaatttttatatttttaatagagacggggtttcgccatgttggcgaggctggtctcgaacgcctaaccgcaaatgatccacccacctcagcctcccagaatgctgggattacaggtgtgagcgactgtgcctggcctgcacaaggtgattcttttctcagatcaccttccttaaacttgagtgtttccagatctcctcagcaccatttgtgcttttccctggattcctgctagtggctgtttttgtttattgggtgccagctctttctagtttcagtctcagcagagaattctgtttccaacttctggagctgccttatgttatttggacacaagacagccgtaaattctgctgaccagggtgtgcatgtgtgggcaatgtgtattttatcattttagttttatttcagagaacaccttagcttccaggagagttacatgtgcaacatctcggagagtgctgagctcaggttcctggccattcaggtagctcaagcagcaggcacctgaaagcactccgaggaatggccaagccctcatcgcacagccagagctggtcacagtgctgctctgcacaccagcctctagtcataaaaataaggaacacactaagaatcacacccctgtgatccc

SEQ ID NO: 38100 - DNA, 1025 bp, Homo sapiens
cacagtgagagcaaggttggcaccacacagattgccatgagggaaaggaatatttaatctgggcagcctctgttcggaggaggtggggagagaaggcagtcactctggaatattccatgaacagagtggagcctcgaagcctggagcgcaggcagggaggtgcaccgggcggagaggcccacaggggctgctcggtgggggggggtaccctgggcgaggaggggggtctgggaagaggggtgagggcaccggggcatgaatggcctgcaggtaaaggcccagaactggcatggccttggcatcacacttgcaaacgctgaggacctatcctggggagaccagagactagaaggcaagaagggctggtttccaggtgcctgcccaggaagctcctgtgctgtgggctgtgggcggctgtggaaggccctggggcttgatttaggcctggggatgctgggctggcggctgcgagggaagagcagtcaggagcaggaaccactgcctggactggacgcctcagggacctctccatggaagaattgaacaaatgaggtgacaatgtgggggccatcgccatcatctccttgtgactggctgcggtggcttgggttctccagaagcagaagcagcattaggggtgcagacggcacactggggggtttacacctgtgacaagaggaggaggccgctgggtcctccaactacagctcggtcccacctcctctccaccagccccatgggcgctgccagcagggactgcccttctgaggagccagggttggggaagggtgcagagatgcccggccctgtgccccaacctcacctgggtgtgaccagagtagcacgtacctccagaagaggctggagctcaggggcacccaccatgctcccaaactacctctacaaaaacgaacaaaaaactgcagtgcacctctgttgagcgatatgatctgattgaaatatttgtcacgcagcacgccctctttctgtgccaagaatcgccacgtgcatgtcccttttttact

SEQ ID NO: 38101 - DNA, 1071 bp, Homo sapiens
ccaagggatgatcctcagaagtgtgttctgctgggttcctccaaagctctcagtgagacccagctccagttgcccatagtggcaacccagctcaaccatgccctcctaacaccttttctttcttccctgacctttctgcctgcactcaagtcttttctcagtttgcaaaaccaggatacacaatatttagtatctcccaaacgtaaaataagtggagtgcaaaattcaaagaaaattcaggatgcatagtagtgtttagagaacaacatggggctgtcatgatatattagacacttgctttcccttccatgaaaaaaaaaaaaggaaaacaattgctctgtgttctaaagaagattcattatctgctgtctctttacttactgcatacatacacctcagacttctgcaatttggcttcagaccccactttccactgaaactcctaatcagtagcctctaaatcttcttctccatgaggatggactttttttccatttgtttgtgtcatctctgatttctttgaagagtgctttgcattctcattgcaggggtctttcacctctctggctggctgtgttcctaagtattttattctttttgtggcagttgtgaatggtattgccttcctgatttggctctgagcttggctgttgttggtgtacagaaatgctactgatttttgtccattgattttgtatactgaaactttgctgaagttgtttattagctgaaggagcttttgggctgagacggtggggtttcctagatgtagaatcatgttgtctgcaaacagaggtaatttgacttcctttcttcctattaggatgccctttatttctttctcttgtctgattgcgctggccaggactttcagtactgtgttgaataggagtggtgagagaggtcatccttgccttgtgccagttttcaaggggaatgcttctagcttttgcccattcggtatgatactggctgtgggtttgtcatagatggctcttattatattgagggcaacctaggcaataccattcaggacataggaactggcaaagatttcattacggagatgcc

SEQ ID NO: 38102 - DNA, 1030 bp, Homo sapiens
ctaatgggtgaactttctcattgaattatatacactaaatgggtgaactttatggcatatggattgtatctcaataaagctgttgaaaactttaaaggagacttctggtttacttgtttccagtcagttccatgtgccattaactacatccaaaggctgtttcaagaaaattcctcaagttgtttaatttctctactttcttgtcccattgcccctagcttccccggtctgtctgtctgtctgtctgtctgttgtctgtctctccttcttgctctggctctggccagcactctgtttcatcgctggcctgctggcaatcactgtgaaagccacatacctcccatctgttctttgcccttagtgattttaccaaagtgaaaggttttatgtgcttttgctcacaaagccgcttttagtcccatctgttaaaccttggaatctagaaacagttcatgtttccagtactttaagacttggaagttttggactttctctgttcatttttatggctgcttgtttcacactgaatgactctttcctgagaccacttcttccttgaaataccttgagcagtgcagccaacacatccaagtaacatccagtggcacccagttctcctatgtcctgccctagagctacgaggacaggtggcacttggcctgccttccgtgtattataagcagtagctttcccaaacctcttcctgcagagtatggtagaagtttgcctttcctgcctcctctaacagattccttgccatgggctactcaaagccacatattttagatcgaggttagggcagctcccctcttttacgtctcatttctgcattaatcagggcaattactgcagctggtacataaaccctgagatctcagcagcttaacacaacaaagctttctccctcaccccaaatcctgcctgggctgcccagggctcacattccggcagtgactcggggattctgactctactttcatgttatcagagctgtggcctcccaggtccctcgggtggggggaagcgagga

SEQ ID NO: 38103 - DNA, 1433 bp, Homo sapiens
ttcagtaatcagggtgtgaaaaaagcagacaagttgtgtgtgtgtgtgtgtgtctaagaaaacttgtgtgcttttcaaaaaggcagtgctaagcacaagatttcaagaaagcctcttcttgttgcctagctgagtgggagagtcattttccccagacactacatttggatacaggtgccaaagaacattattaaggaattatttagaaacaatgtgtctagtttaagaaagtggttttcagtattgtgacaatacaacgtttttacaaggttgttttctaccaccatattttaaagatatttttatgaccgtgtatactcacactttgcttgtattttaaaaggaggatatatttgcacttatgtatacttttacagtttgccaaaatattttgttgtaaaattttttttcaataaaatgtatataacaaatagttgttttaggggctgattttctcttcgggcaccctgagagcaatggatgccagtttctcctccccggcaggcagctgtgcaactctacccacaccccctccagtggtgtaactgacatggtgtggggtctgtgccttgagtaacacaggccaggttctgattgtgagtcttctcaggagaaaaacagtggaagaaacgttttctgttatttctttctttacttcaccccagctttttctggcaaaacaaaaaccagaaggtgaaaggaactagaaagaaaaccaggcaagataccgaccagggtttgattttgaggaaaccaattttgtgccccttctgttttctttcctgtgcccggggagtgttctgccctttgccctctctccctcccgactggcatgggttgacagatgtggggcacagtggtaagcccccctccagggttggatgcccaaagaacagcaccctgcttcttccctttgcacgttgcaattttgttatgggtggcggtcacatgctgtcagaaatggggttcagatctgaagaatgcagggggatccctgagctgcagggggcaggctcccagcagggggtttaacttccttggggagtttaatacagaagctggactccccacacgttgctctgtggctgcggcctgtcccaccctccaattcagagcctggctggccctgctcagcatcggcacatagcaagccggttcagcccttccttcctcccggcctcctctccccactcctcccttttaaccagggatttaacaagggaacccctcagcccctttttctgttcctgctagatttcccagtcaccagtgttacaggcagagctggtgacgctcccgatggaagagcaaaatgggccaactaggcaggaggactgaccttctgtcccagcagcccttcaccatcacgagccatgttggggacaatgggtctgagagaagcagagaaattatctgctccaatcatgctgtgc

SEQ ID NO: 38104 - DNA, 1049 bp, Homo sapiens
tcctctttccttcgatgtcaatgtccattatgaaacagtaatttttaaatattcaggtgacacggagatgcgcctgctacacgtcagcgtccttcacatgtaacagccgaagctgcaatttgaattttcctgccaacgtgaggaagccgggattcgaaccggggagacaaaaggggtcccgaacatgtccttggatttaatagatggtcggaaatcaggggcagcggagctgttaaatgcgtcacgcacgcttcttcgcagtctcctgagctcgccacttcccccagcttctagtgaacgacttgggattcagcctccgggagggtctctcctcaagtcgctaaaatgcagaatcgccgtgccgggggagggaggcctggctctttcccgctccttcgtttctttccctcatttctcttcttcctgtcccattccaaccacccagcgacggcgaatctcaggcgtgtgcacaacgagcgggggcccttccgtgcgtgtccccccagaatccttgaaccgccctctaggtgcgaccctggacgttcccccagacacacccgttgtctctgcgagccggcagccccgcgcatgtggagatggagactggcctggggaagcgttaagctcttagacatatttatttgcttcttgtcatcacacctgctaatgtcaccgagcccgcagcctgacccctcatctgagccgaaacgggcctgacgggatcagagggggcggcggcgcggcgagccggtgggaccctcgcgggcgggcaggggagcgcggggcagcagccgggctccggcagccctcgccgcccgcaccctcaggccgccaagggccggccccccggggaggggggcgagaagcagggcggcccgcagcggggcgggctcatccttcgcgggtgaacggccgtcggaaactcccagcagggccccgcaccccttgccttcatttcggctggggaggggtcatggaggggggccagatgggcgacgaaccttcttccccaccgcgagcagggcctggctgtgaccgagccctcaaaa

SEQ ID NO: 38105 - DNA, 1019 bp, Homo sapiens
ccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgc

SEQ ID NO: 38106 - DNA, 1515 bp, Homo sapiens
ggtttattatgctgggcctagctcgctcgcaattccttaaagacaaagggcagcagagagagcccgcgacggggcctggcctacccgggttccacgcacctcctgcacaaactcgggcaagattgctttgccatggtatgtgagtttaactgaaggtttaactttctcagtttttccttaaaaatatcaaggtggaagatgttttgtaacatttgaaaccaacagccaaagtctggcagagcaggaaaaaataagtttactgaaatttaattgagatttaagatagaagaaaccctgtaataagaattgtcttgaaggatgtccaaatgaatttctctcatagcacagaaatagataaaaaatgccgaagtaaatcgattctccttttctccttttaaaccacatacaccaggaagccaaatgaactcccgctccttccattactcagggtgcaggagcagtgagaaggttgcaaccaaaaatactttttagtttccttcaaacatggatgctgccatccgtttggagaagtagaattcaacatcatggctcaactggagctgcataaacccctgcctagaatctctcctgattctaggtgtccaaacaagcaacactgaattaaacagggccatggcaagcctgagggcccctggaatagtctctcctgggtgtgggaagggaggttccggtggtcagaggagagggggtgcctgcccatcagggtcaaggctaagaggaatgtgactctttgtgagatttgttggaggatgtgtgtgacagtgggtttgggagttgggtttgcaagtgtttgtgagaatgtgtgactgtgagatggcatgtttgtggagtgtatgtgcacttgtgaatggatgtgcatggatgtttgtgttcgagccaatgtgtgagtatgtatctgtgtgtgtgcccactatcccgcccaggctgaggcccggcctcccagcaaccatgtgtttccaattagcagcatcccgcctgggagtgcagagaaggcgagtcctgggacagcttctgaggagcgggtgggctagctcaggccccccagttctgctccatcgagggcgaggccgcccggccagcaagctttcacagcaactgggcagccacacaaagagccctctctcctgcgccagtcgttggagactcggtcctcccccagatcataaacctgcctgtgaagacgttcagaaatagtttacccgcactcacacacacatgtgcaaaggctggaattccatttgctataaagttttattttattttgcttggaaggggagtgagggggagaagtgtcctgacctaatttgttctagggcaaaatactgtatttcatgtggaggtatacacctgtacatgaatccttgcttgctgcctgtgggtgtcctgcacatgtgtgcgtcagcctacctgtagctgtacaccatacacagctcaggagcacacacctgtggtcttacccaggccacctaaatgatgcatgcaaacaaaccagat

SEQ ID NO: 38107 - DNA, 1031 bp, Homo sapiens
tttaatgaccttatttccaaatacagtcacattttgagctactaagagttaagacatcaatatattaattgggggagggacaaaattcaacccatgattgacagctagagggaaaaagaggttcttttttttaactgtttgtgggctcggagggaggaggttggtagtggaggttgttgtcattttcccagtagcattagggcaacttgaacaacgtcagcacagggtctggggcagcataagaagattacattaactagaagtaaagcgaccagcggtagtggaaagctctaagggtgatggctcagttgtgttttcctctaacacagttctcatccctgggtgattttgcccccaggggacatttgacaatgtctggaggcatttttgattgtcacaaatggagttgtgctataggtatctaatgagtagaggttaagtattttgctcaccatctgcagtgcacaggaagctcccacaacaaagatttttctagcccaaaatgtcaatagtgctgaggctgagtaacccttctccaggaggccagtgaaagatgttaacaagcgggtggttgaactgacagacactggctatactatacagtgacttcatggtatgtcagaagaagcaaatacatttggtagctaattgttgatgctgatacctttactcacaaacttggctaatctccagaaacatactagctgctgagggtatagcagtagaggagaaataatcttcaaggggctataatctgaaagggatatgatattgaatcattttatgacttttcataacattttcatatttgttttaatatgatacaaaatatagagaaaagagtgaggcctccaactccaagtcctctaattggataaaagtcaatcattctgtacaagactaaatatgtggaataacatttttcacttctttctttcccatctcttgccactgagtgcatgccagttattcaagaacgattctccagcattccctttaaaattctctctcctctccttttttaaacattt

SEQ ID NO: 38108 - DNA, 1095 bp, Homo sapiens
gctggaaggtccacctccaggctagctaacacacagttggcaagtcggtactcactgcctctgtgtgggagctcagccacagctcagagctaggcattctcacagcacaatggctggttcccaaggccaagtatcctgagagagagctaggtagatgttgtattgccttcagctgtactttgttagtcaaggcagttgcaaagtcatgtgcaggctgaaggggagggaacagagactccatgtgaggacacaagaagaaggcagccatctgcaagccagaaagtaaggcctcaccagaaaccaaattttccaacaccttaatcttggacctcttgccttcagaactgtgagaaaataaatcctgttgttcaagccatgcagcctgtggtacatagtcatagcagccagaacacattaagacaaaccccgttaggccttgaatgctaatgtcaggcaaagacctagcatattaaggccgtttttagacagagagcttttttgactaccacagtggtaaatggagcatgccagtcatgtaaagaggcccatagggtagaaatccctgccattctagtattcttacgacaagctgactatatgcaggcagaacaaagggacagatgccccactagtgattaaggaaacaatgtgccttggggagacgggaaggctctagaatggtatgagcaccttcagatggataggcttggattctagaaatccttatgtggatgggtagagcccaaatggccagcacctccactcatgcatgagaccagtgcataagagatacacatcatagagttttcatctgctactggggtctggctcttacacctgtatgaacatgtgtagagcctaggtaggaccatcctatgaatgaatgttcaggagtcacccatccccatgaatggaaactaggactgatggaactaggtatttcctgaacactcaaagtggatcaacctaatagtgaacaaaaccacatctgacaaggagaaggcatagggactacctagtgttaggaaacagtccccgatttctgactcatcctgctataagccaacttctttcccacaagacagtacaggacac

SEQ ID NO: 38109 - DNA, 1040 bp, Homo sapiens
ttctcctgcttcagcctcctgagtagctgatactacaggtgcctgccaccacgtccggctaatttttgtatttttagtagagatggggtttcaccatgttggccaggctggtctcgaactcctgacctcaggcaatctgcttgcctcagcctcccaaagtgctggaattacaggcatgagccaccacgcccggcctgacatgatattttgaaacacatatacatagtgaaatgattactaaagtcgtgcaaattaatacattcatctcttcacatagtcaccccattttttttgttttagagtgagagcacttgaagtctctcagcaaatttccggtatacaacacagtattattaactatggtcaccatgctgtacgttagatctctaaactccttcatcctacagaactgcaactttgtaccctttgaccaacgtcttcatgtttctccaactctctgcccctgggaagcactgttctactctctgtttctatgtatgacttttttagattccacatgtaagtgggatcatgaactggttttctttccacgcatggctgatttcacttagcataatgtccaccagcttcatccatgttgttgtaaatgacaggatctcctttttctttttttttttttttttttttttttttttttttgagatggtgtcttgctctttcacccaggctggagtgcagtggcgcaatctcgtctcactgcaagctccacctcccgggttcatgccattctcctgcctcagcctcccgagtagctgggactacaggcgcccgccactgcgcctggctaattttttgtatttttagtagagatggggtttcactgtgttagccagtatggtctcgatttcctgaccttgtgatccgcccacctcagcctcccaaagtgctgggattacaggcatgatctccttcttttttaaggctgcctaatattccattgggtgtgtgtatataagtgtgtatatgtacacatacatcacattctttctatccattcatccatcaacagatgcaggttg

SEQ ID NO: 38110 - DNA, 1094 bp, Homo sapiens
gaaaccccatctctactaaaaatacaaaatcagctgggcatggtggtgcatgcgtgtaatcccagctactcgagaggctgaagcagaagaatcacttgaacccgggaggcggaggttgctgtgagccaagatcgtgccattgtactccagcctgggtgacgagcgaaactccgtctcaaaaaaaaaaaaaaaaaaaaaaaaagccgggcatgatggtgagtgcctgcaatcccagctactcgggaggctgaggtcggagaatcgcttgaacccaggtggcaaaggttgcagtgaaccaaggtcatgccattaccatctatctagcctgggcaacagagtgagactccatctcaaaaacaaacaaacaaacaaaactcactaactttcaggtatgatggaatagttcagacagaataacgcttcttctaagatcagctagagaagttagaaaaatatatattttaaatatatgtttgaagtaatcaaagagctacagaggaaaatagtaattaacgggacaaaaccttggagaagggagaaccatatagagaattgagctgacattatgcagtctcttttttcctcaggacatttttaaattctaggtatagagcaataaaagaagaattcaagcaaagggatcaggaagaggattgctactaagaggcagagaaaccaatgaagccttttgccatctcacactggaaagacaaaaagtcatagaggcttgatttttataaggaaagagaagtgagaaactgacctcgatactttgttggacttgcctaaagacatttgctgaattctcgggctgtgctgggatggagattagaggccaaataaaaacctctggtaagtagtgcacaggttttggtaatcacttattgctgaaaagggaggtattagatgtcagacctccataagtcctcaggtgaaacacctagatgctatgaccgaagagtcaggattgatctagaagtaaactgaacctgtagtcatctcagtctcgaatgggaacaaagcattaatcgcctacttgatctgctagcaaaggaaatagtaatcactgaaggaagataagataaaatcatcca

SEQ ID NO: 38111 - DNA, 1035 bp, Homo sapiens
tacaaaaaattagccaggcatggtaaggcgcgcctgtagtcttagctactcaggaggctgaggtgggaggatggcttgagcctgggaggcagaggatgcagagaggcggaggttgcaggcagacagaggttgtattgagctgagatggcgccactgccctccagccttggtgacagagcaagaccctgtctcaaaaaaaataaaaatttaaaaaagaaacgaaggtggattttataatgccaattaatctctcttccctttggaaaaactggactgatacccggcttacagggttctgggccttacaggtgagaaaagaatgtcacttcctggcaggcccaggaccctaggatatcttgaggatctcaacaagagaagaattcatccaaatctgtaggtattgttattggaaaggggtactaatacagactccatttaatacagacacatttaacgcagtgtgtcgagggaactttatagcactaaatgcccacaagagaaagaaggaaggatctaaaattgacaccctaacatcacaattagaagaactagagaaacaagagcaaacaaattcaaaagctagcagaaggcaagaaataactaagatcagagcagaactgaaggagatagagacacaaaaaacccttcaaaaaatcactgaatccaggagctgtttttttaaaaagatcaacaaagttgacagactgctagtaagactaataagaaaagagaagaatcaaaaagacgcaataaaaaatgataaaggggatatctccactgatcccacagaaatacaaactaccatcagaaaatactataaacacctctatgcaaataaactagaaaatctagaagaaatagataaattcctggacacatacaccctcccaagactaaaccagcaagaagtggaatccctgaatagaccaataacaggctctgaaattgaggcaataattaatagcctaacaaccaaaaaagtccaggaccagacagattcacagccgaattctaccagaggtacaaagaggagct

SEQ ID NO: 38112 - DNA, 1056 bp, Homo sapiens
ccttttttttttttttcgttaggatacttctgaactggtgaggtgtgctcacaatgaggtttcctctaaaagttatttttttacttttttctgttagcaaagcagttgctgctacagattgaatgcatttgggccatctgcaggttactgggttaaggacttttgataggaaggcctcagtgctttcgggatacgcccttgtttacactgacaacaaagtggtattggagtgttatagggtaaggagaataccttcaattataggttcttaatttaccttggcttttaaaggaatagtatacactgttttttttcttaactgcttgcatatctctgtctttctttctttctctctttgattttctgtctctttttctctttgactttacttttgcatctgtctgtttctctctctgcctctctctttctctctctctctctctctctctctctgctggtctttccttgcctctgccaaccacctatgttgctgttctctcaaccactgtgtgtgtgtgtggagggtgggtctaaaaccagctataaccaagtgtctatatatgggaactggtctgggtggcttggcttacaggttactttgtgccatacctttgaaacaagggacctgtccaggcttccttctgatggccaacccacctctaatgctggccagtctatcttacacaaagttttaagttttcctggtgtcatagtactccatagtctcccttaaatcctttcttgaaatttctgaacatatttcctagtggggtgggcttactttgtgcctgacccatgcttctttgagacaaaacaccatgctcacaccacacgcacaccacaaagaacaggtaaaaagggcacacacacacttttacagtttacaccaaaccagaatcaaaaccaaaatcagagtatcaggaaatccaagccaggtcaaaaccaaaaccaaagtatcaagcaatccaagtcaagtcaaaaacaaaaaccaaagtgctggtacaggcacgtcgtgggtgatcaggccatgcttccactcaaatggaatgggcaagt

SEQ ID NO: 38113 - DNA, 1031 bp, Homo sapiens
ccagcactttgggaggccatggtgggtggatcacctgaggtcaggacttcgagaccagcctggccaacatggtgaaaccctgtctctactaaaaatgcaaaaattagccgagcatggtggcaggcgcctgtaatctcagctacttgggaggctgaggcaggagaattgcttgaacccaggaggcagaggttgcaatgagctgaaatcatgccactgcactccagcctgggtgagagtgagacaccatctcaaacaaaacaaaacaaaaacaaaaacaaaacaaaaacaaaaaacaaaacccaaaacattacaataatatttagcattgttttggtggtactagccactgcaatcagatgacagagaggtcatggattttagctatctcagacagactgtgggatacactggccctaatacctccaaagattcattatatgataaaagggaaatgaaatcaaggaagaatagatgggtcatataataaataatgctgggacaataggacaaacatctgaataaaattggattcagtcttaaatattagcaccatgtaaactgtagatcgaccaaagctttgagtgtaaacaaacaaaaaacctagaaagaaaccatgaaaacactttaagagagcatagaagaactttaaaaagattggaataggaaacatctctctaattatgttacaaaactcagaattcataaaataaaaattattaaattcaaatatataaaaaccattctgagagttcaaaagttaacggatgaagtatgaaaaatatttagaaattgtttcacaaagggctaatttccctaatatttaaattattccttataaaccagtagaaaagctttaacaacataacagaaaaatgggaaaagactatgaatagacgggacccagaaaagcacatacaaataagtggctattttactacacctttactttggaaaacttcaaacctgtactaaaatagaatagggcagtgaacctccctgcctgcacccatcactcagcgtcaacattgatc

SEQ ID NO: 38114 - DNA, 1050 bp, Homo sapiens
cccaggtgtcatcagggcaggtggagagtgtctcctgcatcgtggaataagtatgaagctttggctctggcaatgaccacaggacgtggcataaaaatgaatttttttgtggggtagaaatctttcctgtttgtgctaagagcatttgtcccttgttatacacataacacatatacaacctcccctacacccaacacacacacagcacatccaaatccaacacaccacacacacatacacatatgtacacatccaaaacacattgacaccacacagactccacacaccacacacactcaacccctccccacaaactctaaacctccactatatccccaacacatgcaccacaccacacacaaactcaacacaccaaacacacatacacatataaacacacatacccacacccaacacacacacacccagcacatatacacaccacacaccctctacacaccacacacaaacctccaaatatacccaacacacacaccaacccaatgcattacacacacatatacaaatatacacacactcagcacacacacccaacacacgctgacatcccacacactccacaacagactgcacacacaacccccccatatacacaactaacacgtacacacacaccataccacatgtatccaccacacatgtacacatgtgcacacacacaccacacgtgtgtgcccactcacagccggatggggaaaagcaggcacagccagtcaggggtgagcagctgaagaaccctgatgggagcaggtagcctggagggacgtggggttaactctttccaaataaggagctttccaaactgccatttccgtattctaaggcttgacagcttttgaaaggatgaaaagagcgtgtattttccagaaatccttcatgtgactatttgcttcatttcaatgcctcagaacaccaccaacaaaaaacccactcacacccttgctggtggttgctacagtgcaattggctgcaggcttttgtttagaagtttgcagcagtccgggaaggaggttttcttcctcccggagc

SEQ ID NO: 38115 - DNA, 1048 bp, Homo sapiens
tcttatctgcgcctgccagccacagaggattgatggccttcaattcaccctcaccagcacctgtgattaaattatttctctcctcattttgcatggatactttaagcagggcaggcagatagtcatttccctccctcttggaaagtgttccaaggggacggaggccactcagaaaaacaccagtaaatcctattggcttcaaatttggatttgcatcctgccttggggtgatgggttgggcagaggcctgggagaaggaggaaagtggaatgaagaaaaaggcttgcatccaaaccggaagttgcagtgtcttgcagttccttttatcctttctttcaggtaagatttcacttctttttatgcaaactcaggccaagcctgtggtcaaattctgcccctcaaagtgggggtgaggatagggggacatagtgacagtctgaaactctggcatttcctgatgtcattcttcatactacgaaggctggtttctcctgcttccttggctttcccggagtgcttacttcttctaaccagtgaaaactgaatctcacaagtaagcccccaaatttggtatcttgattggtgaggttcattcctggggtacttattgaggcacctgctgaggccccattcctgcccaagcatatttttttgtgcaaaataatagttacattgacccggccctccttccaacctagagtagagtacatgtctcatctctccccttggtgaaactgcagatcctatttctgagtcttctttgaagacaaattcttcatatgctatcttattcattacaaaagctgttcaccttatctactgaatatatatatatatatatacatatatgagcctgtattatgacttctttaagtagaggggctgatgttgtctgctaattgatcttttggcctactcatgagcttttggaaactgaatcaaaaatatttgttgatgataccacaaagaccctatgaaacggctttaactgtaacttcctgtaagagatttgctgaaaacttgcttatgacttcagggtgatttttac

SEQ ID NO: 38116 - DNA, 1078 bp, Homo sapiens
accttttaaaaattcacacacacacacacacacacacacacacacacgacagaaaacaaacttgacctgtgtgctttctacttttgaagtgtattgagatataatttttccctaataaatggccagtttggaggtatgctttttgcactgtaacatggatttctaagatccagggcaaataatattatgtacccctccaaattaaaaaaaaaaaagtcctaactaaataacttcatgcgaatctcgaggactgcatggatgaaagcaagtttctaaagggcacctgagcagatgtgtatggaagcggaggcatcaggagaagccctttagcttggcagaattccgctgctcaggaccatcctgctgttaccgcccatcgctgccctgggctgattgcaaacaccagggacttcttagcatcaaccagaggatgcatccctgtctcccagggtcactgtctaacgtccctttaggcatgatggctctgattttctattcccaagggatttttttctgatcagaaatagtccaaatcctatttgtcaattgtactgttttgttttttgctacctgcttttctgttgttatgctttcaatatcttttcagtgaaccactccccagtagcctcccccaactcccctgtacccactgtatccactcagaaaaaaaccaacaaattcattgtttacagaaactcagaggagtgcttaatttttgtctggagccaactaattatatctgcaaagtaaccagaaacttcctcacagtgtgtcaactccacagcaaggcagaggagacaaaactcaaccaggctgatgtatagcgattcagaccctcccaggagctgaataacaccccggtgtcaccgtcctagcagcatgttatgttagatagacacctcttctgactggatgtgactgggcttgagatgagcgaggaagaaatggctgacattagatccatttctgggggtgggttttaacagggcgtggagagggagcaagagggcatcttgtgcttggcaggaaaacttgtactgagtaaatatgtgcctgaagggaggccaggagacagcaa

SEQ ID NO: 38117 - DNA, 1117 bp, Homo sapiens
tcctgcatatgctaggcattggctgagggttgaaaagcttgttcctgtgccttcagagggagcgcagtatgatgaaggctaggggagcaggtccacttccagtgccacgcttatacgccaagtgcagtgggcgtagagaagcagcattcagaatatgtgaaatccagtatttcacctcctagatgaggggatgcggagttgagttttgaaggataagcagaatttaactgagtgaaatagaaagctcattgtctacgccatagttgctttggtttgtatggctaagcagtagtgttcaggtattttgctctcccaaaaatatttggatcacatgatacaaacagtgaagattctgtctgctctgggttaattttggaggccaggaaaaaaatgtccatgattcatgatacgaagaatgagcttgtgctgctgaaaatgaaaaagtaagctagcatttcgtcatcctgcactacttgctgctttgaaggaatatagattcctaggtcatagaatatatacatagtcaaaaacactcctaaagaatcaattatttgtgaaccagatagagtatacaagtctttggagatcaagagagtgaaatgagaagccataactgccctctgcctagctaggctgagttccgagaggtggttggaagacagaaagtggcgtctgtccctgggtaagggctgtggcgtaactgggtgtggggcttttctctaatcatctggagaggagagcccctgacaagctggcccccaaacaaggtggctatggattcttctttttataaaagtttaaagtgtcttaaataaccttttgtgccattgaatagaaagaaaggtagtggaactccagaatacaagggattggccagaataaatggttggtatagagtagatgtcaatctttttatttaaaaattttttaagtacattaatacagtacattaacatagctgttttaatacaagggtgcattaaaataatgccataaaagcaccagcagccagaaccacagatctcatggtccttggatgcacttcctgtggctgctgtaacaattgccacaaactgggtggctcagaacacagagctttatcctcacagttctgaaa

SEQ ID NO: 38118 - DNA, 1057 bp, Homo sapiens
gttactgatctcacccattacatcatgctcctgagaggggtcacccgtccatgcacatacagagcggatcttggaggggttcagtcctaggaatcccacttcctgagctccacgttgcagagctctgcacagtggggatcaccttgtctatagcttggagctggggggtggtggaggctgcctagtgccgctgcctagtgccagcgccttaagaaccccacatcctatacatcttcccagtatgagtgtgtttacacaccccaccccagtgcaacatgtctgccccacagtggatccgcagacacataaatatcattcagatcttggagaaagctgcttttacaggctttgctctataaatagggatagtggaagcattgccctggaaacctgttagcttatactcttgggcctttttataactccagtgagacaaagacccacccccagagttgtgattatttttgtatatgccacctagttcatagttacccactagtaggatccagtgatgtttctgcatcagagtgaaggaatttctaaatgagagcaaactctctgccatgcattgacatcggggttctatagaagtcgtcagatttcaggttataaagcagtgtgtaataaaagcaaacatggaaggtagcatagaataatactagtatctatcactgatgcaaaagaatctttttacagtgcctgctctgtgccaggcgtgtgttatttaatacagccctgtgaggtaagtggtctcgtttttcccattttacagatgagaaacctgaggcacagtgaggatcaggaacttgcccatggcccatgagcttgggggtccagcccaggctgtttggtcccagagcctgtgctcttgtccattatactggtggtattgcccctggcattgacaaagtgggaaaagatgactaacctgtgtagggggagtttaaatttgacataaagtggtgtgggtagtttcttccagcccccatgcccgtgagtttagccaggcctgttacctgctaccctcttccccgccttcctccaccctgcagaggag

SEQ ID NO: 38119 - DNA, 1048 bp, Homo sapiens
gagagggtgtctggagacccatcttcctcttccttacctgctgccacctcccaagcctctgagacgtctgccacgttgatgccttggcattccccactcgacttgccaggtcagttaccatttgcccgccatgtttccacctccagcatcatgttgccattatctcacttgttctcctcactttcaaggattgatggattttaaggattcctttactgtatttttggtggaggcttaggaggaaataaaatcacatgtgggtccaatccattatctttactagtatttcattaagaaatgtatagcccagttttttcttgatttttttttttttttttttggagacggaggcttgtgctcttttgcccaggctggagtgcaatgacgcgatctcggctcactgcaacctccacctcctgggttcaagcacttctcctgcctcagcctcctgagtagctgggactacaggcacacaccaccacgcctggctaatttttttgtattttagtaaagacaaggttttactgtcttgcccaggctggtctcgaactcctgagctcaggcaatccgcctgcctcagcctcccaaaatgctaggattacaggcatgagccactgtgcctggccaattttgattctttaaaaataacatttttacaggccaggcgtggtggctcacacctgtaatcccagcactttgggaggccaaggcaggtggatcacgaggtcaggagatcgagaccatcctggctaacaaggtgaaaccccgtctctactaaaaatacaaaaaattagccgggcgcggtggcgggcgcctgtagtcccagctactcgggaggctaaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaatttttgttgggggatggagttacttccaaataagaagtgtgcttgtgatgtaaccggaggtgacattaactcctcaacaa

SEQ ID NO: 38120 - DNA, 1024 bp, Homo sapiens
cgcttgaacctgggaggtggaggttgcagtgagccgagatcgcgccactgcactccaggctaggtgacagagtgagactccatcttaaaaaataataataaataagtaaataaataaatatcacaagttatgtactgattctgaaaaagcaacataaccaccaaacacaatttattccttatgttccaagtgtatttggtagttttgttcaccctcataacagccaaacctgagtttaagaacagtaagaatagtgacttgcagagatttgttccaattgttacaacaagaatggatgttaactcatcttttccagatacaagtcatcaaacctggacaatgttatcaattaattccaaatgagagaaccggccttttgatactgatgttatattagaaaggatgattttcctatactttcatataaatgccatggatctcttactttttgatgaattaacctttgtgtagcgactacagtttgaaagcactactacacattcatagatgcagttccaggcagtttgagcccacaaaggcatttataacttaagcagaaaccaaacagaagtaaatatttttaatagagttaacaaatcttcataaaaaccaatcatttaaaactaaatgttttgaagctctaaagccagtcaggctccggggaggatgcagatgatcccctcaggccactgagaaacttttaatcagggatcacaagtattagagaggtataggggaggttcaggggaccaacacaaggtgagaagcaattccctggcaaggcctgagaggcaaggggtgggagcaggcagggagccctgggagagcaggaggtggccggcagccttcagacaggaactgcggccctgagtggaggcaaagaactcagcagctgctgcacctcttgagtagggaacctgggggtaggagaaggaaatgcatggtctgaatcctctctctcttgccctcatctcctgccagtccctcccactagcaggaccaaccagaagtttccctggttaaa

SEQ ID NO: 38121 - DNA, 1025 bp, Homo sapiens
gagcaacctgcaaagtcctgggtgtggtatttctttactctgcatgaagttactcaactgccatctgtatgactagccaactttgaagcagaaactatctgaattagaattccatatttcttccattctctaatttttttgaaattctgcccccatgatctataaaaaaaatgtgaagtcttcacctaaccatccacttcattaagtctctccttcctctgctcacatcacactgcataggttctgtctttttggctgtgggttataagccttctgagggcaagcatagtcatagtcatgttcattccacaatgtttggctcctagtagcttttcagcaagtaattgcttaactgactttccccgctacagaagacgatgcttttcaagaatagacaattccatgtcacagatagtgtaggtgtgaacgtccccaggctcagggcagtggattagtcatgagccgagatcatttttcatgctctggtttgcacagtggaatgactggagtagcttaggatgtggtatgaatttcctactagtgcactaaaaacaggattcacatcccttctgccttatgattgtttatgcaataacctcattgcaaatgtcgtgttgctgtaccttcccatgatgttttaatgaagtagaattttaaaatataattaacgtgcttaaggtcataaatcataaaacagatttggacaacttctggatcatagtatttcagcctctctaagcctcagtttccttatctcttaaaggaggatagattacaataatctctacaaactcatgcagtttaaaaatacattgttgttgctgaggcgggtggatcgtgaggtcaggagttcgagaccaacctgaccaacatggtgaaaccctgtctctactaaaaatacgaaaattagccagccatggtggcgtgcacctgtaatcccagctactcaggaggttgaggcaggagaattgcttgaacctgggaggcggagcttgcagtgagccaagattgtgccattgcacccc

SEQ ID NO: 38122 - DNA, 1048 bp, Homo sapiens
aattattaccagacattattgcggagttcacaaggtgtgtaacttccccaatgactcctgaagataacatcactattgtagaacctaagattggccttttaagatgtcttttcaggttttttgcatgtctgacactgatgaccccacctggacccaccaacccctcctgtggccccaaccagaagtgactcagcgccaggagaaccatttcccacagcccagtgatggcagccttgaccaatcagcaggaaacacccagcctagccaccactcctctcttaccccaaacaatctttgaaaaaccctaacctcccgactttcagggaggttgatttggggaataataaaaccttgacctcccattcagccagctctacgtgtgcaaaactctttctctgtttcaacttccttgccttaataaatcaactctgtctggacagcaggcaagaggaacccactgggcacttaaactccaaggctcaggaaggctgcccagagtagaagtctggaaagagtagaacagagggtctttggcctatgtggagattaaatgaacctgtacatataaataccaatgcagaaactcacttccttcttcctaacttgcttctcagaacattggcagccagatctttaatatctaggcaggaaattggaagtctcccctgggattctaatcagtgaaagaggaaaaacctagagaccctgagaatggtccatcctagaataagctgcaagctgacgatgaccgcctaggtgcacagagcttgtaatcagttgtctagtcccccactcttagccccaggaaaaccaattgtcagacgcccaagaaaaatgatatttcagaataccgagcgtaaagagaatgtgtttcaaatttccgaagaaaaagacaggtcacatacaaaggatcggggacttgcaaatgtcaacactggaaaaatagaaggcaatggagtattgccttcaaaacccaaaaggacaatgatttcccaagtagaattctaaccacaactatcgagcagatctgatggcagcacaaaacagg

SEQ ID NO: 38123 - DNA, 1043 bp, Homo sapiens
cttcacattttcagtgaggaccagccctaagtataaaaatgaaaaggcagttcattcctgagaggttctgagagccttccctttaaagcaaccagtagagtggtttcacctctctccctcctttgtcagagtggttttgagagaggctgttttttttttttttaatcgttctgtccagcacggtcttttttcaggttaccttgctgctgttcatgtacttttcattcattgattcattcattccttcattgatttacatttttggagcatgcactgccagttactgggcaggagtactgtgaggaagtgagaaaccgctctgccttctaacgcttctggcctgtgcctggaagagatcggtacagacccaagcatgaccccagcacgtgggagtgatgtgttggaggtgtgcaccaggctcttgaggcgctggctctgccagcctcagcatagcacctttcctgcccacaggcacaacgaggccctcttggaggaggcgaagatgatgaacagactgagacacagccgggtggtgaagctcctgggcgtcatcatagaggaagggaagtactccctggtgatggagtacatggagaagggcaacctgatgcacgtgctgaaagccgaggtagagagggcccctccgcacggggatccccagcgcttgggccctggctgtctgttatggctccccttggggtgtttgtttgcagctcgttagcatcaaatttgcaaattgcttggtagtttgaattttcttttcctttttttatagagacaaggtcttgctatgttgcccaggctgaactccaacacctggtctcaagtgatcctcccacctcagcctctcaagtagctgggattacaggctggatttcctgaagtcagtttctccttaaaacatctatgccttgattgggctccgtgggtcacttctgtaatctcagcacttttggcaggaggatcacttgagccttggtgctcaagaccagcctggataacacagtgaaatcccctctctacaaaaaataaaaggtgcatgt

SEQ ID NO: 38124 - DNA, 1026 bp, Homo sapiens
aaagaatgttagagctggaaggaatcccaggcacggtcaaatccaaaacacagtttttacggatagggaaactgagggccaaggaggggcagggctcgccgagtttcgcctcctctgaccgcgtagaatggttgcactaaagcagattcctcgtgctgtgtatccgtcaggtaacatctgccggcacctgctgccccgggtccagtgccccgccttgattgtgcacggtgagaaggatcctctggtcccacggtttcatgccgacttcattcataagcacgtgaaaggctcacggtaagtcctgtcaccgccttcacactccccccgagagcctcggagtcaatgggcaaagctactggaaggaaaataaccaagaggagttggagttttagagtgcacagccccccttttgccaatgccagtcagtagcaccgctttatttagggtaccacggaagagagaagccctgaactgtgggtgactgataaccagaaggaaaggcatgttcagatagacagctcttactttcatgagtggcaaacatgctcataggtgctaagccctgtcacttggtaatagtttagatttatttccatcagtattaaccgaaacagtttcacacaatttgggaattttcagtttagttttttatcattataaaagcactgaccacccaatttaaaaaaatctgttaaaccaaatttctgatgtctgctgacagccagccctactcagcacagttaatggtagtgttccctgtccctaaagcccccaggccagcagggaaagcaggcacagaaacagctccactgctcccttctcgctctgttctatgatgtatttaacaacagatttctcagagaatttttaaaggaggaaaaaaagtttcttttctataataaaatacaattaccataaacctttataattactatatccataatggatagtgctatatccatttagcattttttaagttaacaggcatctctttattccacacattcctcctataccacttcaacc

SEQ ID NO: 38125 - DNA, 1045 bp, Homo sapiens
cccacaggggctggagcagcatgctccctcacaggctgagatgaggagattaggcatcctgcctctgagccagctgctgtggggcacgaggcaccagtgcacaggtgccccgactgtgagtcactttcttcttgctgtagccttaatgatcttgtttgcttcccttttggttgtggtgttgcccttcagcatgctttggagtttgagacactaaaacgagcctttcgtgtgaaactggtcctagaacttagtagcactgtggttccagcttcatctttcccaactccgctgacctcatatgcgacatggggtccacctacttggttgttgacggacgccacccctctttccctcggcacctgtgcctgtcctctctgaacctgccactgccatcgtcgtgaagaatcagaagcccggaagccagaagtgtggctggcctgcggggggtggagaagctgcagtgtgccctttgcttttcttttaggactccatccccgtgtctacctccctccttggagacacttccgacacgacctctactggccttgcccagcgcctaggtatgtacccacagctggcgctgcatggccagccaggtggggcccactctttaatggaaccatgaagcaagtcccttcggaagtaaagcatctttatgctaagaaccatcacctcattgctgctgggaagcacagacctttgcacgttgggtcttatttaaggggcacattccatgctcgcctgtcatcaccaccgtcccagggctggcctgttcccaaaggactcccacctcgtccttgggtgtgtccttgagtccatgagctgatttagttgccttccgtaagtgcatcaccacctcctgggaggagagcatgagaagtgcccacagcccctgtgggtggtggctcaaggtagcctcccgggccttaggaggagtcagtgcagctggtggagcaggtgtcacctctgtgcaggaaggactgtcctcactcagtgtgataccgttcagggctcggagggaagactggcctggcctgtgagtgtg

SEQ ID NO: 38126 - DNA, 1027 bp, Homo sapiens
cttgatctcctaacctcgtgatccacccgccttggcctcccaaagtgttgggattacaggcgtgagccaccacgccactcttataactcaaaaagaagacagataatccagtaaaaagatgggcaggccagacacagtggctcatgcccaaagaggcttgggcaaaggtgacctgggcagggaggatgggagtcccagggttcccaggtggccctcataaaccagatatacacaggtctatgctaataaccccaggaagattcacagatttggagcctttttctcagaatgcaatggaagaatggtgattgtgtgtgtgtgtgtgtgttgggggcttttgtcctgtaacaaaataagagaagacactttgctctgccttttctccctctaatgtagaaatgactgcctctctgttggttgcagtccacccatctgcatccaccatgggcacagggcttgggggcacaagggcagccttgccaggcttgcagccctaggggacaaagactcgctggattcttccctttcccagctccttcctgtccagcccatgaccaagtcctcagggcctccactccaggccgcctgggtctgcgctcctccctggcgcatcttctgcaccccctagactttgtttcctcaccattgccaaaccgattttcctagaacacagagctaatcatatcacctggctgctcagagtcctccaatggctccctcctgcctgcaaggtgatgcacaggtcctgggggccccacctcttcctcctgtcctctgcctttcagtcccaatactcatggcaccggggtccctcagctctgtctggtgctcgctctgtgaggttggcctatgctggctcagccgagctcccacaggctacctgggtagggcgccgtctgtgcatttctcgaggaaggagatgccttctggtacagggtcttcgttaatgtttattccattagatgattgtcaagactggggcatcagccattagcctccaagccttgagtaaacccacataaaaaga

SEQ ID NO: 38127 - DNA, 1033 bp, Homo sapiens
ttcaagcacttctcctgcctcagcctccggagtagctgggattacaggcatccgccattatgcccggctagttttttgtatttttgtagagacagggtttcaccatgttggccaggctggtcttaaactcctgacctcaagtgatctgcctgcttgggcctcccaaagtgctgggtttacaggtgtgagccaccgtgcccggccttatgttattctatatatataattaacacaaacaatacttactgagcacctgctatagattagataatctaggccctcagagatagagcagtgaactaaaatgaaaattctgctcatatagtgcttacattatgatagggagagacaaacaagaattatattagtggtaacaattgctttggagaaaaatgttaagcacagaaggagaatatgtgtgcagtggagtggttttgcatttaaaatggattgatcaggaaaacttgtttgagaaagtgacgttttagcaaagacaaggtaggccaaggtagccaggaatgcatgtatctggggaaagcattcctggcaggagaaacaggtcccacgtacctgagatgtgagtatgcctattcaaggaacatggtgtggctggagcagggtgaccgtgggagaagagtgttaggtttagagtgtgggggatgttggggctgtaagtataggaccttttgctctgaataaggtagaaagcaataaaatttcacaaagagtagtgacataatctgacttttaaagcatcttaatcaaatggaagatcttttgactgacttgaaataacagccttctcactggtttgttgtatgtgtgaccttaggcaagtcccttgaaactcaaaattctcaactcaaatggagagacatttcttgaacacttagtgtgacagccttttatactatgaactcatttaattttcataagcctatgatttgtcagtactattaccccattttttacagttgaggaaaccgaggcacagaagagcaacttgcctaagggcacaatagctttgtcatgt

SEQ ID NO: 38128 - DNA, 1037 bp, Homo sapiens
ttttgtgcttttttttttctttctttctttctttctgttttttccaattggaccttctatattgttccacgtattaacattttattcatgttttctggaaatagtattttctgtctctcagacaatagcgaggttattgtgtgagatttttgttctttatagttttctttgctatattgtgtttcttcccagattccttttgctgcatgtttacttttcatttgaagacttttctcacacagctggatccttcattgctgcctattctgagttaatatttaggtactgagaaagctgaatgggatttttcttctattgtgacagtgtaggacttgtcagctagtggttatcacttcagagtaattagatatttttggatattagtgactgtagatgtattttcttgggctatgagttttccggaatcctttcatttcctcctgggaaatagacctggctaccagtagagttctcttccttcataatgtaaacttccttataatctgtctatctttggtatgtgcctctcagcatctggagtgaccaacccttctctagaaagcaaatcttaagtgttctgctagaatgtgaagggagtggttgacattttccactgagttggggaggggactgtaccgagtctggctgtttataaaggctttcaaccaattctgtcctcagctcttacctcacaccatcttgcagaggatagggagtctccaattcctgaggctttctgggggtgttgtgacatgttctgactgtttctgatttaccttgtgtgttcatgttggaccaatattcagctcaatttgatctgttactattctttactccaatttgcacattctaagattttattctcatctctgctatcatctctcttgacattctccttgcctgagggttttcctcccctccccaccccacccctcccttcccctccgatctttctcttttctctctctcctctcccctctcccttctcctcttttcttttctttcttgaggtaggatcttgctctgttacccaggct

SEQ ID NO: 38129 - DNA, 1034 bp, Homo sapiens
tattgcaattataaagtaatggaaacagttgttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttaatagagacggggtttcaccgttttagccgggatggtctcgatctcctgacctcgtgatccgcccgcctcggcctcccacagtgctgggattacaggcgtgagccaccgcgcccggccaggaaacagttgtttttgactggattttaaaattatagccatatgtcatatgtactggaacaacaggctgattatttttaattcagtgcattttagtacctactgtatgcaccaataacaacttaaactccttccctctattgtctgtcttatgccgtcctttgctttatctgaagacgagttgagaaatgaaaggatcatgttgattagctgtcactatggtgacctgcaaaaaagtgaaaatttatcagagtgatgagaatctgtctttttttaatttgttcctgttttcctccaatagaaagttaattgccatatctgtgtgttttaataccacacactgagctggtattaaaatgaatttaatgtgtttgaaatgttggaaataagtgttaagtttagattgccctaggcttagaaaggaccttgttttgatgggaagccccaacttctgtatttagctgcttactataaaatgtagcttattgacaaattgtaacaagaatttcctcagataaccaagtgttaaaatttgataaggcatccattactatgttctgtttttttgttgttgtttgtttgtttgtttgttttgagacagggttttgctctgtcacccaggctggagtgcagtggcatggtggcatgatctcggctcactgtaacctctgcctcctgggttcaagggattttgct

SEQ ID NO: 38130 - DNA, 1079 bp, Homo sapiens
aatttgatatgctctcctttcaatataaaatgatttatcaaatgtgggggtggttcttacatatttttattttgcgcttgattttactttatgcttgcaaatgtttttgcctttttatatttccattttgcattttaactcctattttgttttctttttttaattttctcctaaaagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggtaagtcaaacagccaagctgcgctgtacatcttgaacatacatttcacttcttactagcagtaatattattactatgagaaacgacatcttagaagcatagttcagtatattaataacctatttcaaatgactaatacttttttatctttcttggaaatcggacagtgaaattttattgacaagtatgaagaaaaaggaaatgtacaattgtccctttttttctcttttgactgatagatttaaagtgtgcaccaatcctggaatgctttactgtagtaatgagtttcttctgttatctttagaaaaatgctgcacatgttgctgttttgaaataaggagtgtccgtactcttctgtttgctaattttatagctccctaagctgtggctcctgggggctcaaacacaataaagctcagttgtggttaggtattatatttaaaggcatcgcttttgaagtttattttattttatttttaaactttcaagttcaggggtacatgtgcaggcttgttacataggtaaacttgtgtcatggagggtttgtacccacttttcctgatcctctcccatctctcaccctccagcctctgacggaccccagtgtgtattgttcccctgtgtgtccatgtgttctcaccttttgaaaccttaattctcttcgactagtgacttctggtggtaacagcagatttcacaatgtatatgtttttaaaattttgaaatacatacatattatcatagtgat

SEQ ID NO: 38131 - DNA, 2653 bp, Homo sapiens
acacatttgccagtgtcacagaagaaactcttgtttttaaaacctaatgctaaactagtataggttttcacatacatttaagaaatgttttcccgtcttcctggggaaggaaaaaatagaccttaatgacggagctgatttttgttaatgaaaatccaaagcctttagctcgtaatttcaggtatcagtgtggtttaagtaccacattcctcatgacaggagcagaagttgtgtagcaaactgaagtgcatatgagtatggataccctgctattctttaaggcattttagccagcccaagagttccactgatggattctaattttaaaatggttcttaagttttctgtgggtattgaaactgcttaagtagctgaattcagcttacactttaaaaagttttaaaataacttttctattttaagatgcttttctgattcccaagatgaaaagaatagtaatcaatgtgggagttaaaaataatcatttctgttcctattaatagcttaactctggatatcatttataatagtccagtctccccatagagactgcctaaggctatagtgttatgctgctttggggtgggagcagtaggccaagttcaagtcccaactcggaatttgtgtgtgtctcttttgaaggggggaagggactctggaatatgaattatcttcacttgttaatcctgaacatgcctctgactcatgagtggcagcagtcatgggagcaactccagcctttctcagcagatgtcactattactgtgtatgttgaagtatttacaaaggaaaaaagaaacaaatgactaatatagagttcatgtttatcagttttgccagatatatttaacattttcttgactaataccttctttatatttgagggatttaatattttttagacttgaagtgattgctaaatttgggatcatatagcagcttcggatgaagaatattttgtttttgtccaagtttattctgaatcacccttctgctttcattgccattgtaattctctggcaactgaaagttaagtctgattccttagttataaaacttgactttattcaggtattcagggtctttttagaagatgctttgcttcatgaaattagatttttctctcagtaccccacccttttaaaaatgcagttgttaaaattaaatgtactttgtgatatccatttcctcactgaaaacagtttttactcattgtaatgaatatttgatacatattaacttttcatagttaggaaattgaattaaaaataaatagaaaaggaatttttaaatgaatgtctttgttctcagtattggaattaataaaacttttcaaagccaataatttttatttatttgtattaattattcctggcttgaattaaattcccttgaaaaaatgttttgcaggttaatgaatccaaaactattttaaagctttgcgattttgggtcggcttcacatgttgcggataatgacataacaccttatcttgtcagtagattttatcgtgctcctgaaatcagtaagtttcttaatgttctttgacctgggccatcatatgtggtggaaaccgcatacttaatgtctaagcactgttttccatcacacttcagcagctgcacgagttcattcatgaggaagggaaccatagcaagttcatcctcctcaggtggaatgaaggtagttgtgacaggagtcttgatcatgtcgggcaagagtagcaaaacagttgtggaaaatcctcgactttagaagactgctcttgattattcaaggtctgattatcacatttatggattgtatgggacctttgttttttcctgttgccttggttgaggctgattagcacctccaccaaaggcgaaatgagaaaagagaagaaatacatattttcttttgccctttaagttcctcccctacacctccattttttaaggtttttaagtttgagtctctattaagaattagtgggaaagaacacaaaactaattgtcaaactaaggcatgaagattgtggttatagtccaagctaaggtagccagcccctcattaatggaaataaaaattaatagtcgtcagttttctctatcctcgtatattaaaactttgattttgttttcagttataggtaaaagctatgactatggtatagatatgtggtctgtaggttgcaccttatacgaactctatactggaaaaattttattccctggcaaaaccaataaccatatgctgaagcttgcaatggatctcaaaggaaagatgccaaataaggtaagacattagcatgagcttctttaaggtcttagtttcttattaactgacaagactgctgacacttgctcaccactagtgagctataaaacaaaaatttcagaaaggtgggtagatggctatcatgatttcttagggtctttcccttttctggtgttttaaattagtggttctaatcagccaagcgctaaggataagagaacttgttcaatgatggacagagagcagcaatattttggggatacacccttatgggtaaaagtttcaaaatgtttggaagacagaatggaaaaagatgtaagttgaattaggtaaaatacaagaacatgcttagtggtcagagaatgaataggtgaatattagatattgtaagagg

SEQ ID NO: 38132 - DNA, 1055 bp, Homo sapiens
acatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagagaaaa

SEQ ID NO: 38133 - DNA, 1960 bp, Homo sapiens
tggatgttaaggattcttagaaaaacagcaaccaccagaatagcatatatctgaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcatattgtctcctggtttttttctttggttgagttcagattttcctcacaaacatcaaaacattttcaaagcattaggtgcacaacaccaaagagtgtattatattcgtgttcctgttacatacatttctgctttggttttcctagtaaaggaaacagataagtaatgagccaactcctgtttttataatgataaaaataaattggttcattgctcacatgatagcttgacaaatcttgggctcttatcctcagtatacccactctttattttcttcttttaaggaactgtttttggcttttcaaaacagtgagtaaaatagattcacagtgtagtttgtgaatcttagtgcatgcaaagcagataaggcagg

SEQ ID NO: 38134 - DNA, 1013 bp, Homo sapiens
tttagctgatgtgacaaatgagagaaacctggggacatgctgaagtttgaagctggtgctcactttcatcattgcctgagttttcccaagcagcttttgaagagtgaggaactaagttttcttagaagagtaaatgtctcacagaggggtcacccttataccttggatgttgaaactttgtacttctggaactaaagcagttaccacggtgctgggcattgggggtagggctaaggcgttctaacctcaggagggctaacagttcggggacactctttttatctttggcgaccccatttttttcaagcccaaaatgaggccaggtgatctggcaagttttgtgtttctaacattgtgacaaaccccagaatgatattgcatcacggaaaaaactcctaggcccaggcaactgggacccctgggctaggccccacactttggggggcccatctggccttttccagccacgtctacggccataccaccctgaacgcccccgatctcgtctgatctcggaagctaagcagggtcgggcctggttagtacttggatgggagaccgcctgggaataccgggtgctgtaggcttactttgtgtctgacccatgtttccctgagacaaaacaccaagctcacaccacactcacaccacaaaacaaagaacgggtaaaaaaggcacacacacactttttcagtttacaccaaaccagaatcaaaaccaaaatcagagtatccagaaatccaagccaggtcaaaaccaaaaccaaagtatcaagcaattcaagtcaagtcaaaaacaaaaaccaaagtgccagtacaggcacgccgtgggtgatcaggccacgcttccactcaaatggagtgggcaagttccaaagaccagtcttaccaagtttcagatgtccggactccaagtgccagttccttcccggtgttcagccactgcattgatcctccaccggggcctgccacgcgctgctctgacgaggtgtccaaccggggcaactgcctacc

SEQ ID NO: 38135 - DNA, 1053 bp, Homo sapiens
ttctcatgcctcagcctcctgagtggctgggattacagacgtgcaccacccccgcctacgcccccccccccccgcccccgcccccgccccggctaatgttttgtatttttagtagagacagggtttcaccttgtgggccaggctggtctcaaactcctggtctcaagtgatccgcccaccttggcctcccaaagtgctgggattacaggcatgagtcactgcacccggccttcccttgttcttagaagcttgttaagtaactcatcttgtacttgtcttaactatcctaaactttctcatcagtaaaataggaggatgataaccaaataattgaggcttaaatggcattagcgtgtaaaagcaattctacaaaacgttttccatttttaaagaggaaaaaaaacccatccaactctcaaaccatgaaaccaaacctgttttcccttcctcaagatttaggatttgaaagtattctataaactgattatatcaccagagaaagctgtgaggtcaagaggaccttaatttatttagcagtcaagtaaccaccatgagactttgttcacgtgggactgaataaggaacgtatgctgtagtaaaatggaataagtattctctttatttgtatgtcttaataattccttttttcctcagtagatgtggagttattcccttgagaactcctgtaatagttaattcaaatttcagtaagctctcaatgattagtcttgaccttctgagagaatatttatgttttcattttcaaaaatggaagtaagcttttaagaatgaaatcgtatctggtgtgtaaaaaattgttttaaagttgattagtttgacaggatgatcaggatttgcaggggaaggtaggtcttttgaatctttcttcctactttgcgataagattcctgctctctcctgtgcaccacaaggcttttacttacattgaccaaaagcagttgtgaataaagtctcaatctgtagttcaaatggaagtcacagagaccaggacacctttcatggatgttggccaagctaggtcagcgtatgttg

SEQ ID NO: 38136 - DNA, 1068 bp, Homo sapiens
cccttagagcaagtgaagggcatgcttatgaaagaaaaggcatatgttgcaaagagctatcaagaagagtttttaaaaagtgttgctatgtaagtgtaagcgaaaaaattaagtctacttttatggtaaacttaaacataaattttatggtcatttccacccaagttctccagacggcagaggagtcagcaggaattctcctaaggaggtggaggtgggagggaggaggaaatggcctttgcaagcctgacctgttgtttgaaatctcaagttaccttacatgttttatgatattaaccatgtagtccatacaatttttgggattcaatatgaaatattttaaacatatttaccaaggagctcttctccagagatccttgatttaggctgatgtttcaggaagctgagctgtggattagtggccctgtgtgcccttggtctcttgctgtgtgtgtgtactctggcttcagaagcagagacggactgtgttaccttccataatgatgccgggtaaaggaggcattagctgatctggtgaaatgtaaataagatttgaattaagtagttcaaaaaaaatttaaaaagtttgttttagtaattgtttttaaccaataaagattaaaaatacttgttttctgtctgcagtcatcttactgctaggggttcaagagaaggtgcactagtagtttttatctcgagtctcgctgtttattctctgtactttaaaaaagtgactgtgctgttgccttgagctggttgtgggagcatttgtagggtccctgttggaatgaggaccaatctgcttcataactcctctctgtctatgggctagaccaaagtacccttggagaactccatgtcttccaggaagtttccaccctttttctcctccctctttcctgagtgttattgtctgcatgtccagctgtgtccctctaacctgattttcagccatctgccaggtccctcgagttgaggcttcactcctcctgtcctgattcttgaccctggcttctgcacttgctggtggccctgcagagctctggcctgggaagtagaagaatggct

SEQ ID NO: 38137 - DNA, 1059 bp, Homo sapiens
tagctttggtatatctttttccagtctgttacttttagtttgtttctgtctttatatttaaaattgttctttagaaaccagaatatagtcagttcttgcctttttaaaataatcggatagtccatgctttttaattgaaattaatccatttacatttaaagtaattattaatatggttatattaggtctatcattttttgcttttcttagggaagggattttatttgcttttgttcctcctcttttgctgattttgtgttaaccaaaatttcttattaattttaattcttctgttggttttctagctatatgcatcttagctttttctttaatattgaatcactttggataagacatataattttttcaatgatgtgtttccagttccactacttatccttagtattattgtcacagttgttgcatttatatactttgtaaacccatcagtagtgttgtattttttgctttatgctgtcatcttttatagaaaactaagatattacatatatccacataattaccatttctggctgtcttcatttcttcctgtagctctaagttgccatctagtgtagtttccatttggactagagatctttctttagcatttcttgttatagatctaccaatgacaaatagtttatttgaaaatgcccttattttaccttcatttttaaaggaaacttcttctgaatactagaattcttggttgactggttttcttccttttccttcttcagtaatttgaatatgtggtcccagtgtcttcagacttaaaagtttctaaggagaagtctttgttcttatcgttattgttgccgttgttttcctgtttatgacgtcattttctctggctgctttcaagattttgtttatccttggctttctaccatttgactaaggtgtgtctagaagaagttttgtttgtgttattctgtttgaggtttattgagcttttgggagatatttcagttgttgtgtcttcagatgtcttttcctcctttcctctctctagagtccaattaaggtactgcttcctgttgtcacatttttggg

SEQ ID NO: 38138 - DNA, 1048 bp, Homo sapiens
atgtgttttagctgagacagtataaaattgtgtctagtatagatttgaggtgtactgaggttccacttgcccctcaagggacacccccaattctcatatacccaccttgaacacagttaacagtgtttgtgtcctgctttttataagtcatgagcatttcctgatatcatcaaaatgcttttagaaatacaactaataaatatattgtgtcttgcctgttgtattgttgcgaaatctagttattcctacaggcattgtatttttttggtggtatctttcttttgcagttgtgttgtatgtgaaagagtatgtcacctgtgaggtatggagcctcctaaagagacctgggagccagctaacttcagccggagcctaatactcatgcattgaactgtgtgctctttccctcaggcctttaattacaggtacacagttacaagtaatactgtgacctactcttcaatcaccctttcctttttaagagaattaaaaaaaaaaaaaactgtgaaattcctggatcagaagccatggcttttgtcagagccagctactcactcccaccggcagtacctgagtgaccatctgaacattcccttacgagccaccactagacagtacattcaaaacttagctcatttgatagaaaagtgttatcttttaatttgcatttcttagctcactagaaggtaagtgatgtgggaatttttgttaaagttagtatttttatcattttaaacttttaagtctgtaatttacatatctggactttattctgcccagtgttgtgtcttgagggcctaaatctcataatcaattagccaccgtttttgtattattcatgactcatcgtgacttccaaagtttaaacttctgtgtgtactagggtttgttttgggctggttgctgcgtcagaattagatgaatttgtctgtagtctcattgcttgagacaaaatatcttctaaagaaactgaaataacatctttttcatattaaaaacgtttaggcattggcacttcttgttttgtggctacaactaaagttgtatt

SEQ ID NO: 38139 - DNA, 2138 bp, Homo sapiens
tgcattgattgaggtgatcctgtggttttcctttctttgatttttctaatgcaatatattacattgattgattttctcatattaaaccacccttgtattcctgggataaatcccatttggttataatccttttagatgttagatttggtttgctcgaacagccaatcctcattattcatggattccatatttgcctatttgctaaaatttatttgtaacccaaaaattaataatgcagtggtttcatggtcatttatacatacacctagaatggcaaaaaaaaaaaaaaaaaagagagtcacctgacacacatcttcctagctgagactgcccataacaacacactgccttgtttcagctgtgagaccaccagcgggtggaagtgatgggggtaatgcagtgtagtaccaaaacctttggcctcagagccacttgaagtggtttaaatctcaactctggcacctgttagtgggacggtctcaggcaagtcacttaacatttttgagtttcattttctccattctgtaaaatagaatcgactaggatcagttgtttgtaggattataatctatgtgagatatgtgtgtgcatatttaccttatgagcaggtggtttagtatccattgattcaatggtcctcacctttatttctaattttagttatttgtgtcttttctttttttctctgtccagctaatggtttctcaatttttattgagttcttcaaataaccaactcttaatttcattgatttttcttttcttctattctctatgtatcttacccgtaatctttattattttcatccttctggtaccttcgggtttactttgctcttctttttctagctccttaaggtgtaaagttaggctgctgacatgagatctttttttcttttttaatgtaacctttacatctataaactttcctctgaccactgccttcactacattgcatactttttctgtgttgtgattttgttttcatgcatccctaagtgtcttctactttcccttgtgatttcttttttgacccatggttgttgaaggagggtgttgttttaatttccacatatttgtggattttcccatttttcttttggtgttaatttctagcttcattccacaagataactttgtaagatttcaatttcttaaaatgtgagacttgttatgaggtctgacatttggtctgttctggaaaatgattcatatgcacttaagaaggtatattctgctgtttggtgaagtgttaggtctagttggtttatagtgttgtgcaagtcctgttttgatcttctagataatctgtcctgtactgaaaatgtagtgtattgaattctccaactgttattgtaaagctatctttttcccttcagctttgtcaatatttgcttcatgtattttggagcactgttgtttggtgcttacatgtttataattgttatattttcttgttgaactggcctttatgtcaccatcttttgtgtcttgttacagtttttgacttaaagtctgttttgtctgatattagtgtagccacctccagctttctcttgcttactatttacatttaatatattttttactactttccctttcaacctttttgtttttgaatcttgagtttcctgtagataacatatagttatataatgtttttatatccattctgccagtctctgccttctgtcagaaaagtttaatttacatttcaagttactactgacaagcacttcttccatgttgctatttgttttctgccttatacttttgttcctcattgccttaattactaccatttgtgattagttgatcttttttctttttaataatggattgtttggattcccttctcatttccttttgaatatatagcttttagatattttctttgtggttatcatgggaattatatgtaatatccacaattgatgttgttgtttaagtcaatatcagcttcaatagcatacaaatgtctgtctatacagctccatctgctccctttatgttcttacaaagtacatattttatgcattgtgtgctcaataacatggattgataattatttttcatgcatttgtccttttttttcttttttgagacagagcctcactctgtcacccaggctggagcgca

SEQ ID NO: 38140 - DNA, 1047 bp, Homo sapiens
tggactagtccttttatcattatataatgcccctctttgtcttctttatctactgttgctttaacatttgttttttctgatataagaatagctactcctgcttgctttttgtgtcctcttgcacggaatgtctgtttcacccgtttaccttaagtttatgtgagtacttatgtgttaggtgagcctcttcacaacagatactaggtgaattcttatccattctgccattctgttctctttccagtggaggtatttcagttactattgagatgctaggtattattctattcattgtgctatgaatacacaacatgggaacgaatatgaaaacccttgtgggtttttttttccattatgttattgctatatagttcctgtgagatttatgctttaaggaggttctattttggtgtatgtcaaggatttgtttcaagatttatatctccttttagcagtttttgtttcaagatttatatctccttttagcagttattgtagcgctggcttggtattggcagattctctcagtatttgtcttaaaaagacggtatcttttcatcatttatgaagtttagttttgctggatataaaattcttggcttataattgttttgtttaaggaggctaaggatagccctccccaccccaacccctagtcccttctagcttgtagggtttctgctgagaaatctgctgttaatctgttaggttttcctttataggttacctggtgcttttgcctcacagctcttaagattcttttccttcatcttaactttagataacctgatgacagcgtgcctaagtgatgatctttttgcaataaatttcccaggtgttctttgagcttctcgtatttggatgtctagatctctgtctagcaaggccggggaagttttcctcaattattccctcaatatgtttttcaaacttttagatttctcttcttcctcagtaacaccatttattcttaggattggccatttaacataatccccaacttctcagaggctttttctttttttttttttttaattctttttttgt

SEQ ID NO: 38141 - DNA, 1022 bp, Homo sapiens
ctccagccagtaggtggcgctgtcaagagagcatcagctgtggtagtatagggaggatcaggtggtgtgggggccctagagctcccgggagattatgtcctttgtctttggagtttttcagctgtcccctggggcctgcagcagcaatctgcttccttcagagggtttgtggattctcttggctttcctggtacgttcctgccgtagttcttggagcaaaagttaaggaggtgagtccccacacgctgctctgtccgtccgagtgggagctgcaaattagtcctgcctttctgtctgccattttccttgtgactctgaagaatatttttcccccaacatgggtttgtttctgagattctcataaaagtacatacttcttaaaagttgcattttcagttagtacatttgagattgttgacatttggattttattcttctgtaagccatcattttattattgaaaaagtttatttgtgctgaggtaaggtagcttatgagttcagagcaactagtgctaaaggaaggctattttgttgtttttttaatgagatgtgaagtattatagctcaaatattttcataagaactgtctaaacctctatttagaatacctatattcaacaaataattttgcaagacaaaaaagttgtcaaataaattgcctttttcattcttttgaatcttttgctaaatttagatgctgtaaaatgttgtttttatccaatcaaaaatagaagggccatgaaattattctttctacaatttgagatactccaaagtgcacttactgaatttcaaaattattgtacattgctctatatattccatttttgtctgtcacttgatatttttagaggttaatttcactgcatgcttacttgcaaactttgatttcaacaattgcagtttgccaaaaggttcaaaagctgacttttcaaaagacagttgtttgttgaaagttttgatcaaaatttccagctgattttgaacaaaaggtaacccaatcttagaggtctcaccaaa

SEQ ID NO: 38142 - DNA, 1513 bp, Homo sapiens
aaagttcaagggacatagcaggaaacagtactaatgaactgccttcatgaagctcacatgtagaccacaaacacagaaagaaaacacagtgtgtttgatggtgagatggtgtgacgtgctcaggagaaaacaggaggcagggaaggggatagaattggggggaaagggtggggagggaggggggcagttccagccctaccactaactagagtggactagctgggtgacttcatttaactctggaacctgttttctcatgactggattggcaaaaatataatacatgttcaacatacttcatagagttttgtgggtaagaggaatattattagtagtaacaagggccttataattgcacataggataactgtatttgcttactgaatcttcatagtaatgcttcacgctaattgccagtatcacaattcattctctgattaattcagcaaatacttgttgagtgtctgctaggcacgagggatatagctagattttagatacacaaaactctgttctcattctggttgagctatgactgaagagatgtagtgtcttatacctttcaccgttgctgtgtattttatctttaaatgttcagtttggtgacttttgtcaattaactagaaaagtcgatgttttagcgaaaaagtttataattttaatagagcttgtggtagggaactcacagtggttttattttcctattacttactcttggggctatttaaactagtaattttgtttattctataagtttcttaattttaaaagtattcatagagttcttttccttgtaagaatgctactgtatagccctaaaatttataatggttcaggagaactttggatataatacattttgtgataacagtgtggatcaagaagtagaaatgaaatatgccatttgataattgaaagcatatagttagatcgtgaaagccacgcactagaatttgtctaagttgatgaaatgctgactgatgaataaggtgaatctttcttcatttgggccagtagaatggagagatccatataatttggatatttaacaaaaattttcaagtgttaaaaaattatttgaaaaaatgtataatttgcattagccagtacagaattcttaactaacaagcagaaaatccaggagtactgctcattttttaaaagtttttgattaccaggggaaatataatggcaccgaggcacatggcaatgactaattaaaactgagcactagggtctgtggctctcgactgactagtatttgtgatttaatcatactgccctaaagatttgggcgctcacttgggtgggcatagttattacagattggcctacacgttccctttcagagccagaggacatggacgtcttatttagtagaaagtagtaatctgggtcttccaactttgagctctgtgctagttctgtaacctgggccaaagttacctttggttttcccatctgtaaaatggacgtaacagcagggtggtgagaatcaaatgagttaattgat

SEQ ID NO: 38143 - DNA, 1051 bp, Homo sapiens
gatctgtgcccttaataaagaggcccaagagagcttctttgtcccttccaccacgtgagggcacataaaatgtgccatctgtgaggaatgggccctcgccagacactgaatctgctggcatcttgaccttggaattccctgcctccagaattgtgagcagtaaatttctattgtttatgaattacccagtctgaggtattttgttatagtggtccaaatagaccaagacagaagttggtactgagagtgggtgtttcatagatattatctccccatctatggcttgtttgtacatctttcaacattttttttcttatttattctgtcctcacaatctgtccccgtcaacattgtttttgatgagaagtttaaaatttttttaatgaaatctttttttaaatcaattttctttctttcctggttattgcttttttgtgacctgaggaacttttgccttccccaaagtcacaaggatgacgttggtttgctctaaaaacgtcatcgctttagcttttatacttaggcctgtaatgcatcttgaatgaacttctgtgtatatcgtagtttgtggttcacttggtaacatatggatatccagtatcccagctacatttttccaaaaaacttgaccaaatagatttcttggggatctttgtaatcaaaaatcagttgtgtaatttagaatcataaatgaaaatctatttctggtgctctcttgtttcattgatgtctttgtagatacttacacaggtactgcttttccttgaaatctgttgctttatgatgttatatcttgaaataggttgtaggagccctacttagtacttctttttcaagattgctttggattgcctttcaagtttgttgcctttccttgtaaatgttaaaatcatcttgttggtttccacataaaagcttgccaggattatttttgggaatgtgttgtatctatagatgcatttgggggaaattttatattaatatttgctcttttaatttgtaaacatggactgtctttacattcatttaggcttgtaatttctcagcagta

SEQ ID NO: 38144 - DNA, 1081 bp, Homo sapiens
tcatatgtttctttgatggcagtttcacaccacagaaggttctcagcgccttgtagctcattgctgtcaccactccaggctgttgcctgggtgcccgctgctggaaccctgggatgaccaggcacagctgcagatgcctcgagctgctccagccatgagtgtggaaaccaactcggtggtcaggcttcaacacagaaatagcagagagcccctttcagtcacaagaaacataagtcacctaatgcatatccacacgttctcagcataaaaatttagcatcttgtttgacttactttcagggaaattgtccacaacccaaatggcctattactattttattgaggttgcagaagagatcattttatcatctattgtggtttttgctatttttgatgtttcctaatgaaacttgcacttttccccccaaattttgatttttttaaaactatttttttccttttatgaacaggttgaaaggattgttgacaaaaggaaaaataaaaaagggaagacagagtatttggttcggtggaaaggctatgacagcgaggacgacacttgggagccggaacagcacctcgtgaactgtgaggaatacatccacgacttcaacagacgccacacggagaagcagaaggagagcacattgaccagaacaaacaggacctctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaacatggacctagcgaagtcaggtatcaagatcctcgtgcctaaaagccccgttaagagcaggaccgcagtggacggctttcagagcgagagccctgagaaactggaccccgtcgagcagggtcaggaggacacagtggcacccgaagtggcagcggaaaagccggtcggagctttattgggccccggtgccgagagggccaggatggggagcaggcccaggatacacccactagtgcctcag

SEQ ID NO: 38145 - DNA, 1082 bp, Homo sapiens
tgcggccttgatctaaatcaggcttgcagattaacgaggaggaagtctttctggaagaaaagcaactgcaaagctggtggagcccctgacagcaggcctcctgtggatttgggagggtcagttctgtcgctgccctggtacctgtgcagagaagagctttgttatactctgctagatcgtaagctccaagaaagcattttgtttttccagactaaatcgaactgtgcccagaatggtgcctgccgtgtagtcggtgctctgcaagtacttgtggatggagtgattccagtagaatgggtgcgcatggaagacaagggttgttgtaaggagtcatttgtggcctgggtcttttgctcagagaggagggaaggagagcaggaggggagaaatgctattgaaataacaacatatatggccagaaacacagacattccagaaagccctcgttcgccctctggcacatgcttcctgaatgaggagaagccgcgctgaagctctgttaggctgttggtccacactcagacactttttaagccattgtttgtttttactttctagactaattttagagctacgtaaagaaactgatttgtttttctaaaactaattgaagtagatactggtggagtcattgggaaacgaaccatcattcaaaacattaatcatatactgaaggaatatttttgccaccaaaaaccacagatatttgaatatctgtgaacccaaagaatgaatgtttctggagtattttcacacacactcacttttatagaataaccatatatgtgtttgctttttaattattttaagtatgacgcaaaggcttaaatgaatatattatttcactcagaaatgtgagaaattctaaaatttaggtgatgcagctagctgtcttctttctctctatcaatgtttaatggtaatttcttgctcttttaattccctaatgaattaatcctacaaaagaagtaattgcttttaaaaactggattatcgtaactttgtcctttcatggattcaaacatataattcatcatcattccgtaagtatgaaatttcagaaaatgctattagcaaactta

SEQ ID NO: 38146 - DNA, 1045 bp, Homo sapiens
gggagtggctcccagtgccccagcatgatgttgaaaagatacgtggtcctttcacctgtttccaagttgggaatttttttttttcctgaccattaggaaaaatgttgacgttggttttggtgaatctgatttgacccattcttcctgggagtaataggataacacggccgcttctcatttgtgtagacaaccccagctcatcatcatctgcacgtggcctggagggtcactgttccctgcagtggctccttgggagaggagtagcaccctgttcatcaaaagcaggtagcaaggcgcacttacagttgctgactggcaggggcggaacgccgtagggctttgtagccagggtaagaagtttgggtttttttcagatggtgaagggattgaagtggaaacatgatgtgtgctgattgacatttgacatttgattgtcttctcagtccattttcagatatttgtgagagaatatctgaaactacgtaatttacaaagaaaaggaatttttctttcttgaagtgatagatgctgaggagtccaggatcaaggggccccctctggtggagcctctttgctggtgaggactctgctgagttcccaggcatcacatggcgagggggcagagcctgcttatgtgccagctcagctcactctccccctcttcttatgaagccaccagtcgcactcccgtgataacccattcatgagggcagagcccccatgacccaattgcctcttaaaggcccctcgtctcaatactgccacactgggggttacatttcaggatgtgtcttggaagggataaatgttcaaaccatagcagctgctgactgctctgaggagagtgacttgccggtgaggtggactagcagaagtcatcagagcctttctcagagtccaggccaggctgttaatgctggtggcttgcagatgtagaccagcattactaaactcttaaaagtttgtttccctgggatcaaagctaacttggcagagaccttattgtgtcttcagaattttcttcccagtgctcgaaattcgagcc

SEQ ID NO: 38147 - DNA, 1029 bp, Homo sapiens
cagcctcttgcaggtctttagaagctcagctgagtttcttactattatctgtctcttgtgttctgccgcagttgagacagtccacatggccccagctttccttgcagcggctcatctttcctcagattgcaggctgtgtggctgccttgcaacctcagccatcctgcaagttcaagaacagttgtaattgatagtttatccagctgtaaccagcgttttagctgtgcacgggcctattcttcattctgagctattaagctggttttcatttgactttggtttgcatagaacacagggtttgcagaatgggtttgtgactggggtgggttgtgacatggtttcttagaacggggcccacacatggcccacgcatagaggtgtttcagtacagcagtaacagcccggcacggtaccacagtgttcacagttgtgggaacagggtgaagagtagactgtcctccagctgggagagtaggcagggatgagtcggtgcaagtggacgagtccaggacagagctggcttctgagcctaggaggtcgggcacgtatccttgcctttattcactgtgccctgcctgtggtttgcatgtgagaacacacatctctgtcttgtgtgctggggctggcccaacctcgtagatcatgtttaactctgtgttgttaggcataaccacagtctactttaatgacagcagatgccccactgtttagtcacactgcaaagagcatcctttcgatcacctcccagtggaaatccatgatgatgaataaattcctagattcggatttgtcaaagatttgttttgttttgtttaatatttttgatacaagttgtcaaaccatcttccaaaacacattttaccactctgctctctagccagtgaacacattttgcttggccctgatattagggttgttttgggtgtttgataaacttatgtgttttgacattagaattgtaaaccaaaaatagcattctaagccctgcagcttggaatgtgaactgcctcttggccaaggggaccctaa

SEQ ID NO: 38148 - DNA, 1048 bp, Homo sapiens
tgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaatgtttctctgattcttgtgagatttctcatgggatgttttctctttcgtgtgtgtgtgagatatacatgtgtgtataaagcatctgtacagttcaatggaatgaaaccctgtgtgactaacacctaggtaggacctaacaatttgaccagtatcctccctggtcaccttcacccgggtgaccatttcctcactttgtgtccatcatccacttctccttcaaagaacttattcctaaaataaattacttttagttctacatgtttttaacctttatatcatatcacaaataagcttctgtgactgactgacttcattcactgttaagttttctcttacgtagagttgtaacttactccttctttacccaaacctgtcgtggctgttttcactcctgttttacagatgaggaacctgaagaattaaacacttgcccaacgtcatgtaggtaatttgaacaggagtagcatgaagcttttacccaaggtcgatgtggcaaagcacatattctggcaaagacaccaagatgtcagtgttgtagaattcacaaatagggaactgagtaaaatctccaagttgtctgtctgcatcatccgagactttgaatcctctgggccttgtgagccacctcccctttttctgaagcaaaccttccaccttccaacttcttgcacaagaattgatcccaactagaagtagcactggcgacagcagtgaagtgcttctgttttgtgccctgcgtgggtgaggaggaagggaaatgcgactgctcaggtgggtgaaagtctcggtccaacttttgaagagaatttgacagtaactgtcaaatataaaaagcctggacccagcaactccatcaataaggattcatcttaaggaatgagtggtcatagga

SEQ ID NO: 38149 - DNA, 1064 bp, Homo sapiens
tcagcctcccagagtgccgggattacaggtgtgagtcactgcactgggccacaattagtatttgtgatgttagaaactaaaagtgctggtaagccttggaaagaaaaatcctgtggtctctgagagcttcaaatttaatcttggcctcattacctaatcacatcagaagaagagaatctgtgaaaaatggaagtgatcaaaggacgatgggttcccaggagaagggaatctcatggcttccaatctattcacagctttgacctgcagactttagatatgggaggaatagactaaaaacaaactttgtcattgttgttattgccttggagacggggtctcactctatcactcaggctggggtgcagtctcagttcactgcaacctctgctccccaggttcaagtgatccttcaacatcagcctcctgagtagctgggactacaggtgtgtgccaccacacctggctaatttttgtactttttgtagagactgggtctcgctatgtttcccaggctggtcttgaactcctggactcaagtgatcatccaccttggcctcccaaagtgctgggattacaggcatgagccactgcatctggaaaagcaaatttcttattttgcaatttggccttggggcctgagtggccaagctatgattgtctgtttcctctttggagtggggaaatgtgtgagctgaagcaccagtcacatacacacatgtctatatgcatttctgtacaacccaagagatccaactttagtaagagggaaaggaaatcagaacatagagggggcctgctgtttaccagtaacttgtaatcaacatgtcattgagtcccatctgcaatgggtgtgtgtatgagttagctattgctacataacaaaccatcccagaacttaattagctcataattgagctggttagcaatttaggctgggctcagctgggccattcttctggtctcaactcagctctatgtgtgtggtgtgtgtatgtgtgtatgtttagctctgcttctgggggtgagctggctgtcaactggggtaccttggttctcctgcttat

SEQ ID NO: 38150 - DNA, 1045 bp, Homo sapiens
gaatagatttgggtgtcagttaaatgctttgcttggtgtttcaagtttaatgagacagctgtagaataaactaaaatcattttctagaacatactaagcctttcccatctgactaccttgatacttcagtttctttatctggaaactgtctttttgaatggcttatctttttaatcttgatttaaagtttacttcctcagataggccttccccagccattctttttttttttaatcaaaaaataacgtctcctgtcctatttttaggtttctaatgattcctacttgagttgttaggccttcgcagcctcagaaagtatgtaggtttacagtaaattatacactgtgtataattcatttttcaatatattgtaggtatattttaaggtttagttaagaagtatgtaggggtagaagatcttatgtttttagtgacattttatgatttactattggcattgtattttccttccatttttaatttttgatttatattattttaattgtattctgtcagattggctggagctatcctggactttagtttgagggatgacactttggggagtaaagattgggtttactttgtactcgagtcttccacaatttcctttgtagggctaaccgttgtcagcaagtatttatgcaactgttgtcttatgactacatagcatgtattggtcatagagtctaaaagcttcttaaacaaagcatgggatttaagaaagaagaattagcagattaagccttaataatatataaatactttacaagtgaaggtaagacttaaaaagatttaatagcataaactttaataattcatgtattagaggcatcaggtttaaaataaactgctgttctttcacttattttgtcttatttccgtctttaaattagaaatgaaaagaacctgtagttgttttgtttttactgtgtcaaaaaaatgcttaaaagtcatgtttcatggtggatttttaaaattgtggtaaaatatatataacatgaaatttaccattttagccatttttaagtgtgcagttcagtgg

SEQ ID NO: 38151 - DNA, 1272 bp, Homo sapiens
cattttggccttttttttttttttttttttttttttttttgagacgaagtctagctctgtcgcctgggctggagtgcagtggtgggatctcagctcactgcaagctccgcctcccgggttcacaccattctcctgcctcagcctcctgagtagctgggactgcaggtgcccatcaccacgcccagctaattttttgtatttttagtagagatggggtttcactgtgttagccaggatggtctcgatctcctgacctcgtgatccgcccgccttggcctcccaaagtgctgggattacaggcgtgcgccactgtgcctggcctattttggccatttttaagcatacagttcgctagcattaagtacatttatggtctcatgtaaccatcaccactacccatctctagaactttatcatcttcccagattgaaacttcgtacccagtaaacacgaactccccatcccctctcccccaagcctctggcaaccaccattctactttctgtctctgaatttaaccactctaggaacttcgtatgagtggaatcatacagtatttgtccttttcatctgatttatttcagtgagcataacattttcatggttcatccatgtcgtatcatgtgccagaatttccttcctttttaaggccgagtagtattacattgtctggatagagcacactgtgtttctccattcattcatcagaggacacttgggttgcttctacctttcggctattatgaataagactgctgtgatcatgagtgtacagatatcttttcaagatcctgcttttagttcttctgggtacagacccaaacgtggaattgcttgatcatatgataattctatgtttaatttttcaggaacctccatactgttttccacagtggctgtaccattttacattcccaccagcagagcacaggggttccaatttcttcacataggagataggtaattatttgtccttcactgttacaacagcggaggaagggtagcacagagaggttaggtgagctcacatagctaacatgtgcagacctgaatctgaatttgactccagaagcttacctcctgtgacatacaggtaaggtgaggcacagagagtccaaggggcatgactgagggcccctgcctcatagcatcagtgattcagagcctgccttcagagttcatgttatgaaggattcgtagagttcgctctttttaaataaaaattctctttaaaaaaactaattttggcctggcgcagtggctcacgcctgt

SEQ ID NO: 38152 - DNA, 1034 bp, Homo sapiens
ttcatcatttcacagcgatagctcccatcttcagtccttaccaaaaacaattgttttatttgaaagctttcttttggaagcaactaatgcattattacttttatcaatttaataacaattaaatctgtgttttcaggttttaatcatttttttattaagcatccatacattttgaggggaaaattaattattttggaagtactcatcatatactcatagaaatagatattggatattatagggcatataatttattttttaaaagatgcaaagattctagatttttctctgatctgtaaaattttccctctcaaaaaagtttttctttgtttatgctccataatttatttattttaaagaccgactgggtcatttaaagtgagagagctttgttggacggaggataatagtgcataaacctgtcttttatgacaccttggacttaaccttctttgtacaatagagacactgagggttggccttaggaagcctgggttgtttttgtattatgactcgagagatgctgaaaaaacctcctactgctttccttgtacctcagattatacaattagagacttaggcttttaagtcttgacttttgattatgagtttctgttaaaatatgacaattaggatgtaaaggagctgccatccagaatcttaccaagatttctaccaccaactgagaggacagaatagaatgacccagtggcggaaggactcattcctgctgggcctgagggaagagctggagggaagctggcttcctcaaggactttccagagctgatcctggttctgtagttgacagagcaggagtattaccatcttggacaagcactgtcattttaaaattcaccttgatcagaaaccgcctaaatccaaagggtatcaccctaatggctaaggtcagcatgaccataaaccacaaataacatcttcaaccagaaacgttccaaactcctccctgaccagagacaattatagccccaagataacctccctccagccgggaagatgccagcccccaagata

SEQ ID NO: 38153 - DNA, 1040 bp, Homo sapiens
gtaatgaccagctagattataaaacatgaagtgggaaagttgtggttattttctgacttacttattttgagcaatgctatcatattaagtagatattttagatagtatggacatgtctgaggaacctcctaccttgccggacactgaggatttattcaccttgagcagaggcaggcaggtgtctttctgaattggtggtggctgagtataattgagtttcctacactttaaaaactgtactccggccactgttttgattctcttgtttgactggcctgtttgtattttgggcagtcgctagccaggtgttagacctataatttaccatgtaattctctattgacttgagctctgccgttgtgcactttgtacatcatctaccatctactgcatcatccctgtttgcttcaggctctcccagtgtgactcatcattaaatatccagttggaacctcaacctcttccaggaatgcctcctctggcatcctctacatgtgctgttcttcctcctaaacctccaagggacttgatgcctgtcctcttgttaatcatatgctcttttggaaatgtatttatgtttccctatgaatatggtggccctctggcttcatacatttaaaatgtttgtggtcagggatgatgatgatttaaacaacagtattttggaaagtaggactttttttaaaagtcctctcgcattatcacttagtgtacagcaactattgtagtaaaactacttggcagtgtagcggtaaaatagtttaatcacagtggtacaaagggtgcagggagtatggcactcgtacattgttgatgggagtcctaactggcgcactccctcttaggagatccatttggccctatctgttaaaatgtaaaacgcacaaaccatttgactagcaattcagctttcagaaatttattctaaaaatgcttgcttctgtatgaaaagacataagtatttcctttatagagttactgattttagcaaaatattggaaacaaatgttcatcagtaaggaaacagctaagtaaacatg

SEQ ID NO: 38154 - DNA, 1035 bp, Homo sapiens
gatatactttctctttgcttttcctatatcagcatgaatctatttccagtctgtccctgtctctggtagttgatctctatagcctctacacatacttaacatggttcactgttgttgatctcagttggtgaatctgtaatagcatggaccaaggctgtactggtaataaacatgccttttatataattagtgtcttttgtgtgcaaggcactgtgctggacagaggaaattaggaaaatggatgaaacacaccttctccctgtgaaaacttgtagttctgtgtagtagggcagataagattatatcgttagaacatagtcatgcatataaatgcattttgtgagaacgagctttgtgagatgagaaaagggaactatgtctgtcagttggatcagtagagacttcataaaggagatggtctttgaattgggccttaagtggtcattctcagatgtgtgactagtaattacttggagaggttatttaaaatgtctgttcatagagcatcagagtctggaggtctgggatggagatcaagatatgcatattaaacaaataccctagataattcttacgaatgactcacattcagaccatactttgaaaaccctatctatagcataggttgaatatttttcccaatttttttgggatataattgaagtgtaatgaactgcagatatttaaagtgtccagtttgatcagttattgacatacgtatacaccagtgaaaccatcaccacaatcaagatgataaatgttttcattcccaactgtttctcatgccctttttgtaatctgttcctccacccatccctgtcttcaggcaaccactgatctacctgctgtcattatagattagtttggattttctactattttatataaatggaattgtacagtgtgtattcattatacctggcttctttcactcagcatataatgattttgagatttatccatgttgtgtgtactgtgtatcaatttattcctttttatttggagtagtgttttattgtaaaattctttgtgtgg

SEQ ID NO: 38155 - DNA, 1023 bp, Homo sapiens
ggagatctaacttctagctgtattgccaactagctctgcgacattggacaggtgacttgatggctcttagactgtttcctcatttataaaatgggagcagtagtattagctattcacggagttgttttgaggattgaaagacatgatgcacagaaagcacccggaatgaatgaaggtctcttacatagtaggtgctcacaaacgtttaacaaattatttatgtttttctcataaagcactacagatgtaatgacagttcaatgactttataaagtacaacatgctgcacaaatattttactgtcatttgcttttattttgtctcttgtgttaatggcatacccctctatattatgaaaataccagtttggtttaaagacacagtggacagtgtcatgtgatacaatgacagtgagtgccagcgctatttcagcagcaagaattattggagttcctgtcagaagttcatcttgggccactattggggcctttcaatactccttacgttgtttttctctagctcttgttttctgtttcctccttttttttttctttttttttttttgtggtgtcaagtaggctttgtgaggatggtttaaaatgtagggtatatactcagagtttaaatagtcagtgactacttgtttgagtcaggtttggttttaaaaagtaaaattctatgttttagaaccataataccttcaaagaaagcagcagccctggtgatcataccatccacccatcctttagttcacaaagaaggcggagaacgctcaggaggcctgccaagctcctgtagccgcaggactggaatccgggtctgtactggctgcggcttcacactgcctcgcttctcagcgggctttgaaactctgcgtgtttaggtgtccttgataggttcttattctttttgtatctttctattgctagtaagagcaaattttctgtttgcactgtagagacttatttcctacattttgggaaggtggtcctcctgtggaagggcaaactccattattaggtt

SEQ ID NO: 38156 - DNA, 1030 bp, Homo sapiens
ttctcctgcccagcattccttggcgtggagctcgagggtgacactgggtttgcgtatgcagataagagaaagggaacaagttacaaggtttgattaaagcagcggcccctccgtctggtgaatggctcctagtttacaccacgtagctgatgaaaatgtcacaaagaaatctcgtgagcacactggggaagtgagttgttcctggtaggacacagttggtcctggtttttacaattccagtgcagctcggcagacaaggggcagactcgatgggcatagtgcaggaaaatgggttcttaagggtaaggcgagaggtcccagctacttgtgagtggcttacttttccaaggagtcgataatgatggagaaaaggatgtccagagggtggtccatctagcttggcgccagagcgggagagctgtggaagctcagcaggaaagactgagcgtggggactgtggtctctgcagaaagtgggtggtttctttatggggatacctgctggagtgtgctggtttttaaaaaacaggttactgggaagagcattatccacaacacaacatctatatataccaacacatagcatatgcacactcctctacatgtttatatatacacatcgtttctggtttattttcctcttactcaaaatacattatgtcgcccaattttgttttctcatttaatgtggagctctttatggtggtgttaactgtaattttagctctacattttgtgaggcccgccagtgttgggctggggattaaggagagtgtcatctggatagatggcaagaaggcagcaccgctagatttttataggacaaccaaaggctggggtttggaggggttttttgtttgtttgtttggttggttggttggtttttgctcccttttctatttaaacaaagattttgcctcatttcaaatttttttttagttcagtgattctgtggatatctgcagagtgaaacgttacattatttttcctcaggggtggcagatgagttagtcgaccccttagggaagact

SEQ ID NO: 38157 - DNA, 1111 bp, Homo sapiens
tcaaattctcaagacaactagtctgaatggaagctattcttagcatagtttaagtaaaggagatcaatatagatattcaagattgaaaaatcctaatagttaatagaaaaacaaaattcaaggtccctctaaccttcaaagccgagctgtttcaagtgcttctcaagaaacaaatgtctcttagagaatgtagccagggccctctaaggcaggtgtgctcctgcatcctgtctgtgtggagtccttcttccatgactggaattgtctgagatcttggataccactctgccccacaggcagcttcactcagccagtggctggaccaagtggaggtcggaaattgaaccctgtaccatgtgacccgctttatgcattttacatactgtaattatactgcttgactattttaaataatatttttacttaagtttcatgcttcttgcaataaaaggagaattttttttccttctcaagctataatgtaaaaatgtcagggcagttattatactcataggtgcaaatttgtttaattaaaattacactcaactgttctgacacatttttaagcaactgtgaaaaatagctattatgatctgttggtatgcttccttgagtggctaataattttgttagatcatgatttagttctttttcatcggtaaatatgaaaattaaagttagataaaacgagccataatttcaaactttgtatttgtttatcagttgggcttttgaattaagttttaaaaatcactttttcaccctatgccccaataaaaattcagaaactgtatctgttaaaatgtcccgtaggtgtattctgtggaaaaatagatccaaaaaattcatagcagattataggaggagaatctcttcacaggcgagacgtgctctacaggcgtttcaactctgaatccgaggtctcagattcaaggatatgctacaaatctattttaagttgttctccattcagttgctgacactctagaagggccattccaaactttttgtggtgagatgggaagagtgttcttttttctttttttttaaatgagatgaaattcacatgacataaagttagccattttgaagcgggcaattcagtgatact

SEQ ID NO: 38158 - DNA, 1120 bp, Homo sapiens
gaaagaaatgccaccaacctgcccctccactgccaggagttcaagtcaggagagcagccagcctgactatagaagaactacacagtgcctaaagttccaggaaaccttccagttgcaaggagagagagcagtgctattttaataaatagtacatgatagttttgctgtataccaggcctacacagtgctagacactggaggcaaagacagacaaacagacaaaataattaaaatgtggttaagatcatatccaaatgtaaattaggtccaccactgtggaaaacagtgtggcagttcctcaaagacctaaaaacagaactaacatttgacccagcaatcccattgctggatatacacccaaaggaatataaattgttctattataaagacacatgcacatgtgtattcgttgctattcaaaatagcaaagacatggaatcaacctaaaggatcatcaatggtagacgagataaagaaaatgtggtacatatgcaccgtggaatactatgcaaccatacaaaagaatgcgatcatgtcctttgcagaaacatggacagagctggaggacattatccttagcaaactaacacaggaagagaaaaccgaatattgaatgttctcacgtacaagtgggagctaaatgttgcaaacacatggacacatactggggcctatcggagggtggagggtgggaagagggagaagatcaggaaaaataactaatgggtactaggcttaatacctgggtgacaatataatctgaataccaaacccccatgacacaagtttccctatatgacaaacttgcatatgtacccctgaacttaaaataaaaattaaaaaataaaaataaagattaaatttggctgggcacagtggctcacgcctgtaatcccagccctttggggggccaaggtgggcagatcacaaggtcaggagttcgagaccagcctggccaatatggagaaaccccatcgctactaaaaatacgaaaattagcctggtgtggtggtgcatgcctaaagtcccagctgctcaggaggctgaggcaggagaatcgcttgaacccaggaggtggaggctgcaatgagccgagatcacgccactgcactccagcctg

SEQ ID NO: 38159 - DNA, 1067 bp, Homo sapiens
gcaagcatgcaacacctgttagatctcgttgttctcatctctgtagctcctctcccttctgacccgttcccccagctttcaatgtcagaccacacagattgtgttcagcaaatgaataaatgaccatgaatgaaatgaatgttgggcccatcaagagagaattagagaacttggaaagaagagtggacattctcaatgaggagggagaaaaacagcacagtgccaaggggcggagcccgggagcaagagccctgatccccggacacatcaagctttcctgccatgggtcagccggactccagccccagtcacgagctcctggacagctcctagtgagtctcctcttcgcttccctctttcttttttccaccagagataggtaggaccttttcatatccttcaaaaaaaaaaaaatcaggcatgattcaaatcctgttcttctattcactctgccttcacttcacatcacttccacagttgctgaattcttccttcatgccacatactgtgcaaggctctgaaaatgcaaccaccaggagacagtcctggccccaagcccccggctaggtggtgcccaacccaacctcaccttccacaccaccaccaatggccagacaggtgaagtgaggggttgagcttggattcccttttcccagaaagaggttttgtgtgattttaacttatttgcagataattaacctcagggtcaaaaaatcctacccttctgcctctgcggagattgaaattagatttttgaagagaagcaattgctgtatagaattaaaaacttcttgatgaatactgccatcatgacatggggaggaaatcacagtagcactttctactgtgtaattaaaaaaccaaaaaagcaaagatgaatggaatacccacaagtgaaaatgggatttcgttttcaacagaggaaattggagttctgtcagttacacatggagtgtgtcctgaatcatttcaaattacagcaggaggtcacgtgggccattttctttaatctatgcaataccacggaccaggaaagggaatttttgctctaaaaagatgtgattttt

SEQ ID NO: 38160 - DNA, 1032 bp, Homo sapiens
aagtgcttatctgctaactagagtttaggctcagatttggcagatacattcagatataatattctaacgtagttttatttatcaggaggctcatatattttcctcttcaatacagaaaatagttttttgttttctttttgagacagagtcttgcactatctcccaggctggagtgcaggggtggaatctcagctcactgcaacctccacatcttggattcaagcgattctcccacctcagcctcctgagtagctgggattacaggcgcatgccaccacacctggctaatttttgtatttttagtagaaacagagtttcactatgttggccaggctggtctcaaactcccaacctcatgtgatctgcccgccttggcctcccaaagtgctgggattacaggtgtgagccaccgctcccgcccagaaaataggttattttaaagtcagtttttcctttgctttaggaattttaaatgttttggaggataattttataaaactagtgaacatctcaaacaggttttctatggcttggttagttaaatctgtatgtatttggctaaagtgttctattaaaagtttaaaaccaagtatagtttaaaggaggcttaacttgcgtgtctctgaatttgatttgtatttaaatcatgaaaagaaggtttctgagaaccatttgttcaaaagcttaataaggcttcacaacctcctgtcctggagtgtgattcagtatgagatttagcgtccttttgaaaatagtcagtttttcaccaccaaatttgccaatcccatggtgttttttttaattttttttttttttttttttttttttttttagagacagggtttcaccatgttagccaggctggtctcaaactgctgacctcaggtggtgcactcacctcggcctcccaaagtgatgggattacaagcgtgagccactgcacctggcctcccatggtgttattatttttttaacatttacagatttttattgattcaatacatatttgaatatccactatgcaaggctact

SEQ ID NO: 38161 - DNA, 1057 bp, Homo sapiens
agaagcaatctggattaggaggccagcattctgggctccttttttcccatctgtggaataccaccatcagcaagcctgcatcaagaaccgtttcttgacacttgccctgggtaccagcctctggaaatgcaaggatgggtaaaacatggtccctgccctaaaactcgtcagtgcctcataaccagcaaggacaagtggaggggcctgcaagtgggaagtggttgggaaaagaagaggaagtgatgctctcaaatgtgcagggcttgtcatgtggaggaggatgatgtggggaaggaaaacgtccttctaggcaaaaagcagtttaagtacaggccctggagtatgaaaatatgaggcttagttgaggacagggtagggcaaaaagtggaatgtgactagaggatagggcttaggcgtgttgtattgagttggaatgatgagaagtgttggccctggaaaaatggacgggggctcggtggtggagtctgttgtgagccatcaaatgctttggagcaggactgtgatgtgagcagctctgtggttcagagaactgctaaccctttagaaaatttaagtcggagagaagacaaggtgtttagcaaactgcagtgtgaacttggaatttggtattctctttaacagaataacttcttccctttttttttacaagagatttttcaacccaggatatgtgggctgccttctgaagccttgttaaatgataggggaaaggtgggaacatttattttcagcaaatataattcaacaatgtttagacttccctaattgtgttgtactagttggtacttacttaaggtcattagagattggaattctttagaggagagggactcatttctcaaaaatattgaggatggacactgggagctgaactgggacaatgtattcctcgtaaccacgagtttggtgtgtcagttgggagtgactgcagggtgggataggtgtgagcagagggccagctaatttgctgtcttgatgactctgtgggtgatggctttaggggctggcagcgtctggtggaaatagaatctgttca

SEQ ID NO: 38162 - DNA, 1027 bp, Homo sapiens
agttttatgtgccatctgtatattttcaaaaacatttaacatgatctttatttcaagcttttatagccctttcaagttgctctaggggacttagcaaaacaggtagacagtaagtatggatcaactgagcacaggaaagaatgggatttgggaagatcacattgtttggattttctgctgatactaaagctggatttttactacacaggcagggagaaattactgtcctgtggtggacctggtgagagaggtggcatatgactaagcaagtcagctgacctcaattaaagggctgtgaccatctgtacaatgggaccagtacctcctccaactgttggtctcagctgagtgagattcccatgtctgaggaggtgatcaggggtgatgatgacttttgatggaactgacctcacacaggtttctgggggaaaaaacccaccaaactttattttaagaattctaaaacaattttacaattctgatttgagtagaagtttgatttgaaaagggacttcatctgcaccttctctcttgcctttgtttatagatgtcagtaatgcccgtattttaaaaagttgaaatgagttataaattatatcttaaggattttagtttgttttgaagaattgtttaattggctaggatttctccccccttcagtagcttcagatcccaatggctaggcaatatggagataatagtaaacaggattttgtaagagatgttatttatttatttatttttaaatagagataaggtcttgctatgttgcccaggccggtctcgaactcctgggctccagcaacccgctatcctcagcttcccaaaatgttgggattacaggcatgagccactaccctcagcctgagacattatttgaggaggaggtcatgaatatataattaacttaggagtacaaatgaaaagttttctcttgaacctacctttttgaacagaagaggtgatttttaggtataatggtgtgcaaagtaacaaataacagcctctaaagacatttaaaacaata

SEQ ID NO: 38163 - DNA, 1985 bp, Homo sapiens
ctgttccggtggctaaaggttgcctgctgccaggcgccttgctgagtgtgccctgccttagtctgagacagttcgtggggtcaggcttgacccccagcaggcccgcttcatgagctggcgcctctgcagccatgtgatgggcggagccacgtggggctagcttaccaagccagggcactgacttctgccccaaggccgggcagggaggaccccagcaccggccactctaggaccctagaatgagttcagtgactttacgtggcaccccctctttccactttgagacttacctcacttttgctgcaccacctttggtggtcgcttttctcttaatagtgattcttcattcttcatggggggataacttttctcttctacacatgctgggacccctctccaggaggttctggtggagcatgaaccagtggctggggcattggaagcttcccaggcgatgcaaatacaaagccctaataaagctttcaaaactgcgttagaaacaggtcacttttacatttgtgttggaaacttgtcttgagacaaatgaatacatttgagccactgggatttttggggaaaatacagctaaaagggttaggaaatgatacataaggaaattctcccatctgatgctggctggcttgcttgcttgctgcaaacccgagtgttttctattaagtgaggcattgtggttcctatgctagccctgatgggccttcagcactggcaggtgtaaatgcggctcattaattttttaagaagttggaactctgacagttttcagggatgctgagtagctggtaccagatgtttcttttgttaagggcatggagaggcagtgtcacaggtaatcaggctatggtcgttcactcccttggtctgagactatgcgttttgtggtgctgaatgttttcttaaaccaagaagggtgtggggaggtgcatgttctggtttctagttgggctttcccccgacactggctcttgcagtattatcttaggtagaggtgttgactcaattatcattagacccagctcctgttggaagagagtaaatggtgcttggggcctctttatctagaccgttttgccaccgctgaagtgacagcctgtgcttctaactgaattcagtccttttttttcactccctttctgtggaacaacagcaaagtcggctgctcatcattcgggtgcagactttacagcctctgaacagcctctgcttttgcagtttatgaatgcaccatttgttgttttgagcacaactgttagatacaactggcctctgcagcccactctgccggcgaccagtgtgcatcactgcagcctttttttctttctttttttttttttttttttgcataggccaaatttttgctttaaataccaccattttgtccacactagaatttctttgacccaacttacattttttcaaatgtaagtttcagaaataaggttttaatttgctcaaactgttggtctagggatcctgaataagtgcaagtattttactttattaaagggggaattgtttttgtggcttggttttgcacacttttttttttatattctcaaacatgtgacttccaaattttcctttaaattgggttgaagttagaaagttttattatttcctaagtcattatattttttctttttgagctttatgcacaaataatgttttcagtttagaacttaagatcttaaatgttctcataacaaaaaataaatatatgaggttatagatatgttagcttgatttaaccatttcacaatgtatacatgtatcaaaacctcacctgtacactgtacatatacaattttaatttgtcaactatattataatgtgaaacttaatttttaaaactgaatttaagggaaactgtcaaaaccaaactttacaatgtggtattgaagagtatttataagtaactgtttaatttctcattcttctgctcttgaaacatggtcttatccaaaggt

SEQ ID NO: 38164 - DNA, 1047 bp, Homo sapiens
attttgtgtatttcatgaattttgtagtcttaagttgttaattgaggtgttctggattgtaatgtgttttggtgtgtgtgtgtgacagtgaaggaggtattaatctttgtgagagggtttttttttttttttttttttgaggaaaatatttttaatgtttcattccacagtctggtaagttgtatactgttgacagctcattacctacatgttaaactgcaaaatgttcctagattagtagaactattatttttttttaaaaaaagtagctttgtggttaaattctgatgcccttaaagagatcactttctcctgttttggcaaaacaagttatcagtccacacgtgattacataaataaaattgaaaccctttactcttgctcctccctactcaattaaagtcaagggattccagtagtggtatacacacacacacacacacacacacacacacaaatcctccaatgtatttacttttcacatttttaatacattttagcggactgagctttctaaattattagcaactagtacataatcatgttgcagtaaataatttttttagttagtgagaaacagaccgaaaataggaggttaaaaacagttcatctgttttggtgaatagaagtgaatgagagtagggtagaaattctggctgattttataaaatatctcagatctgtttgataggttgggcttaagactgatgatgtgggcatcctctttataatgaagtcaggctaagcgaagctatgttgaagtatcaaacaaagcctgaaatcccagtggctcaacccataaagtgccgttgcttgttggtgtagaatcctctgcaggtctggcagctctctagtatagctcccttacaagtggtaacccagggatccaggctgctcttgtcttatagctactctgtcattacacatgcttccaggttgccaccacaaggaaagagctagtgggttacatactgactttgaaaggctgcagtctggaagtgatggctggtacttgtgctcacagctcattggccaggactagtcatg

SEQ ID NO: 38165 - DNA, 1033 bp, Homo sapiens
cctggggaagaagaagaggccatggcaacacagcagctgccctgaggtatctaaggcctgtccgtgggaaatgagagccttccactgatgtctctggactcacccaggaaggtcctagctggccgattatagctctatgttaatgagagttctctttgggtgagaggaacatcaattcatccaacttctgaggtcttttgtttgtttttaagaatgtctgactttgtatggacatattactatgtatttttgtggattttgtaaatagatatggggaccaaataacatgaaaatttattttagcaaaacacaagcaggcaagggaaaaagacaagcacaggaggatgtagggtgttactgattcaagggtagggcagttaggaatcatgtctagagtaaaagatttttaaaaggttagtgctggttcatgtggactgccaacacctctctaccccctactggatctgaaagtcaggagaggaggaaggagctgtagaagcagcagagaagggccctcagttttctaagtagacagtcattagcaagagaatgtcatccctcaacccttggcccaggagtttgaggctgcactgagctaggattgcaccactgcactctagcctgggtggtgcagcaagattctatttccaaaaagaaaagaatacatatccttcaggcattataattctagctcaatgcatcattaaggaagtatctgtaccaagaatgcagaagggtctttacccaggaccaagatagaaaaggaactgctctctccaaatactgccaaggaacctgaggtaggagagcagagatggtggtccagcctggagaaccatgaccccatgcctgggtttggagagaagctctgggctgatgagccgtggagattgagagtccaccaaagcgtttgcttataaggaacatgaaaatgaacccctggtactcctggacttcaaattaagattccttaacttctgataaaatttaactatccttatactggctcccttggaataccatgctacagtca

SEQ ID NO: 38166 - DNA, 1078 bp, Homo sapiens
gccagaggctctgcagtccttgagcaaaactggaggtgggaatgttctatgcctgagctgtgggctcctcaccctcttcactttggtagtaactgtgccaccttgggccacagtccaccagagaggaagtgtccaggttcaggttatatccttaagattccagctggtgatccagaacagagttaactgactggcgtggtcttgggagataggctgggtttgggggaagagcatgagctcagagttggtgcacataggtcggctcaagctctgaggctatgggcaggttggcctccctgcacctcagctgccacatctgcaaaatggaaataatgatctgtctaaggttcctactaggccctcaactaagtgttggccccagtccctcctttatgaaaacagcttctttcataaatcccaagaacaaaataattaccattttgtatttctataaatattgtgtcatatgattcaaaagatatagcttgaaatgggctcatgaactgtttacagttgtcaacctctaatttttaatattctcatatcaactgtagaaaagggcgtggattttgttaattaaaattaattttgagtaatttattgaaagggcaggtttgatgctagtttacatctcttatactttctcaactcttagatgctttctttaaaatgagcatttctaaaattggagtgtgaaaaacttgccagcctttcttttttgctcctaatgctgatattgagggatggtgtcctcaaatcataatcactttggaatagaggtgcttagaacaaagctacttgttcccattaactttcacaaggctttaggaggccaagaactaaataatggttgtctgtgattcttaattattattctatttctttcctttttttttttttttttttgagaccggttctcagtctgtctcccaggctagagtgaaatgacatggtcatagctgactgcagccatgacctcttgagagccaataccgtgccactgcactccagcctgggcgacagagcaagactccatctcaacaacaaaaaaggagagtacagctaaaaagagagcaga

SEQ ID NO: 38167 - DNA, 1011 bp, Homo sapiens
ctctttaaatttggtttgagtcttgcttcccacgtttcttaatcccactgtgtgaaaagcagatatttagaaacgtgaaggaactcgacacctttatgtaacagaacaacacatcactttctttagattgttgggggaaccctagggttctaaggaagtgagtttcctgatgtttgaaatttgccaatgcagcctttcaaaaatatgcttagcatagtttaaaaaaaagaaaattcacccttcttgctgattgtgaggaggtcagatatctgtccctcagctgtcacaatggtagacttgatggagttacatgacagagaagagagcccaaggaagcacctgagtggtttctcatctctgggccactctgttaaggcctgtttgttgactttgggattttcatcttattctggagagttaaggtcgccagatgaataaaatactactgttagtgagcactgggggagctaatcccaaaactgtttagccacaaggttaagaagttaaaaaaaaaaaagagacttttggtgtccttgttttccatttctgtaaatcacattgctgataaatttgcctttgggcatgcaccctgcccattttaggtactaggctcagttactggctacagattgcagattcccttttcagggctgatgcttttaacagtgatagttattcctgataagtaccttaactctgctgtgaggtatcaaaactgctggatctatttttggctgcctctttaccattactccctctagagaatgtccataccataacaacatatttacatatttatcacactgcatttctatcccagctcagaattgtgcaactttctttaaaaaaaaaaaaaaaaaaaaaaggatatcctgtcttcttccaaggacatttgctgtcagaagaacagatatctgtgccctgcctaaataggcagactgtgtagcacagacagccattaattcaatgctttttaaaattttagggcctcacggtggctcatgtctgtaa

SEQ ID NO: 38168 - DNA, 1050 bp, Homo sapiens
acattattgggctaattggtgaaatctgaacaagttctataaattagaaaatcatttgtgtcaattgtaaattttctgcttctcatcattgtattgtggttatatataagtgaatgtttttattcttaggaatgatatgctaagatatttgggggttaaaaagccatgttctcaaatgattcagaaaaaaataatatgtatacatagataaatatatgctgaaatatttgggggtagaagggcatggttattctcaagtggttcagaaaaaataatatatacacacagataaatacacacacatctatggagaggggagaagggggataaaagaaacacaacaaaatgttaacaattgggattccgggtaaagggtctcacaggagtggttttgtcccgtttttgcaacttttgcaagtttgaaattatttcagaattgaaataggttatttgatgtctggtttctctgtgtttgcctccttagtcaaaccggcacgatgtccaggcaccagaaccagaacaccatccaggagctgctgcagaactgctccgactgcttgatgcgagcagagctcatcgtgcagcctgtaagctttccctgttcccatcgcttctcccaaagccttggccacacccgactgtcctctggttagcttctgctggccggggcctattcactgacctctttcacgtagtgtttagagacacgctttttcagaacagactacagagagatgtgtgtcttcttaacctatttgtaatgttggtttaacaatgagaaccagctttcagacagttccccgtccccctcccaacaaatgtttacactacagattgccacctttttggaaataaagcaatttatgatttacgtgactttttgatactttcccttctgagaaatgcaacctggcatgtttctgttcctgggttgggatggatcttcatgtgcaccatcaatttagtatgattttttttttcagagaaaatgactatattgagataacaattctatctgagaaacagaaaaatggggaaaaataggcaatg

SEQ ID NO: 38169 - DNA, 1060 bp, Homo sapiens
gctattatagtgcagaaggaggcatagacactgtgtaaatgaatgagtgtgcctgtattccaataaaactttatttacaaatagaagtgggccacatgtggcccttgagctatagtttggtgaccgctgccctagactgccatctttgggccacgctcaaggctgacattagctggtaccactggtatggccatactgcttgttaaaaaacacagaaagttccatatcagttggtaagaatcactgtcttgagccccctaagccctttgcttggatgcctcgaacctccccatgattcagcaatcctccaggaacagggctcggtgtggcaaagggatgccactccagtgctagccccagtgacagttctgattggtcagtatctctgctatttgggtgatacatattttgactaagactcctcatggtgtctatttgtgaaagctgattttaaaatttagttttgaccataccaagagatatatggtgagaaattctctttccaacttttagaaaaatatctgcttgacttagaatgagataaaaactgcttactagctttcatgcaggctcacctatctcttggtgttcatgcatctgtacaactgagctaggctaagacagctgacattttcttgtttcaggcctatatggacactctgcagacgcagtggagttggattcttcagatcaccaagtgcattgatgttcatctgaaagaaaatgctgcctactttcaggtttttatatttagtgataattttgttgttatttaggtcttaatacctaatcttttgagtgtgttttataaagcactgaaaataatcttcaaaatgttgcataaatcctcttcattgattttgagtgcagagtagcatagatttgcaaccttgccatcagtcctacaaatagtttcccgctgccacatacctaaatactttctgcacgaattttttcctttagccacctgtcaaagagatgtttagggatgacaatccttgaaacagaactactagatgaaattgctcattgagttgctgttcattcactgatcactctc

SEQ ID NO: 38170 - DNA, 1038 bp, Homo sapiens
cctggctctagcatgttttccctttgtgcctcttaggattgagcagtactacgaagccatcttggctctgtggaaccagctctacatcaacatgaagagcctggtgtcctggcactactgcatgattgacatagagaagatcagggccatgacaatcgccaaggtatgtcctcagggccacttaggctgcctggagggagggcagcgctgccccccgcagtgcctgtgtccaacagttcaaccttcttgctgtgtagcagtgcttttgtgtctcgtcaagcaagtcagctcagccctccttagaggttctggtctgtccaatagagaacaggagggattagcatatggctgattatgagagaaagaagcaatactaattcaggtggcctgacaagcaagccagaagtgcctgtggaaaagtcatgcactcctgtaagattctggaccctatgctcctttgatgtaatggaaagttaggtcataaaggattaactgggtatcacaaaagtaaaaggtgggatagaattcttggaagagcacccaaagcattacttactctaaatcagttgttttcagatcatggtctgaagaatcctagcaggagagggagatcctttaggagtgacagggatggaagtgaggagaggggcacagaaagtaccttttggggtcccccgagccctttttctctttgtagttggagcagctttgctgggctctgctttacatttagggcttctgaataatatttcgttgaagaaaaatattctgtaggcaaaaaaaaaaaaaaaaaattagcaacccattcctgtggctcttgggaacaatgtctaaaacctaaaagaccttttatatcttaatgagcctgtgatgagtgttgctttgagtcccatctagtgggtggcattttttggccaactcttcttgattgcattgtggggcagtcataaatcccaaatcacttctgcctgtctcctttcagctgaaaacaatgcggcaggaagattacatgaagacgatagccgaccttgagttaca

SEQ ID NO: 38171 - DNA, 1462 bp, Homo sapiens
gcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaagtgtttgtgttttaatttaatatgtttataagcatgtataaacatttagcatatttttatcataggtctaaaaatatttgtttactaaatacctgtgaagaaataccattaaaaaa

SEQ ID NO: 38172 - DNA, 1050 bp, Homo sapiens
ttctgaattcttactagaaggtggtcttttgaagttagtcctttcggtacttctcagatgcctgtcatgtacccgatggagtccttggaaagaaggcctgtgtaaagaggccagcctggaggtcaataacctgttctagtttattctggacattgagtaccaagtagcattggcaaaagtcatcatcatagcattgaaaaaacatgaagttgctaagatgctttttgggtatcctcaaaatagatagtgtttcactttgtcccgtaagaggaaagaattgtcctggaacccatgaaaatgatttctgaagagttcttggctctctgttgaaggacaaggaagtataagcctattcctttggatcaaagagaaactactgaaattcacacatttgtcattagattaacatgacttcactgaatacccaccatgtctagtattgggttaggtactatgaagactgagtagaatttacaagcccccgacaacaaagcattggcaatatgggtggggacagaaacagataaagcaatcagtgggacaactttcaaatgtcagcagtatatattaatacaaattttatagtacagatagaaaataggaaaacatgctaattgtatagaacaaaaatcaagattagattaattattgggggcttttggtacttagggtgaaagtcacctccattctcattgcatgggctatttttcctccacagcactcttttcttccttatttcacctcttcttccttactccctctcctaatttggaggagttgaaattaattttatgcattaaatactgagttcgcgtgccatgcattgtgccagaagccatggagtctgtgctagaaatacatggtgaaaaagagccctcataatccaaaaggaagaagaaaatgtggtaaatgctgtattgggaaaaatgaaggaaattccttatgctagagctgggagactatattagtcacctcaccctgccataacaagatgccacagactgtgagcggcttaaacggaagtgtattttctcacagttctggaagcta

SEQ ID NO: 38173 - DNA, 1046 bp, Homo sapiens
ccttttttccccattaattcaaaaccctttgacgagtaaaaatggccatatattgttatgtatagccgtgttaaaccatggcctcagattcactgcagctctcctcttaatatgtagacaagtagtacctcttttttgttgtaatgcttagttcatagtatgctcttatttgaattctttttgcctctacctaggaacttaatgaggttagactttatcaaatataagtatctggaaagagctactgattttatgttgttctatgaaccagttactactttagaataagttagcaaacaataaaaggattcctttagtagctcatgttctttgtttgcattagtgagtaatgaagtctagaaagaattgttttaaattgctttttttacagttccaatcatttttttatttgagaaaatttgaatctcaaaacaaaaattttcttcaatgtttaatacatcatatcaaggtattgtatttactttttttcactaatgagcagattttagaaaattctgtaactaccggggggcactgctattaacttttttcaattaatttggttaagccactatgcttcctcctcaggaaattaaaatgagtttaatttaatctgtgctttcctggcgtgaggaggtgtgggatttctgctacttaattattttgtggcccctagctctaagtccttgcacaagtgggatatattttgaatattgaccatctagcttgatgtctcatacaaaaagatattttttacacagtttttaatatttccatagtttattttcaaagggactgtaatgcatattacttattaaaagcattttttcccccaactttgatggggaaaagcatatcaacagatacctacttttgtagatggctataaaaattgttacccaaaaggctttcttagagcaaattgtctcttatgattattcctgcctgcctccatgggatctgtctttatattgttggagagaatagcaaacatccataatacattttttttttttttgtggatataacattcaggatagaattgt

SEQ ID NO: 38174 - DNA, 1169 bp, Homo sapiens
accctccaaattccccttattccttgcttctctgacttttcgtgggctacagggacacactgcctctgagtcacactgcttaaagctggctgtcagctaatccttgctagggtgatggtttaacatagtatctccctagggatattgacatttttcgtaaaggattttgaaagatctaaaaaaatcccctaaaaatttttaagagaactcacccagtagtgcaattccaggccccaagacaggctgacacagaactgaaagagaattctaggatgggaattctatcccaagcccctcatattcctatcactgggctccttgtacaagttatagctactgtaggtccacttctggactctatactgatagtgtgaagagaaaaccttttgcgggtaagtagaatccaagcagcaagccatgccacctgccaatgaagcaattctatttcatcttaatccatgtagcaataggaaaggggtatttcatcatcagaggctagaatggggtaaaatctgattgccatgactctgaacataggaaggacagttcatttgaacaaagttattgcgtaccaatgttggattctctatatagggatactagagaattacagatttcctaattgctgtcaatgccatgttaactgccacattacctgactcatctattaaagaatctacagaaagataaacatgacagcgctgcgttttaaagtacgcttatacctactaggttaagtaaattacacactggaagtacaagggaaagtattacatagttgtaaacatccgacttccctgggactgggggaataatttactcatgaaatacatttgaaacaccccgagccttgtaagccagccggactatcaggaagtgtgaatcaacaggataaatttctctctcatagcgcaagtgctggtcatccaaccagctcattgttgtttatgttgactgtttcaaactctttctgggtgaataggctgggatgtgtcaccttctaaatgctaaccgtctgctgcctgggctgctggtgtgcagagtgcctgggtgagcgagctcgtgaacttgcattcactcagggccacagatgccattttctatttgttttctaatgctaaaaatgtcttggcagcctagtcagcatccctgccaatttggtgaccttg

SEQ ID NO: 38175 - DNA, 1049 bp, Homo sapiens
aaaattctgatttgtgtctcagcagagcatgagtgaaccatatcattggtaagagctgattaggccaggagatttcttataatattagccttgcttattctctgagaccagttattttccctccctccttttgaatctatgaattacatttaaatagtccaaagactgagttttgtaaactacaaaattaaggactaaaagtttttacttaattttgatttttattcagattttatttgtagactcccatatcggaataagttaacaacggagaagctgtacattttttagaaagagagggtttttttttaagatcagtttgaggttcacagcaaaactgagcaaaattttgcagagatttcccaggtaccccctgccccacaggtgcacagactcctccattatcacccagcagaatttggtatctttgttgcaattgatgaacttatatggacacatcattgtcacctaaagtctgtagttacatcccggttcactcgtagtgttgcagattctgtggatttggacaaatgtgtaatgatgttatccaccgctatagtatcatgccgaggagttgtgaaactactctgccctacaaatcctctgtggagaagctgtacattaaacaaggaaaaacaagtcaatgaaagtataaaaattcaaaatacgcagagttcggggaaagaattataaaatacctcagttgaagaatattttgtttctggggttttactaaagtggtccctaaggaagtaattttgatagtctatgacaatgtgggatttattttatagtgcttctatgtgttgacaacaaatccatcagaaatctttcttttttctttctttgtttttaagtctaggagtttaaaaatcttttttcctccgcatagtttgactgaggtgtctgtcaccatagtacctagacaatccctcaggcagagatatgagtgattaaatttctccctggcttgtgccctgtttgatccatgctaggcaggatttgggggagtaaaataaagaagcctgaagaatgaacaagaattatag

SEQ ID NO: 38176 - DNA, 1051 bp, Homo sapiens
cagacccaggcctctctgcccccacacccactcctgaaccttctcctgttgtcctcatagatcaggggagggaccctaggaggctgcgtttccagctgctctgctcttctgtggctccagctctctctggtccccatcttatgctagggaccccttggctctcctccctccttcataagagggaacgtggcttcctgcagttgccaatccatgggctgcctcaccacgacctgcttggccgtgtagccctcccgcttctgtgccaccagatccctgcattaaatcccctctgttgtaaactcttgcagaaggttctctgttccaggttggaccctcattgctaaaggctcttaattccctggaacacagttgagaaaccccaggctagataattcccaagacgattctttttaaattttttggtaatgcagcttaatttgacacattgacgtataaggaacagcttaaagtgtacagttcgataaacttagacataggtaggcatggctgcaaccatcatggcagggaagatggtgaacacattctgagctacactttaaagcatctcctgtgctagggaatgaaatcatcactcccaacacacaggaagtgctgtgcaaagtcccatctttcatcgacaccttggctcttcttgcttttctcttacgggctttgtacatccttaagaatggaatttgctgaagatcctcatggcttgttttcttggatcagagaaccatggggtcaaatcttcatagggtcaagcctgctcttggcaactgtgattgacctttaccctatgtctcactttccacattgattttgggaaataataataaaaataggcagacttcttttctaattttggaagcaagtgtctgggggtagttttgcgttgtggtgaccctgtcagcattttgtttctaaagactgtaatttagaagatttgatcctgccggaacacagcacaaagatgcttccctgtgtttctgttttaaatttgggcaatttgggtagggcacaaatccaagaactctaggaaagtagactc

SEQ ID NO: 38177 - DNA, 1025 bp, Homo sapiens
ttggtcattacttcttcaagtcactttttggctttcctctttcgtcacctccttctgggtttcaaattacccataggctggacttctttatatctcacgcttcagtgttttgttttgttttgtttcctctctgtgttgtctcatttgggcaagtttctattgctaagacatcaagttcactaatattttctttttcagtatctaaactgctgttaataccatctaatgcatttttcatttgactaaaagtttcatttacttattttgtgtgtctttcatgtatttccttctcatgctcatgcttttctttgtattcttgagcatatatttatgatttataataccaattgtaaggtcctttccttagtcattctatcacctctgttatttctgagtctgtttttatggattgatttttcttttagttatgagttattttcctacatcttcaaatgctcactaatttttgagcatgcaaagatgctgtgtgctggattttgttatattcctttttaaaaagtgagcacgcaaagatgctgtgtgctggattttgttatattcctttttaaaaagttagattttattcttctgtgcaacgaagtaacttgcagatcaatttgatccttttgaactttgctttcaagctttgttatggtggattcagacaggcctttattttaggattaatttatcccctcctaagacacattcttttaagaactctacctaatactccatatattatgaggtgactacattctggttctccagcacgcaaactttccccagccttgtgtaaactggtaattttttttcctgctgctttcccatagttctttccttgccttggaggttttctttgtacacaagcagttcagaactcagccaaaggttagagaagacccctctgtagatctttggagcgctctctctatgtagcactctcttttccagtatttagccctgaaaatttagatgccttggccttcccaaactccaatctctgtcttctaaactcaatgaga

SEQ ID NO: 38178 - DNA, 1037 bp, Homo sapiens
agactaatttctttcttcttcttttttttttttttttttttttttggagactgaatctcactctgttgcccaggctggagtgcggtggcacaatctcaactcactgcggcctctgcctcccaggttcaagcagttctcctgccttagcctcccaagtagctgggattacaggtgccagccaccatgcctggctaatttttgtatttttagtagagatggggtttcaccacattggccaggctagtctcagaactcctgacctcaggtgatctgcctaccttggcctcccaaagtgctgggattacaggtgtgagccactacacctggcctctttcttaattttatctaagaaagcagaatttcacatcttaatttttatttttcaactttttttttttttttttttttagatacaagatctcgctctgtcacccaggctggagtacagcgattatagcttactgcagcctcgaactcctggcttcaagtaatcctcccaccccagtctcccaaattgctgggattataggaatgagccagtgtacctgaccttcaagtatattttttgaggtggtatgatagactagtgaaattaaaacaggaactgtgaaattataatttatttgttccttttcctaaatacctttgtcagtctgcatgtgaattaaagtaattatttactttatatcagagtagagcaaggaacaccgtctttccaccttgactttgctgctctgggtgactttgggcaagtagtttagctctcttggaccatagttttacttatttatttatttatttgtttctttgagacagagtcttactctgtcacccaggctggagtgcagtggtgcagtctcagctctctgcaaccttcacctcccgggttccagcaattctccctgcctcagcctcccaagtagctgggattacagacgcctgccaccacacccagctaatttttgtatttttagtagagatggggtttcaccatgttagccaggctggtctcaaacttctgacctcaggtgatctgc

SEQ ID NO: 38179 - DNA, 1025 bp, Homo sapiens
tggcggaatagtataatttttaaagatgttttatgcttattgtgctttttataaaagatagcaacaatcttccaatgaggtcattcatttctgttggtacagttagaatgtgtgtctctgggttggtctctttgagtttcttttggcatagagcagtattctcaccctgcatgatcatcagagcacctgagatgcttcgtaaagtgtaggtctgagccccaccacggagatttggatacagtaggttatgaggggggagcgtcgagcttctcaggaaacctagttctcagctgtttttctccagatacaaatctgtaactttttgtatttatcttagggtgaagctttcatactgtgagctcattcaagccagagataatttcttatccaggaaccagttggcaaatcttttgtacctgcagttagtcctacttattttaatttcctgatttgataattccaacagccctgctacgtctgagtctgcttttggtgcttgctgtgtctcttgtgttttttgctcttagtgtgccttgtaatttttgttgagagctggacatgatatcctaggtgaaaggaactgctgtagctaggcctttggtgaagtggaggtaaggtgttgtggaggggaagccctctgtggtctatgattaggtctgggtctctaatgagcctgtgccctggtctcagcttttttctttaatgaccctgtgccctgggctcagtgggtctcaggtttttttctccccgcttgggtgggacaggatggctggagataggtattttccttctcttcctggggaggcaagagcgggcaggaagtgcgcatgtcccttcctccaggtggttttggctctggtttattagtttttcctgagggcaggccttgttaagaagaacggagtgctctggtgtattgcaaaccattccctttcctctcccactgtgaagtatgaaaggatttttctcccacattcacttggaggacctggtccagctcctggaagtaaaacttgtgaaagcat

SEQ ID NO: 38180 - DNA, 1100 bp, Homo sapiens
ggtgcctgtaatcccagctacttgggaggctgaggcagagagaattgcttgaacctgggaggtggaggttgcagtgagccgagattgtgcgattgcactccagcctgggcgacagagcaagcctgcctcaaaaaaaaaaaccaaaaaaacaaaaaaaaacaaacccaaaaaaacccttttagctttcatgcttcaacctcttagggtcatccttgggaaccccacactcccctccctctattttacagaccactctgctctcaatgtgcataaccaaactcattcaggtcctaagccaacagagtggcctccagttaacgagacaccctgtgtcttcttgtcattgttcacggaaaaggcatagtcctgttcgttacttttcttgctttctcacatacagaattatacctgttgggatcttttcgttggtgaattcagaacctgtcttaaaggcccacggcccaatctgtcagtaatgaatttatttatttatgatgaaattataaggactgagggggaccagaccactctagtcaaacagccagaacactctctccctgtagatggggccaaagcaagccaaatcccaaactcaatgccagtttgttgatttacagtgagaatgacaactgccaatgggaccgagtaccatgcctttctgccattgcatcctctccctcagggccagtgctatgggggtaaaattataaccaagagctggttaggcaaaaccagaaccaggatgcaagaatcaatgagacttccaaaatttggatttcttctcagaatccatgaggctaagtctcctctccccctggacaccgcttggggagaacatgtcctgtctttgtctctggacccttctatctaaggtcccatggctggcaggtgacagattcccctcccctagttggtgttcccattctcacatttcttctttagctattttactgaacatttgatctgattactttcatgcttgacaggactgggacccaatctatctccttgtggtgctttaatttgtcttaattgagttcattaggcgttgattttaaaatgcaattttctgagggcaattttctcttatttccagagtc

SEQ ID NO: 38181 - DNA, 1988 bp, Homo sapiens
catggaactcaatccatggcagggtttgggtggctccctcagcctggtggcagagaaaattctcaggttgcttgctctcattcctgctttctgccttccacccaagaaagcatagcaggctggctgtggtggctcacgccggtaatcccaacactctgggaggctgaggagggtggattacttgaggtcaggagtttgagaccatcctgaccaacatgtcgaagccccgtctctactaaaactacaaaaactagctgggcatggtgctgggcacctgtaatcccagctactcagaaggctgaggcaggagaatcacttgaacccctgggaggcagaggttgcagtgagccaagatcgcgccactgcactccagcctgggcgacagagggagactctgtctcaaaacaaaacaaaaattagccaggtgtggtggcacattccttagtcctagctactcgagaggttgaagccccacttgaagccaagaggcggaggttgtagtgagcccagatcgtgccactgcactccagcctggatgacagagtgagactccgtcaaaaaaaagatcaacacaatacattttcctggaccctcagctttccttccttattgaaacaaacatggatattgccttagttcttttttggttgctataacaatgccacaggcttggcaattataaagaaaagaaaattgtttgacttacaattctggaggctgggatgttcaagagcatggcaccatcatctgtttggcatctgatgagggccttcttgttgtattatttcatggcagaaggtggaatggcaagagaacactcaaaggagaaacagagaggaagggggctgaacttactcttttatcaaaaacctactcctgagttcactgacctactcccacaataatggcattaatccattcatgaaggcagatccctcgtgacctaatcacctcttaaaggtcccgcctctcaacagtgttgcgttggggattaagtctccaacacatgaactttgggggacaccttcaaaccatagcagctatattgaggaatacaatggaaattaagatgaatgtttgagataaggcacaaggtgttaacaaaattgtggacttttggctaagctggagatctctaggatatataaattctctctcctttgctccaaggatgatgaccttggtagtgaatgttgaaggtcacagagctgctgaagtggtcctgaatggctgtggagaccaagcttttattttggaaagatacagaacacccatggtgttcaccatgagcttgtgacttaaaaaagaatctcctgcatgctctcaaagcatcatgcagattttggtttttatccataatacatccctgtttattgtaatgtaagaataatgtttgtaattatctcctagtgattaaaataggaggaagatgtgctcattagtctgtgtgtccgcctgcctgttgtcaagtagtcaagggaccgggttcatgtccccagttgtagaatgtggtaaggtcagctctctgattctgttaccctatcccttgcttgcttcccaagtcaaaatttctttttcttccaggcgtctggggtcaggttagttcttcttgattgttggagataaatttgctgatgttcttcatcaactccaatgacttagttcagtatttataatctattttctgtgattccaaaactaaacatttggggtagcaacgaatataccattctctaccttctaagaagaaattatgtttgttttcaaataactttacttcgcactcattctacttacattagaatgaaacagcacttcctctacgtccataccaccctgaatgcacttgatctcgttagaatgaaacagcacttcaagtacactttctgtgcttttctttaattaaaacaactaaaacactagatgatgtttgttttataagcaagagagagagtagaaggtaaattttgcagcacttggaaattgtt

SEQ ID NO: 38182 - DNA, 1032 bp, Homo sapiens
tgcatgtaatcccagaactttggaaggccgaggcgggtggatcacctgaggtcaggagcccaagaccagcctggccaacatggtgaaaccccatctctactgaaaatacaaaaaattagccggatgtggtggctggcccctgtaatcccagctgctcgggaggctgaggcagaagaattgcttgaacccgggaggcggaggttgtagtgagccgagatcgcgccattgcactccagcctggacaacaagagtgaaattccatcgcaaaaaaaaaaagcaagggagactcttcaaacttaaatttcttttaatccttgacttaatatacattttttttatatgtcccccagacagcttctaacttagtaagggatcaatatatatttgttaaatgtgacacagacaattctatttttattttattgttattattatcattattattttgagacagtctcactctgttgcccagactggagtgcagtggtgcagtctcagctcactgcagtgttgatctcggggctcaagccatcctccccgttcagcctcccaagtagctgggactacaggcaccccctaccacacctggctaatttttgtattttttgtagagatggagtttcaacatgttgcccaggctggtctcaaactcctgagctcaagcaatcctcctgccttggcctcccaaagtgctgggattacaggcatgagccactgcgcccagctaacaactcttttttcaatctgtacctcttaacgacttcctagtccacacagtacagtgcatcgtgttgctgtcctttatttgccctaacactatcattaaagctatgtccatggttacttcttgttccctcttattgaatatttagtattcagtagccaagagactgtttatattctgcttaatcctcaccaaatttctgcaaaataagtagtatcgttacttttattaccactttacagataaggaagccaaggcacagaaagattgagtgatgtgctaaagttcacatggccagtaaatgacaa

SEQ ID NO: 38183 - DNA, 1037 bp, Homo sapiens
ttcctgtggggagcagcatcttcccctagcttctgtgccaccctatctctgtctgtcacctctacagtcactgcctctggccccttaaatgttagtgtttttcaggcactgtccttggccctctctgcttctccatcttcatggcaacctcacctcctcccagcgcttcagttggtccttgagctgctgccccttaacccagaattctgtctctggaacttttgactctcctaatggcgctctgaacatcactacctggaagtcccagaagcccctcaaattcagcatgtaggaaacttatttcattgtgacccccatgcctgccactctttctgtgttccctctccagcgaatgacgttgccatgtactcagcttcctaagccagcaaaaagggctttatcttagattccttcctacctgttgtcttatccccagtttcaatggccaaatcacatccattctacctcagtatattttatatccgtctacttatttttatcctttgccaccctttgcctcctacttaagaatcaaaaaccctgtaagacttccttgacctcataagaacaggttagattcttgtatcagtcagagaaacaggaccaattggatggatggatggatggatggatggatggatggatggatggatggaaacttattttaaggaattaatcttgaggctgacaattcaaaatccataactgcgggaggagggtgctaacaattctgaatctgtagggcaggctgtaaactcaggcgggaggtgatgccaaagtgtcgaggtggaatctcttcttacctgggaaacctccgtttttgctctgaaagccttcaactgggtggataacacccacattatcaagggtggtctcctttgcttaaagttaactgattgaggatattaacctcatctataaaacaccttcacagcaacacctagattagtgtttgattacataactggggaccgtacccttgctcagttgacacgtaaaactgaccctcacagttctccctctgggtggatattccc

SEQ ID NO: 38184 - DNA, 1034 bp, Homo sapiens
ctatttgatgggcttgcatcagggagggaggaagacagggcagtcacttgatgaggagggatgggtgctgccatcagcaacaacctatgcaccttctgagcaggtcactgaaaggagaggaaggtggcagtgtccttggatggactgagacttgtcctttgattgtcacctgacagtgaagggtttcctcatcccagagagacattcttaggcaattgccttctttccagatggtgagactgagtaggtctggggcccatctggccttctggcttagagctgaatatgcggtagggaaggagggggtcagacactcatttattcgttcaccgaatgctcatagaatgcctgctccctgcaggtgctgtgggatacaacagatgctaagagagatatggttgctatacagatgaacctttctttccaaggagggagacaaaagcaaatcaacctgggaagaaaaacacttgaagttgtgatgggtgctaggaaggaagcctgcagaggcttgaatgggaaaatagtagactcgggatggggttggccagggcaggtcccttcctcccagggaagagtggcgcaggcagagggagcagcgtacatccacctcaaggtagaaagaccgtgactggctcaagcttggctagagcatccgtggtcaagagcagtgggacaggttggggagggaggtgacggccagatcattgagagttttagcttccttgaaaaaaagtctgggtttggtccaactcaaatccactgaagggtttgagcatagctgtgatgtcatcctagacaccactaccacattaatggtctctgtgggttatgatacaacactcaaatcttaggggattccccactgccttctcgttggcatcagcttgtcttaatctttcatttcttcccatcctgcaccttaagctctaacctaatggcaacctctactccctacacattcacagtctacttcaagcctttgtccatgccactgtctccacctacagaaaactccccaccctgcaaggcctggt

SEQ ID NO: 38185 - DNA, 1040 bp, Homo sapiens
aaaatgctaaatgagaggaaaatgtgcaggaaacaataagggatttgttccagctggatctgacacactaaattggagcattataagagatggaaatgtctagagtgggatgagtgacccgtttagtagtaagcccaaatgtcaagctaaggaattctgatctctcaaggattatcccacactgtaaattgcaggcaaagccatcgggtaggaaattaaagcagaggttaaagtaacttttttttttttaaactctcacttaaaacttacatatttttaaaaattacctcctcttctcattagccatctggccatgcaaactggctttcacactcctttctttctttctttcctttgcttttttctttattattcagtagaggtgctggtttatacatagtgattgtcaggacagagttttcaggcagctctatgactattgggaccagtcgccaaagtccttcatttaaatgaccaatttcacattcagtctggacttcaatggggatgaagattttagaacccgaagacacatgggtaatgctggaagtctttttctctttccctatgaatggaaaattcattcattcatttagcaaacatctggtgtcttttacgtgccagtcacagtgctgggtttgaagaatacacagataaaaatatgctcggtcccttcacatagcttctattctaaacacaaggagagtttgttagtagattatttctacagtgtcatgtatagatgtatagactaccttctgtactggattggtttaaattagatgatttccatgatgggactagaggattttaagaatattttccaacgctttctacaactgatttttttttttcttagtgtattaaaaaacacagccattgcacagaaataatctcccactttccaaccaacctgatgcttgtaaactccctctcaggtcacaccagagggacgaaatcatttatagaaagcaaattactattaaatcctaagcaattttattgttgaaagtttaaccctatttatataatactgtcat

SEQ ID NO: 38186 - DNA, 1048 bp, Homo sapiens
ttttatattccatcaactattactgggattgattctgggatgaaattaagtaactttgaactagttttattctttgtggtctagcttttaagctttgttaggactgtgccagagaagtctttggtctagagtgaatttgacttcactcctaatgcaacaccttctttagtaattaacctaaagccctgtatactaggacatcttcccagattagcttctgggaaaatgaattattcccagacttttttgagcttcatagggttattcctcctactccttacaggtagctctttctttggccttgtgtatatcctcctatcagttcttagccacagtctttagggattcttcttaagatctctggagggagctctttcctcgtctagttccctctcatgttttacctaccctctcaaccccaaatttcagcacttctggtctcccatctgtctcctaggttttggggtcctgcttgggtttctctttcttgtgctgcaacttggaaattctcttcaggcagtaacctgggacaattgtagcactgacctcccgtgtttccctgccattcagtgttaaaaattgttgcatcaaacattttgtctggttttctagttatttaaggcagaaggtaaatgctctcattcttaatccatcctggttggaagtagaagtccttctttgcttcttgcattgtcacttttccccttttggtttcaatttcctccaattaacttctcatttcaattacctttcaattacttgtagtaggtttactgtttatcgatctatctatctatctatctatctatctatctatctatctatctttcctctaatgttttgcttgtgttttgccagagtgaactgttctgttttcagttgtctgataatatctttattaggttaccacttgagtgatattttaggtgagtatacattctagggtttcagttattttatttcatcacttgaaatcatttcattccctggcattataagcagacatctgcttatatgatgtctgctgtcagtctaactagtttttttc

SEQ ID NO: 38187 - DNA, 1048 bp, Homo sapiens
ttgtttaaatagctccacaactttggacatgcttacctctcccagccttttttttcccccattactatctcctaggtttgctgtgacgtaatttatgtagaccagtttgcacaatccttggaaaatgtcttaattatatatttatgacaaatttggatatgacatttgttatacatctgtatgcagggcagctttaaatataaaacttaagcttagtgaattgttaaaaattagtcatatttcacttatgatcatctcctcttggaagctgaagaaagaagatcaagtaataaggatgtttatattttctaagtactatttttaagaagttaaatgttagtttctggtgtcatgaatgaagaattggagcaaatgagaaattccagtatatggcttgcttcggagtgaatggccaaagtattgtgataaagtcgctaacctttgggaggatgtacagccgataagagtcaggccccatttccaatgagcaggccccattcctgatgacaagagttttaagaacatacagtaaaaagattgaactctgatcaaaggccacagctgctacgctccgcatgctgcttgctgggtatggagtcagccctggagctctaacctgattcttcagctttggcaacacaagcatttgaaatgtgggagaaggtggggcctagcatcatcaagtcatagtctgagaggtcttggtcactaccgtgacctccttcaccagctcaccagtctgagggagaagcccaggctgccacaaggccttgtcttacaggcaaataattaattaagatggaaacttatatgtctactgacctccagtgattaggcctctggttcaggagctgagttttgaggacttacttaaattaggaagactatgacagttgtccttcctttctcccaacctccgtcttccccccattgttcctctgggtagcttagaggtcacctgtggaacatttaatggcccttttatttgatattttggtacttatatatgtctatcttctcagataagcttttcctctgacagaaaaga

SEQ ID NO: 38188 - DNA, 1040 bp, Homo sapiens
attactctgaaggtcagaaataggagcaaaatactaatattgtaacccagaagggaaagaggttttaataaatataaaatgtttggcttatgctagttctttatttgtggtagtgagaggtgaagccagcgggacttcctgggtcgagtggggatttggagaacttttctgtctagctagaggattgtaaacacaccaatcggtgctctgggtctagttaggggattataaatgcaccaatcagcactttgtaaaaatgcaacaatcagcactctgtgtctagctaaaggattgtaaatgcaccaatcagcattctctaaaaacgcaccaatcagtgctctgtgtctagctaaaggattataaatgtgccaatcagcactctctaaaaacgcaccaatcagcactccttgtctaggtaaaggattgtaaatgccccagtcagcactctgtaaaaacgcaccaatcagcacactgtgtctagctaaaggattataaacgcatcaatcagcactctgtaaaatggaccaatcagcactctgtaaaatggaccaatcagtgctctgtaaaatggaccactcagtgctctgtaaaatggaccaatcagcaggacgtgggtggggacaaataagggaataaaagctggctagtagcctgcagtggcaactcggtcaggtcaccttctatgcttgtgggggctttgttcttttgctgttcatgataaattttgctgttggttactttttggggctgtgccacttttaagagctgtaacactcaccacgaagagctgtggcttccttcttgaagtcagcgagaccaagaacccgccagaaggaagaaactctagactgggtagtctctttgtttccttctcctaatgaaacactagattcattggagctgatctatcagcatggctctgatgcttatttttttttgttactgtaacagctaaaacacttccttgtaatttaccccaagtggcataataaaaacacagtattactcaaaaggttgaaataggactagatttagccata

SEQ ID NO: 38189 - DNA, 1023 bp, Homo sapiens
aaataaaagacagattcccttttctttaaaaaagaagacagagaaatataagaaaatcagcctgggaaaaaaccacctgggaagctgcttgaaatacaaatactaggcccctccccaggcctactgggcagagactccagcaacctatgttttaacaagcctccctgggagtccaaggcccacactgtaatgtgagagacgcctggtacagacactgctctaccctcttccccaaggcagatttcctccatctgaaagtactaccaagtccagagtaaaaactaacccagttgtagttctgaggtgcaggattcagtctcgcatctgcaaagctcagagtggtgccttcttagatcactagctgacccctttagggaaagcctgtgccagaataatcctctaagcattgttctgacctcctgctggcttcctgtggttttcctctattttgtgtctccaaagtctcatagatgaacttacttaaattatatggtatatagacttaattaatggtaaggaaagtagaattcactagtttaaagggaaagcaataggaatgaatttagtacatattttcagcaagaagcatggtggtgttaagtcagagacatcagtttgaacatattaaaggccattcttttgctctgtcaatctcatggctgttgactctaactttaatgcatagtatcttgaaaatatgtgactataatcaaaatggaaagaaatgaatctacatacatcaacatagatccttatttcctgaaatattcggaacctacatatacttacacacacacacacacacacacacacacaccccgcacccaagcacacaattatttttgtttgttagtatgtggtgttcttttacaaatatattaatgagctatttttaaggttttaaaaatggtttgctttgtaatgggtggcctaaaagtcttagttttacttctctggaaattctgacttttcccttattgctcagttgtggtttttcagcgaggaaagttttgctattttcca

SEQ ID NO: 38190 - DNA, 1026 bp, Homo sapiens
tggatgcacattacgatcatctggggcttctaaaaataactaagccagggcctgtttccctccttggggcaagacctaactattgatatttgtacagcttccaagtgattctcatgtacagccaggggtgtaaaccattgcaggtgcttgttttagatattggcatacaaagcttcataggcttagaattctctttaagtctgtgattttctcagagccagaaggggaagtatagtgatcaaaagaaattagggctcaggaaagtctggtggggaaagcacagagctgtttaaatagaattgtagtgtccagagtaagggaagtgaaagcctcacttctctcccatgtgcttggagtaggatgtagactcttcaggtctggccaccctactatacggggagacattgacacagcagttccaaagagagcagccagggaggtaaaaaggccaatccccacttttttttttttttttttttagagaagaccaagacaaagaaaaaggataattgatttggaaaagacttgaagagggatcggtgtctttacctaattaaaagatttgctcaggaaagagaaattagaccaactctgtcgttttggaagtagaatctagggccagcgggtgggagatgagaacacatggagctgggaataaaacgggcagcttcctcaatggtgagcaaagccaagggaagcagggctggggaagtgctgctgaggaaacctcaaggattggaccggatggcctccgagtcccttcccactctcagagtctgtgatcctaatcaggggactcaacagaaacttaagggaaaccccctgacttctcgactcgatgtatctattggagctggatttttacaccccgtgttagcagtaacagattggcaaagcaatagaaaacaaatgcaccaattcatgtttttcagaaacttaacaaaagttagcccctgaagtcatttctgtgttatgtgtgtggaggaacactgccggaggaccctgaccagctctgccaactctttt

SEQ ID NO: 38191 - DNA, 1057 bp, Homo sapiens
tcagaaaatgtagttgaagtagttgatttggcttcaacttgaattccctatgtaattgcagggaattcaagggactctgaattcaattcagggaattcaaacagacctctttgcctttgagctagttttccccctaggcttttcttagcctgcaaaaatcctggttatctttgaggacccagttgagttggtcttgctcctaaatcattgacaagcccctaccctcaggcagagcagtttgtcctttgtgctccaaatactttttgttgtcactgtagttagggtttgcggtttaatcatctattgctgctgccagaaagcagaatcttggagggtagggagctttatatctttgcgagcctcaaccaacacaaagcttggcgtcagattgaattcaaattcaccttacgttgctagtatgaaaccaattgtgttgttgctttcatacaaatccagcagttttctgctaatgagacctgcaatgtaaaatttaaaaagaaaaaagaaaaaatatccaacaggtttctaccgtccaagtcactgatagaatctacaacagatcgacagagttacagctgtttcctgccccagttttaggcaccataaagattttctagaaggcttgccaatcatcatcatcctgtaagttcttacactgctacgcactaaactaattgcctttccccctcttaaaggtaacaggtttattgaggtataatttacatagggtgaaatttatgacatataatttacataccataaaactcacccacttttgtgtacaatgtaatgatttttagtgcctttacagttatgcaaccatgatccccggctaatgtagaatcattttattactacacaaagaaacctcatgaccacttcccatttccacacccaacccctgcttttctggctctatggatttgccttttctggacatttcatattaaccaaatcatactatatgtgttctttcatgcgtagctccttttacttattgccatgtttttaaggttcatccgtgttatcgcgtgaatcagtacttcactttttatag

SEQ ID NO: 38192 - DNA, 1086 bp, Homo sapiens
gattcaatagccactcattctgcagagggtgatgaagaacggcaaggatttgagagtaggtccgactcgggttccagtcctgcccctcccctgaccggcatctgcctcagcctttgtaaactcacctgcagtggaagcagagctcgtggaagattaatgagaactaactcattgtgagggaagagaaatcccagcactgctcagagggccccgcaggcagcccagccctggttttcatgttgagttgagatgatgatgtgttgttagccatagtccttgtgctgtcttcttgtttgtgaccgtaaaagttatcctggggcagagagaggtgggactgatacagaatgaccacttaacaattttcagtctgttgagccaactagagtgggcagagcagaaataatgccctggttggaagttaatagctttgcctgcccaattatttactggaaggaaatgcctgttcaatataccatttgatatattcaaagataccaaacaaaacaaacctactgctagggccagccactcagaaggcatcacatgctagtctcagtctgttcatctaaaccactgtaaataagtcaggacaaatgatgtacatggttttggggttttgttttatgtatgtatttatttattttttattttttattttttgagatggagttttgctcttgttgcccaggctggagtgcaatggcgtgatctgggctcactgcaacctctgcctcctaggttcaagtgattctcctgcctcatcctccctcgtagctgggattacaggcatgcaccaccccacctggctaattttgtatttttagtagagacagggtttctccatgatggtcaggctggtctcgaactcccaacctcaggtgatctgccctccttggcctcccaaaatgctgggattaccggcatgaaccactgcacccggcctcatttatttatttttggatactgctgttttgaactataaatcatgctgccactcccatctgcagactgctttggctacatcatgttgaaagatttcttgagtttgttttgcattggcacttatcagagctccttattgtagga

SEQ ID NO: 38193 - DNA, 1053 bp, Homo sapiens
gactctgtttcttgttctttcttttgcaggccactatgtacatggtatttgtatctatggaaacggagacttaaagtggctggttaattcaccaagcctgtttgctaacaagtttgagcttaatacctacccccttactgtggaatgcctagaactgaggcatcgcgaaagaaccctcaatcagagtgaaactgcgatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagt

SEQ ID NO: 38194 - DNA, 1044 bp, Homo sapiens
tattgtcacatggcaataagcacagagttcctgagatttcgttattggtgattctctagagcttacgttggtactcatggaaacatacctttactctgttggtttttctttataagacttgtccactgggcgcggtggctcatgcctgcaatcccagcactttgggagggcgaggcaggtggatcacctgaggtcaggggttcaagaccagcctggccaatgtggtgaaaccctgtctctaccaaaattagctgggcatgatggcaagtgcttgtaatcccagctactcaggaggcttaggtgggagaatcgcagttcattgctgtgtatcaactgcttggaatagtgccagacacatagtaggcactcattatttgaaagaataaattcaaataaaaatgtgaatatctgaaaaaataaattaagtctcacatataaagtaaatacactaaagagttaaagatttgtgtaggatctaaaagtcttccttagtccagtctccattactgtgttctagagtgatgatacccagtgttgcctgcccacctccttgctttaccttcctcatcaagtctcaagtcctttgtggtaaactacatgtcattttgtagtttaacatatcatttttccatttataggatccattgatagttttcatgaatcgtggaatgatttatcttttcagaaacagataaatggttccgtgattcatgaaaactaccagtggatagagttggtagaactgtggtgtgactggcattaattgtatgttttcatcttcagcagcaatggactcttgtggctgacttcactcaccatgctcacactgcctccttgtcagcagtagctgtaaatagtcgttttgtggtcactgggagcaaagatgaaacaattcacatttatgacatgaaaaagaagattgagcatggggctctagtgcatcacagtggtaagaaaattgtatcccttaagatgagaacatagaggttttctttacaatttgacttcagttgaacaatttgttgtatctattttatagcagat

SEQ ID NO: 38195 - DNA, 1049 bp, Homo sapiens
cttttttgagaaaggaaggaatatatcctgactgattgtaagtagcataacttccaagatttcctagtgacatatcataaagtttcacagtcagaaggtgaatattttaggcacagtagaataacattgaatactaccccattacttctaaatactatttttcagcatctactatgttttaggcactgagctgcacttgttacagatattcttattccatccatacaacagcccgcttagatcatattagtatccatatcgtgtggctctccaatgttgagtaacttgcctaacttctcacagttagtaagagactgagctggggtctgaactcaaggcccaggggtgttcagttcaccctgaacacgccaggctttctcacgaccccacttcttcacatgggggtgtatttcccactgcgaagcccctatctctgaagtgctctctgtgtctgtcttcattctgtaaaatggttgtaagtggacctattctcgtagggttgttgtagggattgatgagactcttcagagcacgtggcatagaatctgtacgcattaaacgtcagctagcataattgccatcattatcaacaccatcatcatcatcactattggtgaatgctcaatctggcgttagcatagggatgcattgatgaggaaaaatctaaagtctggagaccagtgaggaagtcactgctaagagctgaaatgagggaggatgagggtctgaaccacagcagtggcagagggtgaagaagaagggaactaagcaggttcacggggtggaggtggtagggaaagagggaaatataaactcctaagtttgcagctcaggtgactggggggtgcgttgtccatgaatagcaacataggaggagaatcaggattgggggaaagacatggtacccagaggacattcatgttgtggcaggcagagggcaagtgggcaggcgtggagattggtgatgatcagggtgtggtggttacagagttgtgggctgaaggagccagctcagaggcactgcgaatgtgcagagacctggagtagac

SEQ ID NO: 38196 - DNA, 1080 bp, Homo sapiens
gtgtctcagcctcccgagtagctgggattacaggcacccaccaccatgcttggctaatttttgtatttttagtagagaggggatttcaccatgttggccaggctgtctcaaactcctggcctcaagtgatccgttcaccttggcctcccaaagtgctgagattacaggtgtaagccaccacacccgacccaacatgacattttcatgtcacttgttttgagcgtatattcttggcccaacccttggtgtagcagggaaaacagacacgtgactaagaactcaggaaaacctttgaagttcggaggtatgaagctccacctgaaacgcttatttgtatatgagatacagtaaaatggaaacagtttatcccctgtgcgccagaaagaagtcattgcaaatgtacttggaaaaagaacagtttaaattacttatgattttctgaaatctgtgaaatgtccattcagccttgggccgtgatactagtggtcaaagggagttgtttcaacctgttcttaagagactgaaaacttcttgagcttgttttcttttcactgataattaaattagagtgaacttgagcagtctatgccttttggtcattcacggagagttttctttatctagtgtagaaatcatcactgaggactccactgatttaggaagtcagaactgtctccaggcagttgagcttttgctttccgcgagctggattccttagaaaggtttcatatgtatgagatatataataatatcccttattttgaaaccagaaatactgcacctcaaaagttacccattatcagttctctaaggaaacacttcatcaggcaagtaatttccctttctttataggatataacttccctaataaaacacctacaaatcgaactattataggcaactaccagctgggtgcggtggctcatgcctgtaatcccagcactttgggaggccgaggcgggcggatcacgaggtcaggagtttgagaccagcttggccaacatagtgaaaccccatctctactaaaaacacaaaaattagccaggcatgagacaggagaatcgcttgaacctgggaggc

SEQ ID NO: 38197 - DNA, 1032 bp, Homo sapiens
agtgaaatgtactggttttttttttttttttttttgagacagagtcttgttctgtttccaggctggagtgcagtagggcgatctcagctcactgcagcctccacctcccgggttcaagccattctcctgcctcagcctcctgagtagctgggattacaggcacacaccaccacgcccagctaatttttgtatttttagtagagacggaatttcaccatgttggccaggatggtctcaatctcttgatctcgtgatccacccgccttagcctcccaaagtgctgggattataggcgacagcacccggcaaaatgtaccaatttaaacaaacaaaaaaacaaaaaacacagtgaaaactatctctcatgaacctatgttttgaaaactttcttccatccttgcttttgcagtcagattaaaactctctcagaatttcttttttctttttctctctctctcatgatttcaacaccaaaatttacacacaggtgtctaaagattacaataacaaggatttctgctgctttcaaaagtgtgccccaaccctggtcttgatcccaactcctctcccaccttcctaagctcttcagtccctcactcatcccccttcacctcctgtgttactagttcctcctctgtaagggatcttgctcctctacacgcaaacctgctcggagcactgctgaaatgcttcattccatttctaagctcctcttcacagccatctaagatgaagcagccaaaatgaggcctgccatgtttacagtctgattatcaagaaatatgggcagatttctcattctgtgagtgtcatgatgtgacaacttcctatacaaaaatgttagaataacttattttctctcactttcaagaatcaaagcataatgtcacaaatagaacagttttcaaactgtaggtgaaactatagtcaggaaaatttgacctcgtgaggaagaaaatacagacttcaaggtcaaaagtagattttttttttttttttttttgagacagagtctcactctgtcacccaggc

SEQ ID NO: 38198 - DNA, 1024 bp, Homo sapiens
caggctggtctcaatctcctgaactcaggtgatccacctacctcagcctcccaaagtgctgggattacaggcattgagcctccgcacccagcccaaaatatcttattgcaccgtactgcaggtaaatgaaaccatggaaggtgaaactgcagattcaggggactactgtacccaatttctgtaagacaagaaccaacagaaagccagttttctgatttgtccctttatttagtaaccctatgccatgtaagagttgaaataactgagaggtgtgactttcttgcctagagtggaagaggacttgagtgggcttttcctccagttcatgtatttttaggaaagagtacctatggaatgtgaagacctggaaacggattgcataagagttatccaagcaaaaaaagaattatccaagcatatgtactccttagagattcctcgtgctccaaagtgaagacttccatactatgtcatgccaaatagctacttgtataagttttcctgactcataacacacttgttctttctattcttctgtttcaaagaggaaaacaaaaaaaaaagaaagtatctttccaaaatattcaccaaaacttaacccatcctaacttcaaagtcgaataatgtactaaggatgacctcacttataaaaagtaaaggaactgctagagatattaaacttccagaaaaggctcagaaaatgattgaaaaaagtttagaatagcgaggaggcagttagtgaaatcttaacaccatcagaagaagctgttaacttggcacgtggtgctctacttcctgcaacgaggcatgtcaatttcaaatgggaataatgattgtcattcacaagagcatcgtaaaaatggaacaagatcccctctgatacgttttggacatctgtcctctctaaatctcatgttgaaatgtaatccccagttttgaggtggggcctggcgggaggtgtttggaccatgggagcagatccctcacaaatggcttggtactatccttgcggtaacgagtgagt

SEQ ID NO: 38199 - DNA, 1714 bp, Homo sapiens
aaagttgtaaataatcaaaattataaaattaaaagcaaagtagcaagatagaaataatcaaaagttatagcaacttagggacaagagtacttacttttttgggagtccctaaaacttggcaaattttaaagatttcatcgacctcacttgtccctgggaaaagtggccttaacatatagagttcagccatgatacttccaacagcccacacatcaatgggagaactataaactgaagatctcagtaaaacttcaggggcacgatacctatgaaaatagagaacaaaagaggtaattttgattgcaatttcaaaggtggatgggcagtagcattctacgctgtgtggtcatgcatttccatcaaggaacaggtattcagaccctgttccatctgtgtgtcaggcatttgtacaatgttctggggataataggacacaacacatgttccctgatcacagacaatgagtggggctggagacaaatgtctatgaaatgtccatcaagcctaagacaggaactcaactgaatagatatggaaataagtgccatctgatatattaagaaaaaaagtagaaaaactatgttacaaagcattatattcagcatctattcacaaggaagcacagaaaacaaaagatgaacaggattatatcctgagtagtggagtttttttttatcagtttgaaagtactgatatcctcaactgactcctcttctgtagtcaactatatttattgagtggagttttgctcttgttgcccaggctggagtgcaatggcgcggtcccggctcactgcaacctccgcctcttgggttcaagtgattatcctgcctcagcctcccgagcagcggggattacaggggcacaccaccatgcccagctaatttttgtatttttagtagagacggggtttccccatgttggccaggctggtctcgaactcctgacctcaggtgatcagcctgccttagcctcccgaagtgctgagattacaggcatgagccactgcacccagcctaacaatatttttaattgagaaaaatactcaatttacaagagcaaagtgagctggtgagtccaacacaaagtctgctaaatggaagacactctcaattctctttttttccaaccaaaatgtgtaaatatttcagtccaaatgtttggcatactgtctttttgctttcattgagaatactgcaagccctcaaataaactagttttgttcactgttgtttttgctcaatgttgtttcattgtaatgttgatgagaaagaaaaaaaaagaaaggcatttctggctgggccaatgtgtggggtttgcacattctccccaagtctacaagttttctccaggactccagcttcctcccatatcctagatatgtgcatgtcaggtgaactggggtgcctgtgtggccccaggatgagtgtgtgcatgtgtgtgtcggggggggggtggggagggggcgtgctgccatgggaggctgtcccgtccatggttggtgctcaccttgcacccccagcttccaggacacgctgttgccacctgtgaccctgaactagaataacttggcgaataattatcttccttgtttttattaatgtttctcaaatgtatgtatagcttacatgtatttcaatgttcaatattagtgttttggtcactatttagaagtttggtggccaggcacagtggctcacacctgtaattgcag

SEQ ID NO: 38200 - DNA, 1050 bp, Homo sapiens
ttttgacagcaactattttattttatttatttattttttgagacagagtcttgctctgtcacccaggctggagtgcagtggcatgatctcagctcactgtaatctccgcctcccgggttcaagcaattctcctgcctcagcgtcccaagtagctgggattacaggcatgtgccatgatacccagctaatttttgtatttttggtagagataggttttcaccacgttggccaggctgctcttgaactcctcacctcaagtgatccgcctgccttggcctcccaaagtgctgggattgcaggcgtgagccaccacgcccggccaaacaactattttaaaatatctatttcttgaagtattacatctgagatgcttagcagcaagaattatgtggctttcgtaaaaacgtctaatcatccttataggctggtttcccaaattactatgtagccaactctacagtcaactgttgattattcatgttatttctttcagtcacaatttttaaatcgtaatcgaacttcctccttcaatcccttatgcttcagacgttgctgacagcataaatcaacccaggcaaatgtcaagtgttaccatgctgaccagagtttaaaacaattaaaaatcaggaatccattatgaataattaaaatagcagatgtcccttatttccatataattaatacattactgctgtttgccaataaagtgtagtatatcattacaggatttagacttttaaaagaccccaatagtttacatatggtgcaaataaaaagtttttttttaatgttcttaaaacattctaaacataccctttttataagtttaagaagtgttcttaaaatatttatatggaatcctgcatagcatttttggaaggcaaataattcctgtagcagttaagaaaataaaaaaaacaaaatataaactacaggaggaggatgggtgtgatggctcctgcctgtaatcccagcacttccggaggctgaggttggaggatcacttgagtccaggagttcaagaccagcctgggaaaaatggcgaaacct

SEQ ID NO: 38201 - DNA, 1048 bp, Homo sapiens
tgggaggccaaggtgggtggaggtcaggagttcgagagcagcctcgccaacatggtgaaacctcatctctactacaaatacaaaaattagctggcgtgatggcacatgcctgtaatcccagctactcaggaggctgaggcagaaaaatcgcttgaacccggagggtggaggttgcagtgagctgagattacaccacttcactccagcctgggtgaaagagcgagactccatctcaaaaaaaaaaaaaataaagaaagaaatatatatgagagccacttgtgtacttaacatcatttttctagcagccatgttaaaataaatcaaacaggtaaaattaatttttaacaatatatttaatttaacctaatatatgccaaatattatttcaacatgtaatcagtataaaaatgagctgactgtaccactgtactccagcttgggtgacacagcaagactatgcctctaaaacaatgtttttttaattatttatttttaaaattttacctttttaatttttattttttgaaaaagagatgcgggctgggtgcggtggctcccccctgtaatcccagcactctgggaggccaaggcaggtggatcccttgagttcaggagttcaagaccagcctgggaaacatggtgagaccctgtctctactaaaaatacaaaaattagccaggcatggtggcacgtgcctgcagtcccagctacttggggcaccgaggcaggggaattgctggagcccaagaggtcgaggctacagtgagccatgtttgcaccactgcactctggccctccagccaaggtgaaagagcaagaccctgtctctgaaaaaaaagagagacacatggtctcgctatgttgcctaggctggtctcaaactcctggggctcaagcaatcctcccgccttggcctctcaaagtgctgagattacaagcatgagccatcaagcttggagtaaaaattattaataaatttgttttgtaacaagttttcaaaatctgatgtgcaatttattttacatttacaacactcttcaatgcaaac

SEQ ID NO: 38202 - DNA, 1036 bp, Homo sapiens
ttcaactgtgtcccccaaaactcctatattgaagtcctagcccccagactttcacggtgtgacagtatctgaagatagggtctttaaaaaggtaattaagtttaagtgaggtctttcaggtaggcccaaatctgatatgactggtgtccttataagaggagcctgggcaacatggcaagaccccatcactccaaaaaaattttttaaaaattagccacatgttgtggtacacgcctacagtcccaactactctggaggctgaggcaggaggatggttcaagcccaggaggctgaggctatagtgagctatgtttgtaccaccgtacctcagcctgggcgacagaatggaaccctgtcttgaaaaaaaagaggggggaaatgtggacacagacatgcacaacgagaagatcatataaagacctagagaggatatggctgtctacaagccaaggagagaggcctcagaagaaacaaccagcagataccttgatgttgcacttcttgcctccagaactgtgaggaaataaatctctgttgtttaagccaaccagtctgtgatactttgttacagcagccctagcaaaccaagagtgagccaccttggaagtagatcctgcagtcccagtcaagccttcggatgactgaaacttcggccaattatctgactgccatcagagaacccaagccagaactacccagctaagctacttctaaattcctgacccacagaaactatgtgaattaataaatgtttcttcttattttaaatcactaagctttgcaggtattttgttatgcagcaatagataaacacagtggattaaaaacaaacaaattaacaacaattctatttcataagttcaggaatataacatatatcattcagaactcaatttgacattatgaataccatctgattttgagaccttgttttaaagaaataataagccctactctgcactcaactttaaatgtgaaaaacaggtcaggaatggtggctcacacctgtaattccagcactttgggaggccaaggt

SEQ ID NO: 38203 - DNA, 1046 bp, Homo sapiens
ttcaagcaattctcctgcctcagcctcctgagtagctgggatcacaggaacccagcaccacgccggactaatttttgtatttttagtagagacgaagtttcaccacgttagccaggctggtcttgaactcctgacctcaggtgatcagcctgtcttggccttccaaagtgctgggattacaggcgtgagccaccgcgtctggccttttttttttttttttttccttgaggcagagtctcgctctgtcgcccaggctggagtgcagtggcaccatctcggctcattgcaacttccacctcccgggttcaagcaattctcctgcctcagcctcctgagtagctgggattacaggcaactgccaccacgcctggctaatttttagttgtaattttagttgtgacgaggtttcaccatgttggccaggctggtctcgaactgacctcaagtgatccacccacctagattacaggcgtcagtgatcacacccagccattgagctcttattaatacctaatgacttgtgagcaattttaacaatgaacagctaagtaaatactaaagaaaatattaaagcatatcaggtaattttttctttactgatccactttattatttcactttataagtaatacataacaacataatattagaagacataataaaaatcacatatctcaccactgctaacattttggtgtatgccatttaaaagtttgaaataaacttgttaattttagaatagttttagatttacagaaaaattccaaagatagtacagagaattgccctatatcctgcagccagtttccccattgtcaagcatcttacattcctatgctacatttgtcacaacaaatgaagcaatatcaatacattatcattaactaaagtccatactttattcagatttccttagtatctgaataaattgccttatgtccaatttctgttccagtagctcacctagaatattacattatgtttacttgtctttatggaggtttctcaaaaaaaaattacactgggcacggtggctcacacctgta

SEQ ID NO: 38204 - DNA, 1037 bp, Homo sapiens
tgctctgattggatgccctgccctccagatgaaccagtcactatgaaaggataaatgggccacctctgcctagtttaagccagtctagatttacccctggaactgatcggtctcacccaaatagcacaattgctccgtaacagaggagtggggaaggatggtggggaggccaccaaaaagtccattacagttactttctgttccctctttgtaagattatctgtcacatctttgtttttatcttcatatgcatcttttcctcgctcactttcccccctgcattttgacagcagttctcaagttcttcttagaagaagaattacctggcttgaaatatcaatattgccaaagttgaaaaagtctgctgtaataaaagtatcagagaattaattttcctgagctaaagtaagatttggtttcaaaaaagtcaccaagaaccatggaaaataaacgcgtgtatgcgtgtgtgcacatgctcacaacccttaataccagaagacaatgcaacaggattgtaagaggcacagcctgcaaagtgggttatattgtagaaaagccagaacgacatccttagtgaaaagctctgaccgtgtgtaggagtcattttcttactcttccaaacataaatttgatgctttgaaattatactttcagggaaaattcagatgttggattccttcctacttagcttaggattcctggtgacagaaaagactgtaaatcatttgcttcaacaggaggtgagttgcaagtaacaaaacaggtaatagtggttccagaaacctaaaagaagatcgtacataggtctctgttttctttcttctccatgaatgtcttctcaattccaaaaagggcttgaagacttttaactgcattttgcacgctgtccctcgagaagagagaaaaaaattccctttgtcagaaggcatgtgtcatcttatgtaagtgactttgtataagttacgtgctgtagtaagggtaaaatctctcatgagtgtatggcttcagtctgtgttctacttagacctgattatgtc

SEQ ID NO: 38205 - DNA, 1059 bp, Homo sapiens
tgtagaccagatgaatctaactaacatatacagaacattccatctaacagcagtggaacacttattcttctccagtgtacagtgcgcatgggacattctccagaattgatcatatgttgggctacaaaatacatcttaacaaatttgaaaagattgagataatctcagatgtcttttctgatcacagcagtatgaaactagaaataatagcaggaggaagattggaaaattcacaaatacatggaaattaaacaacacactcccgaataaccaatggatcaaataaattaaaagggaaattaaaaaatcttgagataaatgaaaatggaaacataccaaaatttacaggatgcagcaagagcagtgttaaaaggggagtttattagcaataaatacctaccttaagaaaaaaggaaaatcccaagtaacttcacccctcaagaaactgaaaaaagaagaaactaaacccaaagtcagcttaacgaagaaaataacaaatattaaggcataaataaatgaagtaggcactagaaagacaatagaaatgttcaatgaaactaagagtttgtgtttggaaagaatgaaattgacagacctttagctagactaaccaagagaaagagaggactcaaaaaaaactgttaatgaaaaaggagacactacaactgataccacagaactacaaaggatcataagccattacaacaaacaaattatacaccaacaaattggataacctagaagaaatgggtgagtttctagaaacatgcgacctaccaagactgaatataaagaaatagaaaagctgaacagacccataatgagtaaggagatcaaatcagtaatcaaacctcccaacggagagtagcccagggccagacggtttcactggtgaactctaccaagtatttaaagaaaaattaatgccaatccttttcaaactcttccaaaaaactgaggtggacagaacacttccaaacccattttatgaggccagcattaccctcttgtcaaagccagataagaatgctacaagaaaagaaaattacaggccaatgt

SEQ ID NO: 38206 - DNA, 1044 bp, Homo sapiens
tggatttgctggttttttcttctggttctgttcaatttttgctccctataaatcttttttctaaataataagtctttaggccaggcgtggtggctcacacctgtaatcccagcactttgggaggccaaggtgggtggatcacctgcggtcaggagttcaagaccagcctgaccaacatggggaaacactgtctctactaaaaatacaaaaattaaccaggtgtgatggtgcatgcctgtaatcccagctacttgggaggctgaggcaagagaatcacttaaacccaggaggcggaggttgcggtgagccaagatcgtgccatggcactccagcctgggtaacagagtgagactccatcttaaaaaaaaaaaaaaaaaaaaaaaaagagtaagtctttagataaaagtaaaatatttaccttattgtatatttgccttatggcatattaaaactcttatcattatgaagtgatgacccctgtatctagtcatgtttttgtcttgaagtctgtttatttcgtttagaatttgcatggtataatttctaaaagtcttttcatgactgacatatgtgtatgtgtttcataatgttatatatataacttgtaaacagcctgtatttggacttccttgcccctcatttcatagtatgtcttttaactggagtatttagtccatttacatttcatgtactttcccccatatttggattatatctaccaatttgttttgtgctttctgtgtgccccaaccattctgttttctttctctcattcttttcattttgcataagtatttttattgtattttttacctctactcatttgtagttatatactctatttcttttttcatttactgattaacttagaaatcataatgtgtcatttctaagcctaaatttaatctagtgttacttttccataacgtgtaaatttctaagcctaaatttaatttagtgttaatctagtgttacttttacataatgtgtaaatttctaagcctaaatttaatttagtgttacttttcctccagattatataga

SEQ ID NO: 38207 - DNA, 1016 bp, Homo sapiens
tgtttatttttgaggtgttctgtgtatgtagttttaactctgttatgaaaatgttgaaacgtgctagtgaaaagtggcatacagttaccatggaaacaaaactgagccaaggacatcacttagtacctgcagcctctcctgatgaagtgctggttcttgtgcaggagcctgtgctctctggagagccatgcctttggtaaaggtaaagaacttcacgagcactgccacttcgaagaaggtttctaaaagtctagtgatttccatgtccctgaagccatccaactggatgatcccttgttagtaggttcacaaattccgcataattcattcaaagggtgaccaggttatttacacgatgttcctggatttctctctttggtggatgtaactagtgtctgtgctgacagatgccttgctttgccccaggtatgcatgggggtggaacattgaaattcaaggacaaactttgggctattgctacaaatttgccaccaagaaaaaaaaaaaaagttccagaaggggcagaacaggtagtaaggaaaagaaacgtggtgattgttgatcagtgcctaattgaggctaggtggaatcctttttaagtggtttcttttggccctgactgcggtatagacaccacagaagatgcaagcatgaatgttgtttgccttgaggctgaaagaaaaggatagagttgtaattgggttctttttttttatttttaaaaatctttgcccttgaaatgacgggatccccccagaaaatatccatccaaacccttcaaacaaatggacacacctaagtctaagtgcaatgagaagaaaagaggtactagctcctataagatgcctctcacagataagagtatttcttaatgtgtttcttttctttttttattacagagaggccagatactggctgtttcttttctaagttctgcagaatgggaatgtgatctctaatgaatttttcagtttatgaaagtactattatagaatactaattagggtgtcccatga

SEQ ID NO: 38208 - DNA, 1030 bp, Homo sapiens
aggtatgttcagcctgttcagtggttaatacacaaacgtgtttaatggaggcaacccattaaaagatacattttttgaaggaagatagaaaaatggcaagtaaacaaaacaatgacaacaagtgctttgagagatatcaacaaggtgctttggcagagaacagtggtatgaagtgtcagcttaagacacttcaaggtctctctgaggaaatgacatttaagatgaggtttcaagaataagaagaaactagacttgtggtttaaagtaacagggtcaggtatggtcatctttgagaaacagtgagtaagggaagcagttatttgaagtgaattgggaggatggtagactctcaacgaggtaagacttcattgtccatgttgaggagtttgaattttatactaagggttagagaaaatatatgtggtttttggtgaagccattgattatcctaatctaggaatagattaggataatataatctgatttatattttaagaaaattactctagatgctatgttaagaattgatgggaggaatgaagactggatgaggagagtccaaccagaaggcgtttggtgtccaagttggtggttctaagcaggaggatagcagtggaggtggtgagaaatagatttcagatatattttggagctggagttaataaattgctgatagctgcaagcagtaggtaaaggaagaagaatgaagtcagtcttctaggtttttgtcttttgcagtgagatggatggtgttgccagttagataaggaagactcagggtgggaagaatatgtgggtcaaacaggaactacagtttatttaacattttaactggcagatgtctgtgcacatccaagtcttgacaggaacctggagtaactgggcaattttccaggaaaatacagtttaacaaaatggacttctaaatagatgggaaaccttagcagacaaatcttcatagaagagagagacaaagttgtcagagaagtaccctacaaatatgtgtatgatccagattacattacagagg

SEQ ID NO: 38209 - DNA, 1031 bp, Homo sapiens
taatagctctaagatttgaggcccatatttaatttgagtatctggagctgttaggtacaccctctccttccagatagctgtgtgagtgtgaagaaccagaaacgtgtatttggaatttgtatatactccttttctttcccctagtttagggctttcgtcagcacagtgagtttggctaattgcacagaggtccccggggacagagctttaacctctgtaatttgttgaagggacattgtaccatactctgcatatctagctctatccctgacaaagctattcccacctgaaaaccgtatgtcatgtggattatctaggagctgatcttttaaatcttcctggctggcataaatttggttaagtatctcacaacacaaatgtggtgttatggtctcctggtagtggcagtaaggaaactgagttaagggtggaacactgctcaactgttacctatgggttttctaacaacaagacttggtactttaggagtctgttttcagacacgttgtattctctgtctgcaaggaagtttggtgtttggactagatgttggattcccagttctcttgttggggagcagattaacaggtcatccatgtattgtaggagacactctctcctctcaagacttaggtcctgcaaatctctagccagggcttgcccagaccaatggggactgtctctgaaaccctgttgaagcactgtgcaggtgagctgttgactccttccttttcattctcccactcaaatgcaaatagaaattgggaggatgggtcgagggggagatacaaaagaaagagtctttaaggtctaagactggaaaccactgagcatctggaggttggggaagaattacatatgagttggggatcattgggtgtattgggactactgcctcatttatgattctcaggtcctggactagcctgtatttttcattgctctttttaacaggtaagatggggtgttatagggtattaataatccatgtttttgaaatttttcagtcagaagctgaaatccctctttgg

SEQ ID NO: 38210 - DNA, 1020 bp, Homo sapiens
tggagtctggactccagtgggtccactgggaccactaaacctcctgaatggggcataacttaaggaggtggtgtccagaggatggccctgggtagggaggagaaggcttctgggagacttcgatataattgggtagaaggggcaatggggcttgagctctgggtaaacctgatgaggggccttctgaaccaatgggaaggggctgcatgactatggccatggatctgttttacaagcccaacaaaggtcagggttgtttcttagggccatgaaggccagcacataggggatttctgtccattttccctggtggtagcaaaacaaatctagttgatggatcatatttaaatttgtgcttctattttctggccaagattcctggtcctagagcttttattcaacccaggctgtattacagaaaaatattagccttttcctttttagggtttgggagtcaaacttttcccagttcttgaggatgtatcctagtagtgtgtcctgtggtacagagacttgattacctgtccacagagagaacagaggagagaagagaaaaagaaggcaacccctccaatttccctactgtctttttcctgaacttacagcagaccagagtgggtagggcattaccccattcatccatttttcctttgcgtatggcagtgtcccccattcattctaggggttccagaatgaaccagtgcttaccaggtacccctaaccttggtcccatcttgttttattgaggcacaattacccgtttgtaaagaaagaacagaggcgagaagagggcatctccccttgttctcttaatcctgtgcctatggcagactacagtgaacagggtgccctcccactcatccaaggggttctggaatgaacccagtgtttactgggtacccctaccctgatcccatcccatttctggaccagccttcatctgtgttgcagtggtaatctgttttgtgtttgtagcctggaactagtcttcatctctgttctatgggtactttggtctct

SEQ ID NO: 38211 - DNA, 1010 bp, Homo sapiens
tttcttttggatgtataaaccaacagtagaactgctggatcatatggtaaatctgtttttagttttttgaggaacttaaatgttcttggtggctgtgtcaaaaatcagttaatacatggatttatttctggattccctattgtgttccgtttgtctatgtgtctgtttttttattagtgccatgctgtgttggttgctctagctttttggtatatttttaattcaggtagtgtgatgcctcctagttgttattattgtcatatctaacatagcagttgaatagcttattggcagttgtatctggcacagtaatacctttcttagtttattctttgctcagtcatacttttcctggtatgtattccttggggctttaataatggttttttccctcaaaacagatgtgtcatgtgtcgttttcccattgagactacctggcatttttagtctcatcctttgttcagactatgaacactctttgataaacagcctgtggtagaagtatcagatcttactagtcctaagtattatgatatggaaacaccctgtcttcctgtcctcctcctgtctgtccccaaaattacacctctgtaagaacttagtcattttacttggaggacaacttgttgaactttcctcaatttagtgaatttactgcaattcttatctaaactacaatttatctctttcctttgtactcccaacctatcattacagtagtcattgtaaaaaaaaaaaaaaaacaacaacaacaacaacaactgggtgtttattctttttggctgcccagtagatgagctccctagttatattaggggaattccatacctcacagtgttttgtgagaaacagtgtaactactacatgttttcccccagccctcacacagcctatacccagacagaattgggagaaaaatgcatactgttcaagcttacctctctccagatttgaggataaaaattacagcagtgtggaattggagtggctcagctggccagggtggggag

SEQ ID NO: 38212 - DNA, 1063 bp, Homo sapiens
gagtccagaaataaactgtaacatttatggccaattgttttttgacaaaggtgccaagataatataatagtgggggaaaataatcttttcaacaaatgatcctggaacagcttgatttcctcatgcaaaaggatgaatttggacccctctcttataccaaaattaacaaaactggattgaagacttacatctaagagcaaaactataaactcttagaagaactacatagatgtaaatcttcatgacgtaggattggtcagtggtttcctagatatgccatccaaagtacaagcaaacaaaggaaaaaatgatgcgttaggcttccttaaaatcaaaaacttaggtgcttcaaaggactttttcaagacagtgaaaagccggcccacagaatgggagaaaatatttgcaaatcatatacctgataagcatctaatagctagaatatactaagaactcttacaactcaataataaaaagacaagcaactaaatttaaaaaatgagcaaaagaaatgaatagatatttctccaaagaagataacagatggctaataagaacatgaaaagatgtttaacatcattagtcatgagggaaatgcaaatcaaagcttcgtgatataccatcatgcctgctaggagtcctgtaataaaaaagatggacaataaaaagtgttggcgaggatgtagagaaattggaacctcatacattgcaggtgggaatgtaaagtgttgaagctgctttgcagtttcacaagtgtttaaacacagagttaccatatgacccagcaattcccttctagatagatacacccgagataaatgaaaacatatgtccatggagaaacttgtacacaaatattcattgcagtcaaaaagtggcaactttgtttcttataatagccaaaagtagaaacttctaaatgtctatcaattgatgaatccttaaacagaatgtaatatatacataaaattgaatattattcaaccataaaaagaaatgaagtactgatgcttacaacacaatggacacaccttggaaacatgggctgagtttgaaaaaccag

SEQ ID NO: 38213 - DNA, 1029 bp, Homo sapiens
gcattaaaggacacacagacacacacacacacatatagtgttagagctacattattacatttaccttattgttttcttcccatgctgtattcaacaccctcaaggttgttttgttaacctgtttgccacagatcatgtttcacatttttgttagtattaaccaccaggaagattgaagaaactcatcaaagccaagtaaaaagatggaggagtttctttgagaatgcaattgagaaagaaaaccatgaatttcattggctggggcaagttgtgacttctccaggagtgctcagctgccaagaatgtaggatgggaagaagtggattgtgctagggttggattttgcaaggcaggtgtgtctgaagggcagggtcattagagattgctggagattggccctggaatttgggctgcgtcatgagagaagttggatcagtaaggcactggtaaactggatgaaaggaaagggatagggaattgaagataaaatgaatgtgacgtgtatgataagtttgggatggaaattaggtgaagtagttctgagtgatgacactaaatacagccatagaaaaggggaatctgagaacagtgactcattttaagcatatgatgtgagcctcagaatggccactaatattttccacatgatggctacagttggaatggagaaggtaactatgacttgggggccatgtcagggacttggaagacttatcttaaggtctgttatgtctggtggctcttaaaaggaggagggaacttcctgaaaatggaagaggaatgttctgggggagcttcgagaatgctctttcctcatcctggcctcccaccccctgggcatctctacaagtgcattagtttatcttgtgtaagtaattcagctggattgtaagaatgatgctgtttacaaagaactttgtgggggttagaggaggaaggagggaaggacagcaaaagcttcactaagaatcttgaagaaaggagttggagttttccaagtagaggatgaggattctagataaaagaatg

SEQ ID NO: 38214 - DNA, 1061 bp, Homo sapiens
gggggtggaataagaagagacccaaggtgacactgctgtggtttgaatgtttttgttccctccaaaaattcatgtgttggaaactttatgcaatagggttgggaggtggggcctaatgggaggtgttcaggtcatgagggccctgatctcatgaatggattaatgtcactataaaaaaggctttcaggcatgggatcccttttttttattttttgagatggagtctcactctgtctcccaggctggagagcagtggcacgatcttggctcactgcaacctctgcctcccgggttcaagcgattctcctgcctcggcctcccgagtaactgggattacaggtgccctccaccatgccccgctaatttttgtatttttagtagagacagggtttcaccacattggccaggctggtctcgaactcctgacctcaggtgatccgcaggtgtgggctctcttttcttccatatgaggacacagtgttcttcctctgcggaggatatagcaaggagatgccatcttggaaccagagaccgaacctgccagcaccttgatcttggacttctcagcctccagaattgtgagaaataaatttctgtcctttataaatcacccagtctcaggtattctgttatagcagcacaaaaagaactaaggctgttaacagtgtggatatttgtccccgctaaacctcatgttgacatttgattcccagtgttggtggtggggcctagcaggaagtgtttggatcataggggaagatccctcacgaaaggcttggtgccattctctcagtagcgagtgagttcttgctgtattagttcccaagagagctagttgttaaataaagcctggcagttcctccccaacccctgcttcctcttctccatgcaatcctgcacatgcaggctccccttcaccttctgccatgaatggaagcagcctgagttcctcaccagatgtccagtcttccagccagtcaagtcaagagccaaataaacctttttttaaaaagaaagaaaaaaaaaaaaagaggctgggggcagtggctcacgcctgtaat

SEQ ID NO: 38215 - DNA, 1047 bp, Homo sapiens
ttctcttacagaaccaccgagtatttatccacttgagtaaatttaacattgatttaatttattcaatggtagtctgtatttccatgatgacagttgacccaataatgccctttcttatttcctctgggatgggatccagtctagggcccgacatttggatctagttgtcatgtctgtctggcctcctttaatcagaaacattcccacagccttcctttatctttcataacaatgacaggcagcagaataagtttccctgtgccttttaaagacagaacaaatgttcttcattgtgtttgtctgatgtttcctcacgatgaggcgagaaaatgaaatactgcgtaagtgatcctgcatccgtctcaaaaaaggtctcatttctggagacactgatgtccttctcacctcattggcggtgttgattttgatcattcctcccctccagggcgttgactgatttccccatggtgtaaattactagttttcctttgcatctaataagcagcctgtggggagcctgaaatatgtttcttgccaggtggaggcacggtcataaggagcagtgtgtgtgtgtgaggatggagagaagcccttcccttctaggggaacgtgaggagagtggagggtgcacttcctccacctgcagctggaaagtctgtgcgcctttcagtgatgaagcttacagatggatgttgcagggctttgggtagggcctggaccaggctccaggtagagtatttcgggcttggatgttttcaggcaccaataagtcaagcttgcattgatgatattacaaagtggcagaggtgcctcctgaatgaaaaagaaatggaatcctaaccctgacttctgtctttgagggtcaaacatataaaaacatgtctgatgccggatttctgggaagggcattggtttctggaggggagattgataatggcagagatggaagtctgggccagtttcacaccagaggcagggggaagttgcaaggaaagattgatttagggtgtgaaattgccaacagatgaagttgttccacctggcacc

SEQ ID NO: 38216 - DNA, 1026 bp, Homo sapiens
agtggcgggcacctatagtcccagctactcgggaggctgaggcaggagaatggcatgaaccctggaggcggagcttgcagcgagccgagatggcgccactgcactccagcctgggcgacagagcgagactccgtctcaaaaaaaaaaaaagaaaaaagaggcctcattagattgtcacattccatctcatgactttggctaagtagattaagcattgaaagaaaaagatttttttcaccaaactttatgcaaataggaagaacacaatttcttactggagtccagttgcttgtgttatgataatcatggaatataatctaagagcatatatctacttgttgtagtaggacttgaaaaaaatgaaaatagctttgaggaatgtaggttactagatcaattaacattagcttattaacatactccattactccccttcatttggtatgttatcccatatacttacatgtacatcaatttttctaactttttataaataaagacggggtctcgctgtgttgcccaggctggtctcaaactcctggactcaagcagtctgcccaccttggcctcccaaaatgctaggattacaggcacgagccacagtgccctgcctctaatttttttcataatcctgtcgtggcttatataattttttttttttttttgaagcagagtctcactttgtcacccaggctggagtgctgtggcgcagtcttggctcactgcaacctgtgcctcctgagttcaagcgattctcttgcttccgcccccaagtagctgggattatacaggtgcccaccaccatgcccagctaagtttttttatttagtagagatggggtttcaccatgttggtcaggctggtctcgaactcctgacctcaggtgatccacccgcctcagcctcccaaagtgctgggattacaggcatgagccactgtgcccagccaatttcttttttttttagccaacgctttaccctgacggattgtatgattcttatataaaaaaacgtatacccagggttt

SEQ ID NO: 38217 - DNA, 1033 bp, Homo sapiens
agacttgtctagggctgggggttcagctcccaggggcattcatgtggctcttggcaggtggtgggaggccttctccatagggctactcacaactgtttttttcagaatgagagatcacacacacatagacacaaacacacagtaagagaaaccaaaacagaagccacagtctttgatagcctaatcttggaagtgatataccatcatgtctgctgtattctattggtcatacacagaccagctctggaacattgtgcgagcagactgcacaagggtgtggtagggactcttgaaggcctgctggatgctggctaagacagtcttaaaggtgggtatggggagaaaggaatgaggctaagggaagactaggggcatcatagcaggtgagggaatgaagtgtctgtaaaaacaaggtgattagaaaaagcagaaaactgtctcgatatgtaaaatcatgtttaaatagcacagtctagcattttcaaggattaatcctgatatttcttgattataagttatgtgccagtctctgtggtaaacactgatgaacaaaagtgaaaatgtcagtcattatccataaggagctcagtgatctagagaagctaacctttagattaagtaattcttttgtggcttgttgagttcaggaagaaccaggcaatggaactgtgaagacagcacaagaagaggttaagagtggagcaggaacctgttcatgggagggtagagaggcaggagaggtgaactgcctatgggttggtactaccaggacatgattatgttgctgctcttgggtgccttggaaagcaaagatgttttcatcagtaatatgaaactggattttcattatacagttttttccttctgtcactccctaccatgaattacgtgaatctgtcatggtttccaggcctgcgtatcagaatcacctggaactgttcatacagatccatggctccagtcgataaatgtggaattaggatcttagaacaaggcctaggatgctgccttgtaaaccaactcttcaggagat

SEQ ID NO: 38218 - DNA, 1052 bp, Homo sapiens
tcatgtatttgccgatagtgattgggccttagactttaagtcttgcttatccagagttgatcaaaatctttagggtccctgttcactcatgaggttatgttgatctgtcaggtaattcaaaataatagtaataacacaaaacctaacataactgttaggttatgttttctatcattttttccatcataaagagtatgattttttaaaagagagaaagaaatataaaagtaaatctgacattagggtactttgttcatgttcagtctgatgaaggaataatcctggactggtcattggaagaccatttgaaattctattttaattttatgattattttgatacctttggtttttataaaacattaaactgaaattttactttgccttctattaggtagatttattgttgagatcatagctacatattcagtagtcaaacaacactacttttttataatgtcagataatttcctgttcacagtgttaaatatagtcaataaataaattatttcctctaattgtattataagaacttttttaaatgggcgtgaggtacaaggcggattgttgacttttgtattgaagagcctgtggttgttgcagagcctttccttgtctcagggtaagttgagaaaagagctcccttgatgaaaatatacacccccatattctactcccttatattctcactttattaggttcacttaggaaaactgtatctttcaatatgcaaatatctgctgagcaagttggggtttttaaattttaatgtatttattataaattgaagccatttgtttgagagtaatgatctgaaatactgtttccctgaatgctggaagagaaaagcctctaaaaggcaagttttgtctatatttccgtaatcactagcatctatcttgtatgccattgagaagcatgcatggtagtttaacacacactgtaaaatatatcagatgtatcttctttgaaataatttcaaattgcatgagtccattctacgtgccagttcttaagaatttggcagggtaaagctgattttaaaaaaatctt

SEQ ID NO: 38219 - DNA, 1021 bp, Homo sapiens
ctaagaacaaggcttacccgggtttctgcaaggaagcttcatgcattagcgtagcagatgctctatgtccgctgcacctgagctcacttctgcattggcagaagtcaatttctgagcacccgacaacttctccctcagcggccctgcctgggtttttctcaggtgcccaagtcatgccagcttgcccagccagcatgcgaggcagcgggactgctgaggatgtaagaccctcggggtgggggtggggggacaaatgccctagctacccagggatgactcctctctttcctccttccccactgccattcctccctttccccatgccctcatgtgtatttcctgggtcaacccagcaaaccaccttctatgtctttgtctcaagtgcgctagagaacgccaactgagacaatcagcaaacatgaaagcgggattgcaacaccggctactcctcagattgttgttgttgttgctatttttaacagaactgcatcctcagaccagatgtttgttggagtgtctggggatgcccagtcttgacagtggggcattgggcaaacatgactcttagctaaacacctaattccctatagcatgaaaatactggaattcaaagaaaactggccagccttgttcaacagccccctggtaaacagaacagatactgtgtcatttttaacaacaaacagcataaattaaatttgaaccgaagtgtatgtgtcattgttggctctttacagaataaatgaaatgcaagctgagcaaatctaaaaggcaaatcattttctcactttctgaagaagccacctgtgggtctctgttcattggtactaagcctcaccctcggagcaccatatacaatacaatgggtctccatgtatttcccatttatactaccactgagataaatgaggcattcaagagaaaacaaagcaataaatgcatgttacaaatcaattttatcagagacattttacttcatcaaaaaaagaaataactacattggactcattagaaagtgaga

SEQ ID NO: 38220 - DNA, 1051 bp, Homo sapiens
tttttagtagagacagggtttcactgtgttagccaggatggtctcgatctcctgaccttgtgatccgcccccctcggcctcccacagtgctgggattacaagcgtgagccactgcgcccggccctgagtataattattaataccttccctttcactctcaagtgtcctggcatgggtgttacttgtttcccatttgcttagactttctgctctcggtggaaaaaccatcacacacagttcacttgctctcaccttcaagttatttccctcctctagaatgctgtacttccaccactgccaaatcgtgaactttctctccttcaatatcccactgagaactcacccccaggatgggactctgctcaccccgtcctctactcaagcagaagcctctcagcgatcatgtaaataactgtataactttaattggctctgtttataagcctcttatatctttttttccctctaggtatttttccatgtgtttatcctgtctccattaatttgtaatcttccagagggcaaggcctgaacacaagcttctgttggtgtaaagtggaggcacaggtaaggctgattgctagacactgccgtccttctttattagtaatctgttaaaaaaaaaaaaattctttgttgtagtgttttgttagtgatggtcccgagactgctaacctaatgaaaaactatatccagtgtctgctagtgtccagacaaaagaaaatcaacagttacaagcttttcataacgtgaggggaaagtgtgcggatattttgacccataagggaatttatggtgtatggaaagcatgttatagaatttgttgcctttagatttttattcttgtcttttcaaggctgcaggactgtctcagaagggaaataatatttaccttccaaactgagatctaaaacccgaacaaagcctcaggaaacatactccaccaccatcttacaagtttgtgctacgggtggagggaaaatgaatctaatgtaggaggcctcccgctgtgcgtctagcaggaaagaccatacggtgcaagtctccagga

SEQ ID NO: 38221 - DNA, 1051 bp, Homo sapiens
aaattctctatattgtagctagaaaggaaataagtaataatttaaaaaatagtttttgttaatatgggtgaaaaagttactaggagcgatcatgtagatagctgacagtgcttagtttgaggaggataaaaatatgaaaatggagttaacatagcaagcctcctttttttttgcagataattatttttcggctcatgttgagagcttatttgatgctttctgaatgcttattaacgttagccaaatgcttctttttaaaagcaaatacaaaatgtagtaatatgattaaccagagtaatgattttattttagaacatttttgtacaaaatatgttctgatgaggtacaatcttatcttaccatagaacggaaaaatacataatttgtgtaaaatctcctatcatagaaaaacatttttaagcttcacatttaaaatggtgataatttgagcaagtctgggctaaagttgattcttgtattatgcagaaaaatattttatgaataaattaagtgctttactttttcatgtacatatttaactctttaaaaacatttttgcagtactcttctgcatattaatactatgctcattacaggtgatgctgttatactgttaaccattgttcactatagcacaaaaacttataaccaaagagagacctttcttctcagtgctcaagtcattctttgagaaagaagctctttttgatcatgaggctttaggcttacatttggtatacagttgcattgattttgatttttttttttttttttttacaattttaatgagaagttgtcaaaaggtttttagaaattttctatgatgaattttgttctagaaaatattctaaggctgtgctgtgatgcaaacatattgaaaaaatagaaagtgataacaaaacggttggctgctgtgtaatgagatagcagtccctaagcatgaattggaaccatacgatttaagagttacacctacttaatacaaagcttgatttttatggtccttatgtgtttctgtccacagaatttctgtgtgcctgtgtgactagag

SEQ ID NO: 38222 - DNA, 1043 bp, Homo sapiens
ggaataatgaaagtttgtttcttcattttgaaataattgtttcttttatttatttttcttatcttgctcagttggctccagtaaaattggtatcttagacttgctcctgattttaaagaaaatgcttctaatttttcaccattaaaatgtttgctatctttttttgtgggaagagagtctgtatattttttagttgcttaaaggtgttatcttctattttttatttgttgaaattatttttaaaaatcataaatggatttttatttttatcaccttttgtttctatgtaaagatgatcttactatgtcctttattctttcattctgatgtttaaaagtgacttacgtatctttaaaccaatttggtcatgatgtttaatcttaatcactgctagatttgatttgttaatattttattgaagaattttgaatccatgttcaaggcattggtttatatttttattatgttttataattttctgtgcctgattttgttttaaggttatgctagtttgataggatgatctgaggactatatgcttctgattcccatggagctgtttgtttgatattggaactgtacctttgtaggcaagtcttacaacatattttgacttttgggagggactgcagggtagacttttaactcccaagtgtacttaacaataagggattatccaaacattctattttctcttcagttttaggaagttgtatttttcttataatttatccatcttatctaaacagtcacatctgttggcaaaaaatcagtcgtagtattttcttactctctttcatttctgctgggtgtgtagttatgtctgttttttattgcttctatcattgatttgtgcctctcctcgctttcttgattagtgttgccagttttctgttttactttctttttattttgccaacatctgattttcatgatactttcttgcctcatcctttttagtttcattaaattttgttctttattatcttttcctgtctttttcttcaggtttgttctgttactcaaatttcttaacttggaat

SEQ ID NO: 38223 - DNA, 1021 bp, Homo sapiens
catactgtacaacattagagcaagttataaaaatagaaaatgtatttatttcatgacacttcacatcagttgtcacttttctattaccttttgtgctaacccagctatatcatagccaaagaggacctgtgttgagttacaaaattgttcttaccactttctgtgaagtacttgtcaggagtcaggcaaagtgcttattgaaaaggcaaataagaaggttagtataacaaatactctaagtatatacttggttttcttctcttagtggagtgtttaaaagacatagttaagtaatgataacagtgtatttttgaactgtaacatttataaatacaatatgtatataacatgtataaatacaatatgtatataacaaaaggaggaaaaaggaaaatagagctatataggcataatgttgccacatctcactggaattaagttaatataaacctcactggaattaagttaatataaatctaaagagactctgaagatgtgaggtaagtcctagagctactacaaaggaaataatcaaaaatctctataaatgaaaaaattattaaagaaattaaatattacatttgaaaatattcacttaatgtaaaagaaaacattaaaggagaagtagaggaacaaaaaaagacacaagacatacagaaaacaaaaagttaaattgcaggcacaaattcagctgtgtcaataatatcaataatatgaatggattaaacagtctaatcaaaaggcatagattgtcagaccagattaaagaaacaagatctgactatacactgtctgcactggcactcactttagatccaagacacaaatatattgaaagtgaaaggataggaaaagatgtatcatgcaaataacaagcataagaaagctggagtggctatgttaatatcaaaagggacttcaaaataaaaaatgttactagaggtaaagagggacattttctaatgatgaaagtgtcaatccatcaggaaggtatagcagttataaacatgtatccacctga

SEQ ID NO: 38224 - DNA, 1031 bp, Homo sapiens
ctctgcagtttaattagaccccatttgtcaatttttccttttggtgttttcgtcataaaatctttgcccgtgactgtatcctgaatgatattgcctagattttcttctagggttttcatagtttttcattttacatttaagtctttaatccatcttgagttaatttttatatatattgtaaagaaggggtccagtttcagttttctgcatatggctagccagttttcccagcatcgtttattaaatagggactctttccccccatcacttctttttgtttgttgaagatcagatggttgctggtgtgcagtcttatttctgagttctctattttgttccgttgatctatgtgtctgttcttgtaccagtatcatgcatgtgttctttaattctgcaataatttgatggtttttcagatatcctccaattaattgatttctggtttaattctgttttcatgtaaaaacacactctgtatggtttctactgattttaaatagttgaggtttattttgtagctcagaatatggtatgtactggtgaatgttccacatacccttatataaaaagtatgttctgctgttgagtggaacatttctataaatgtctattaggtcttgatagtgttttgcgggtcttttatgttcttcctgattttctatttatgtgtcccattaattaccgagagtggattattgaagtcttcagctctgattatggatttatttttttcagtttccgctcctttatttcgaagctctattgcgtacacacttaggattgttatgttcatgggatgacctatatcattatgtaatgctcctgtttatccttcataatattctttgctctgaagtccacttcgtctgatattagtatagtttctgcagctgtattttagttattgatttatggtatatctttccccaaacttttattttcagcctacttatgtctttatatcaatatttaaaatgcgtttcttatatacagtatatacatgggacttgcattttattcagtcctagtca

SEQ ID NO: 38225 - DNA, 1017 bp, Homo sapiens
cccttgtgaactggacttcacacagcagcataaagccctcttggccttccaccatgtgagcgtgccgcgtttctcccagccagaggctgcagccctcaccagacagccaaacctgccagcgccttgatcttggactttccagccccgacaactgtgaggaaatacatttctgttcttcttaaattacccagtcttgggtattttattatagcagcacaaatgggccacaatctgccatagtacctgtcatgtaggaagtattctgaaactatttatggagtgggtttcattaaaagttactctaatctttgaaatagaaaaatatcttacttttatgatcaatgttttgttacaaactgtctcaattatagaaacaggcttttgcatacttacctggcagtggagataccatgatcacgaaggtggttttcccagggcgaggcttatccatcgcactccggatatgctgacccctgcgattttcccaaatgtgggaaactcgactgcataatttgtggtagtgggggactgtgcttgcgctttcccctgaaaaaaaaaaaagcaagaaaagaaacaggcttttgctgaggatccactcctgcttcccctgttgggccattcctgttgtgttgtgtttgatgttagaaacaacgtacaaagttcctcccttaaaattaaatctagatctttacttgtcatgcctgataatatcaaactagagctccagatactataattttgattatgaactttagccatcattgaagtacatcgtcccttcttattaattctcttggagcaaatccttcatgaatgataaaatgggagaggggtcatcatccttagctaaggtagggatgctaagatcgctaaggtgtagggaatcgtatttgatagttcagctctatccagtgtccttagactaaacctgaaagttaacttccagaattttacgctgagacctgaaaaataggagcaatcatgtaaggaggagaaaggcaatgcgggtacattcta

SEQ ID NO: 38226 - DNA, 1048 bp, Homo sapiens
cctctcccatgagtggcagccacctgagaagggcagctttcagggccccgagtggctgtgtgtccctgtctgctgtgggtaggattctgcctgccaggcacactcagcctcccagtgacctcttgttagagacacatcgggtgggatgctggccataggcgggcgctctcctagaagggggagatggctcctgtgactgaggggaacgttacacaatcagtcgttccctcaggatggaggcaggtgtttatcttcactgcaggagttggtttgtctggtgctccctgagagggacattacggtcacgggtgcagggctgcaaataggatctgtccaggttctcaccggcctccagctggggcatttcagcatcaagaaactgcctgcccatgtgctgggggcgctgtggtctctgatgtctgtctggcctcatataggggagggtggggatgtattcatggtgcatgtgtgtgttgagtgtatttgatgtgaccggaatgtgagaaaataaaacaaaaaaccataaggaagggaagagaacacggactaatgtgtgccaggctgagctctgacagtcctatggcagataccagctctaaattcagcctctctttgagtctcctatttgaaagcagttatctgcgctctcaagggctctctctcaagccattgagtagattagctgaagaattagtgaaaaatcatttaaatttatatatataataaggggattgagaggctgaggcaggaggattgcttgaggccaggagttcaagaccagcctgagcaacatagcaagatccccatctctacaaaaatttaaaaattagctgggcatggtggcacacacctatagtcccagctactggggaggctgaagtgggaggatcacttgagctcagcagtttgaggctacagtgagctgtgattgcaccactgtactccagcctgaacaacagaacaagatcctgccttaaaaaaaaaaaaaagaaagaaagaaagaaaaggccaggaggcacggtgacttatgcccataatcccagcactt

SEQ ID NO: 38227 - DNA, 1035 bp, Homo sapiens
aaaaacctacaaattaacctgtctgggcccttagtctatagtgaactcagaagaagagtaggctttttcctctctggctccattcatgttttggcagcacaaggctgagagaaattaagacggtcacggtggaacagaacagaggcctcagaaataacactacacatctacaaccatctgatctttgacaaacctgacaaaaacaagcagcctatctctggaagggatgtgagttcaggtagagctttagtgtgattggtggggtagttgggttggttgcaacctgacgagaatggcgtgttgtgaccgtcttttgttatttcttttacttttttattttttaaattatttatttatttattttttattataatttaagttctagggtacatgtgcacaacgtgcaggtttgttacataggtatacatgtgccatgttggtttgctgcacccatcaactcatcatttacattaggtatttctcctgatgctatccctccccaagcccaccaccccccgacaggccccagtgtgtgatgttacccgccctgtacccatgtgttctcattgttcaactcccacttatgagtgagaacgtgtggtgtttggttttctgtccttgcgatagttttctgagaatgatggtttccagcatcatccatgtccctgcaaaggacatgaactcatccttttttatgtctgcatagtattccatggtgtatatttgccacattttcttagtccagtctatcactgatggacatttaggttggttccaagtctttgctactgtgaatagtgccgcaataaacatacgtatgcatgtgtctttatagtagcatgatttataatcctttgggtatatacccggtaatgggatggctgggtgaaatggtatttctagttctagatccttggggaattgccacactctcttccacaatggttgaactaatttacactcccaccaacagtgtaaaagtgttcctatttctccacatcctgtccagcacctgttgtttcctgactttttaat

SEQ ID NO: 38228 - DNA, 1065 bp, Homo sapiens
gtgatgatgagcattttttcatgtgtctgttggctgcataaatgtcttcttttgagaagtgtctgttcatgtcctttgcccactttttgatggggttgtgtgtgtttttcttgtaaatttgtttaagttatttgtagattctggatattagccctttgtcagatgggtagatttcaaaaatattctctcattctgtaggttgcctgtttactccgatgatagtttcttttgctgtgcagaagctctttaatttaattagatcccatttgtctattttggcttttgttgccattgcttttggtgttttagtcatgaagtccttgcccatgcctatgtcctgaatggtatttcctaggttttcttctagggtttttatggttttaggtcttacatttaagtctttaatccatcttgagttaatttttgtctaaggtgtaaggaagggatccagtttcagctttctacatatggctaggcagttttcccagccccatttattaaatagggaatcttttcccccttgtttttgtcaggtttgtcaaagatcagatggttgtagatgtgtggtgttatttctgaggcctctgttctgttccaccgtgactgtcttaatttctctcagccttgtgctgccaaaacatgaatggagccagagaggaaaaagcctattcttcttctgaattcatttttaccaggagtccatggtagggaagagaggaagggaaggggaggaggggttgagcccttattgacagtctctatcctaggctgggcatagtgtgtggctctgggcttatgaggatgagtaagttccatccctgcttagagggagtcaaccatacatgagaaaccagtaggatgccccttatggctgggatacagaatgaggccacgttccctttaatatttaagctcaccatctctgagcccccatcccactatgtttcttccttgcctgcttcctgcctgtccctggttccatctgtcaggggagggttagcctcccctcattcattcagtccaagggttagccttggttgccatttcctcaagagaggaaggcca

SEQ ID NO: 38229 - DNA, 1599 bp, Homo sapiens
atgatttccttaggacacatttcctaaaagtgggattcattggacagattgtatgcgtatttcaaatttttcttgacacgtctttaaaagcagaggcactttcttgtggtgcgtattcattcagccagtatttaaagaatgcttcccagtgttgagtatagtgccactgttgatgatggattgttaaatgagaaaagccggtttacaaaacaggtcatgctcttcccatccctgtaaagaatgtttataagcaaatatttataagagaaaacctaagaggacatacatgaaaatgttaacagtggttatcttgcggtaagattatggatgatatgtatgtttttttcttcgtattttctaccttaaacaaaaagatagaaaatatgttttaaaaagttatggatcatttgtttaactttaaaaagcagaaacaaaaccagaattaaccccaaaacatgttgattgagtcacttctatgtcactctttgcataactctccttttcatgtcacatattcttctcgattctagtgattgatcaaaggacacctcttcactttcccttgtcccttggacaccctgttttatcccatcctgtttggcttttctcacacctgcaaccacagacctgcctgagtttgtgtaaggttttctgaaataatgttccttctccttgtcgtctggctgtttgttcatctccgtgtacttgccttgtaggtgggcacttcctctgtggtgtacccagcagccatgtttgccccccaggtggctgccaggggcgtgccagtggctgaatttaacacggagaccaccccagctacgaacagattcaggtactgggataccctgatgggagagggagatgtgggaggcaggtacagacatggtcatctaaacatagttgacctactcctctaatttttaaaaaagacatagggtttgtgtttttttgtttgatctgcagttgcttttatggaagaacaaaatcattcactgtagactaaggtagggtagctctgtcattgtatgcgaaatttgccgtgggacttttgtttgttcacattttgaacgctcttcttggattccttaggctttgctttcccttacatttttaagctagacttagtgatgacctgtagttgtaggttacccaaatgctccgcaagtaagcctgggagatgcccttgcagaacctcatcacctgccgttcttactgggaggccacctggcagatacccctttggtctaatcgccaaggttatttgtatctgtggccatattatgacactgatcctgcttcccaagtttgggtgggaagtgtagattgtcatagtatgcatttttagtcttattcctgggtctgttttatttcttcatccatgttctgtcttttttctcaccccaacttttttttgcttttacctctaattcttgtccatctagttaattccttttgaataagttagaatataaataagtagtaaattaatataaatgaataaaatagaaaacttcattgaaccatcttgtcattactttaatcaacagtttccaaccttggctgcatattttaaaaatactgatgcctgggtgccacctc

SEQ ID NO: 38230 - DNA, 1026 bp, Homo sapiens
ggctggagtgcagtggtgcgatctcagctcacagcaacctccgcctcccgggttcaagagattctcctgcctcagcctcatgagtagctgggattacaggtatgtaccaccacacccagctaattttgtatttttagtagagacggggtttctccatgttggtcaggctggtcttaaactctcgacctcaggtgatctgcccgcctcggcctcccaaagtgctgagattacgggcatgagccaccgcacccggcttactgggggctttttaaccttgtttggctacattacctcagtgaacaaggggaagctcacaacaggaactcacacaaagaaggaagagaacagtaccaacaaggtagaacatcacgatgagaagaaagaatgatgcaaatatgtggacccccaggataaacacagctgcccaaaatttagctctggcccccttagatgggggaagtcaacagtgaagtgtttctcagcatcataaaggcagaagctgtggttcctgtggggcctgccaaccgttcccagatgctgaactctgctgggagttttttccatgggactttaaaaaatgatgcccttaggttgggccagacctctgttaacttcagtagggatggcaccaggttcaagaggccaaagaagagacctggagctagtgaaggaaacatagggtttatttggggaaccttacagggtggtccagtggccgcgggctggacagaactgcaaccacttataaaaagcatgcagtttacatagcactttcactcagcaccctcccctcagcagcctccacgtggcaaccctcacttcttaagttattgctgtcagatgcatctgccatacagggtcattctcaggggatgcttaagttatttctgtcaggtacatcttccatacactttactaccttggagtaaagtagtaagaatacagctttttccttaacctttaccagctaactcagtgcttaggggccttggaatgcctgctgtccagcaggtgtcacaggcctga

SEQ ID NO: 38231 - DNA, 1036 bp, Homo sapiens
ttgaattatatactggtacatttatttgaatccatataactgaaggaattgtagaacccaaattcaaaagctaccttggtatatgaatttgatgggaaagacggaggtaacgttctacttcttattttaccatttatttttgttcattcccatagctagcttttgaattcctgatcccattgtgttcattcagtacattttgttgactgcctgtcattgtactagggcatagtgggtggtggtgaataaaaagtgttttgaatcatttagtggggtagcaggcacttatccacaggctctgaaaacttgatttgtcccatacttgccttacctgccaccaacctgtccttcctgttccccacttcatttagcatctttggtgttttatggtttaaagcgaaaagctatagtcgtctttgggaattgatcaaaccctactaaatttagccttctaaatttttttttttctatcctctttttctccccttaaggctttaaattcagaaattcagcccccttttgcttaggccagtgactctcaagttttcagtaaaaaaactttaccaaagagttactcagatcctgaatacattaaacgtaagagcaaatctatttggtggcaaattccctttcatcttttaaaaccaagctcaagtgtcacctttaccttctcatttgcccccccccacctcccatcacttccgcttttgtgtggcctttctcctgtgcaaatgcttctgtattgtattctgtccatttacatttctctctccattgggccacagcccccttgaggctgttccctgtctcctgtgcctaaactattaaattaatcctttgtgatttctccaaatgaaatgaggcagacctactcccattcacttcatatttcaaatactttataacttgttctgaacaagtgtttcacttgaactccattgcccacagcattttgctgctttgaaagcctgctaataggctctcagattttaactgtgaagatcttccaatgcttgagagttggtggcagtgtact

SEQ ID NO: 38232 - DNA, 1049 bp, Homo sapiens
gagggcttgcctgggaggggttcgtcgaggtcgctcgggtgtctggttggccaggctgcgggggtgccctggactgggccaggggcggtcggcaccaggctaagcgggcgcctggcggctgagcggtgggagttttcggctggcgcccggcggggaattatccgaggagccctaacttgtataaaagcagagtccatttaaagttgggctggatagcctctctctcattggttagggggcttggaaaaaagagactcggcgagccctcgctgtggtgctgccgccgccgccgccgccgccgctggagttgactcttctgctcgcactgctgctgcagcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgtgtgtgtgtatgtgtttcgggggaaattttccattatgagtgttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgtaagtgctcctaacaacacatcctttgacttgcagttttaagcaatggctgtgaatgtcaagtttatagataattctgcctctgaagggttttaaacacagcgtccgataaggctgtttcttttttttctgaaagagggcttttcaagcaaagtggtgtctgcctagtttggttgaaaaaacagactggtgtagagatacctcaagtgaataaattgacctcgaatgac

SEQ ID NO: 38233 - DNA, 1029 bp, Homo sapiens
accctattaaccccacaagagtaggggctgaatttatgtcattgtaggtcaatgttaatgtctaatacatagtatacattctaggaatatttgagttcaagtttggtggagtatttcgagtactacttagtagtgggagggaatcggtatgaatctagtgcaaaaagatagacttaactgatcacaattttggacgctataattttatagttgagaattcctgaggtttctagtactgttgtaaagtgacctgcttgtggtcgcatattttatcagacacagctggggcatgaaatccaggtcctgatacagtagaaggccctctctgttactgcctttggaaatacttttcttttcagggggattttcagttattcatggtaactgcagtaattgattcattttcatggaaaaataaaatccacgtgtaatccccatacctaattaagccaatagcattttactgttgtgcagatggccttttttgcttaataagaagtgattcaaatcagacaagtactcaaaagatagaaatcattgaaatcacatactggacattcctctacttgcacatacagttttatatatatgggccatactctttaagtgctgtatttttgttacctcctgtttgcatttataacttgtcatggtaatcaaagacagtgatttttaatggcttcaaggccgttggttgatagttaccactattttcttgactcatctcttcgggatgggtttttcacagatttggggctgttgtacaaaatgatgcatgcagcctgctttgcacgtgtctgtttgcactcaactctaaattcttactgtgaaattactgacttagaagtgcccgtatttacgttttgatctttcctagtacattgctttcttggagagaggctatactaatttacagtcccacaggtagtacacgttaggccagcgggttggttggtttgttggcttttaaaaaacaatacaggcatttgtaacaagtagtaaagatgtcagttgagttttatttaagtt

SEQ ID NO: 38234 - DNA, 1117 bp, Homo sapiens
catgctggagtgtgtatcagtacttcattcctttttgtggctgaataacattccattgtatggatgtatcatgctttgtgtatccagtcatcagctgatggacatttgagttgtttctatggtttggctatttttttttttttttttttgagatggagtctcactctagcccaggctggagtgcagtggcgcaatcttggctcactgcaacctccacttccgggtccctgttcaagcaattctcttgcctcagccttccgagtagctgggattacaggtgtgcgccaccacgcccggctaatttttgtattcttagtagagacggggtttcaccacgatggccaggctagtcttgaactcatgatccacccgcctcggccacccaaagtgctgggatttataggcgtgagccaccgtgcccggcccgtttggctattttgaacaatgctgcggtgaacgtttgtgtggaggtttttgtgtggatttgtttgcatttctcttggaataccttgttagaaaagcgtgcttatacgtattactactaaatttattttctgtcattaagctgtgtttcagttcatgcctctgaagtgatgtgctctgttcagcagagtcctatgctgtgccctccccttctggggctctagcttgccctttggagggtgtgtgtttgtgtgtgtgtgtgtgtgtgtgtgtgtgtgtgtgtgtgtgtgtggtaggggtcctcattttccttactgcctgtcactctccatgtcactgtgggtggccaagagtggtctcatttcctctacccctttgcaaaccgtaaacactggtcacacgtgcttgtgctggaatcatatgctccagtggcttgatggtgggacttcagatttcctgcattaccttaggttttgactttcttgtggttacctctgtcagcattctttggcagaggactatggggagtagaatgacctagaaattatccctgattttcttctccttccaagcctgctgaaccaaaaatggtttttatttttctttgaaaaactacccttcgtaatgaactccattaagaaataggagttcttcaaaggaggagggatgttactgtattcttttgatttctctg

SEQ ID NO: 38235 - DNA, 1079 bp, Homo sapiens
ctggcaatttttattttttagatacagggtgtcgctgtgttacccaaactggagtgccgtgacgtgaacgcagctcactgcagccttaaccttcctgggctcaagcgatcctcccacctcaccctcccaagtagctgggactagagctgcgcttcaccatgcctggctaatttcaggcaatttttaattgttagaaaaactgtaaggcaacataagagaagtggatggtggggactgcaaatgtcatgtggcctagtggtattgagaagcattttgtgaagcagagagtgcgtgttccgattctgtaggagcacatgtcttggtgtgggtgtctttgccttcctagaacttcctgatgataagaagcctgtaaacaccagtgtgtccgtcagtatttggaatcttgtttattacatagtcctcaggttcattgtcaaaaaattctttactgatggtattaatcagtatttggaatcttatttatttcatagtgctcaaggtcattgtcaaaaaattctttactaatggtattaatcatgcttctcacactccagtttttctggtatggttttctgttccaaattgactcctgtgctcaggtcattagtttggcttactaacaggagccctgacagctatattcaatatttttctctgcagtggccaagtagccaagaatttactagtttagacacccacctcagtttagaaggtaggtgtgagtgtgtgtgtgtgtgtgtgtgtgtgtgtgagagagagagagatagagagagagagagaatatctaagaaggagttaatattttaaactttgcattgtttaactggaaatctgtgttctgccgggccgcttttatgtggtgtacctataacctatacacatacttgtgcctttcaaaggctaacgccacatccctcctactaaaattgcttattagagctaattttaagaattgagttagaactgccctataatgtaatgcagaatatttcccaataatgcctaggttaacaatgatagtcttgctgtattgtgcaaaaaaggcttctgttcagacccagctgggtttcaggcttaat

SEQ ID NO: 38236 - DNA, 1058 bp, Homo sapiens
ctcttttccaattgtccctgctatattttcttccttgacaaactataaaaccaagggaatgattttcaactaatggttgtgttctttaaaaaactgtttttcagccagatgtggtggctcacgcctgtaatcccaggactttgggaggccaaggtgggtggatcacctgaggtcaggagttcaagaccagcctgaccaacatggagaaaccccatctctactaaaaatacaaaattagctgggcatggtggcgcatgcctgtaatcccagctacttggaaggctgaggcagaagaatcgcttgaacctgggacttgtgggttgcggagagccaagattgtgccattgcactccagcctgtgcaacaagagcgaaactctgtctcaaaaaacaaacaaacaagcaaacaaaacagctgtttctcagggtagttttcttgaagcacgatttttcgaaatgttgtaaattagtaggaccctggctttgagtcaggatcctagatggaatgaaatgacacctaaagattggtgtcattcttggggatactcactgaagaacatactgctccattttcttttcccttctgcatttctctgaaaaattttgtctatatcttttttttttttttttaagatggagtctcgccctgtcacccaggctggagtgcagtggcacgatctcagctcactgtggcctctgcctcccgggttcaagtgattctcctgcctcagcctccggagtagatgggactataggcgcccgccaccacgcctgcctaattttctgtatttttagtacagacggggtttcaccgttttggccaggctggtcttgaactcctcacctcaggtgatcctcctgccttggcctcccaaagtgctgggattacaggtgtgagccactgtgcctggcctgcttctctatctttgaaaaaggagtttttggggggcattaaggaaatttgtcccttttcattttagatagttttgggggatgtctttaatgtttttttgtggttctttagaggtaggcatatgaagacactggtgcatttttatc

SEQ ID NO: 38237 - DNA, 1801 bp, Homo sapiens
agataaatggatgtttcctcccttccctatttaagctgcctaagttgactaaagttcgacttgataaatgtcctagttaatttaattttgtgttagtgcctctcctcccctcgagtgtccagtccattttcagctgacttgcagaaaaaccaggttaatgcaaatccatcagattctgcatgcctgttaaaatgcttaagcattctacatggcgtgggagacatgatgcttgcctaaaagggtccctggagagataaagtatattcctgccagtgcatttagggagttatacatatataactgtctcatatgatttggcattgtcacatactgagcactgggagagccaaaggaggtctggggttggtaggctgtttggaggtaaaagtttactactggaatagtccttccagctcagccgcttccatttccacattgcctcagaagttgcctaaaggatgtgcatcttgttggcagccccatgactttctagaagccctgttgtgtctgtttagtgctttctacattaggtcggagatcttttttcattaggtcagagatactggactcctttttgttatggaaataacagtctcttggggttctctggaatgagccagggggtcctgttggcctggtccttggaggagaggtccaggctgttgctttcagtatccatgccacctagaatttccagtgactgttgagtcattacattgctatggtagtttcttaggaataggccggtacaatttgattgtgtttttggaccttcccccaagttacaaggccaccagcactcagactgtgggtataccatatggaccagggaacacattggacaaggcgaaagcttgttaccatgaagttcgttagaagatgagactccattcaaattttcagttcttcatgaatgagttcttagtaaaagtgctttgttgatttttttccatggtagtaactaccatgttttgagtgccttgttaagtaacataagtacataatattctcacacacttttgcaaagcagaatctattattttatttttacagatgagcagatagggctttggagagagaagtggcctgaagtagcacgcagtgtgggtggctggagtatatgcaggggctggagttacagcccagttttcttaattgctttgattttatttacctattttttatagaaacagggtcttgctatgttgcccaggctggtttggaactcctgggctctagcagtccttctgcttcaacctcccaaagtgctgggattacaggcatgagccaccgtgctcttggccttaattgttctgattttaataatggcatgatacccctgtaccccaagttatacagatgagagattttggctctggtatctctgtctctatcctgggtaaggtttctcagggttgtaggccagtctctttgtcaggaagagagctagtagttaaactgaaacaaaggtccgacagtctttattttgcattttaaggtacctgttgaaaatgactaaacgtaaaatgggacttttgttaattcagtagctgttactgaagcattagattgattcacctgtttaaaagtagttatgaaagacaacagagaacagctttctatttgtcgtaacttactaatagatagccaagtctgcaaaaaaaaaaaaaaaacagtcaaggattccatgtagttgcaaaaggcaagttcaagagaaagttggcaaagaaagatggatagatggagagaaagcaaaagaaatccttttttttggagagagaacacactgttggagtatgct

SEQ ID NO: 38238 - DNA, 1042 bp, Homo sapiens
ttggtaaacatgttttattattagcttgagaaggaaatgcctggtatagtgactaagactgtaatagggaaagagaactacttttctggagcagtaaaagttttgactaatatagatgatcagtgtttgtgaattttacgttggtatgtgtttttggtcattggtaacttaacagaaaagtatatgtcaagagaaagaatagtttatagctctttggacataggagggaaacgtgataccttttcatctttctgaatgaaagatgatgattcctgatctcaagtcttcattttacaggtattttaccattattaccaacatgttacttgaagagtaatgaagaggccgggtgcagtggctcatgcctgtaatcccagcactttgggaggccgaggtgggcagatcacctaaggtcaggagttcgagaccagcctggccaacgtgctgaaaccccatctctactaaaaatacaaaaattagttgggcgtggtggcgtgcgcctgtaatcccagcgactcaggaggctgagacaggagaatcgcctgaacctgggaagcggagttgcagtgagctgagattgcgccactgcactccatcctgggcgacagagcgagactctgtcttgggaaaaaaaaaagagtaaggaagagaaagctttccattgttgacttagtagttcaaagcctaatggtgtttttgccttgataatcaggaagatttattcctatgctttatattgattgtggtcactgtactttcttttacatgttttcttactttgctagatttgttaatttttacggtgacccacttttagttaagtgagaatttctttctaaatcaggctgtccattgcctaggatagccaaccttaaggcaaaggataacatataacctcattttgtatctgtttattgtgatcacaggttatttggtggttatttattttttatttattttttgagatggagtcttgctatgtcgcccaggctggagtgcaatggcgtgatcttggctcactgcaacctccgcctcctgggtt

SEQ ID NO: 38239 - DNA, 1045 bp, Homo sapiens
tcagctgcccatctcgctgcgcagcctcagttgtcccagcctccttttgctccttttcctccctcctggagctggtggtagagaatggacataatttgctgatcccccccccccccccgcccacccactgtaacttggttagttaaacctgcactttttggtaaaatctggagaggtgataatttattcactttttttagaggactctaaagccagaggattctaagcctccaggccacctctcccagtccgtccaagttgcagacaccagagagcagccagctcatggttacagtccttctctgaagcagccagacaatcatcggaaggcccttcacagactcccatatctagatgagtgatgctttacttttgacctttgtagcatggcctttccccctctaaccctttaatcatctctttaaaaaaatcaatcaacaaatatttattgaacgtttccttgtaggctttaaaatccacccataggctgctctgtgactcttaaggatttctgccctgcatccagagagaatgcagtagctctggccaatttacttagtatctgctttcttagattatgagcattttctgtttttcctgggagtccatgggtgtgtccagtgctggcagggggcaccatcaggttgcaaggttgaggtggtgcatcttatctgcttggtgaggtgcagggaggggtggagcagctgtttccagcatgtgtttcgctctctttattggccctttcagctgactgctttttacaaccagttatgatggaacatttaagacttgttttggggtcaccacaaccaagttttctcttctcactgattggcaggaggggtgcccactgggagccagcacaagtctgggattttttggttggacagggtttcttgcctgcagtttccagctggtaaatgagcctgggcttgaggaagttgtcaaaggccttccatcttttaaatcttggccatgtagctggtattgttgaagaaaacgtgaagaaggattttaagaaatggccattgaagattgatgttgg

SEQ ID NO: 38240 - DNA, 1050 bp, Homo sapiens
tttgtatttttagtagagacagggtttcactgtcttggccaggctgggctcgaactcctgacctcgtgatccacccgcctcggcctcccaaagtgctggggttacaggcgtgagccaccatgcccggcctcagtttggatttttaaaaaaccaatcttattgaagtaaaatttatacatgcagccatttcaggtgtacactgtgataacttatgacaactgcacacatctgggtattaccatcccatcaatatatgcacctcctgtcacccgagaaagctcccttgtgctcctgtcctgtgcccccatgccagcgccgacctgccttcttgcactgtagattagctttgcctgttgtaaatgccatatagatggaagcacttttgtgtctacatcccttcactttgctttgagattcatccaggctgtgtgtatggtttgttccttcctgttatggttcagtagtctcctctctttctgtctttctgtgttcttcctgtgactcactcattgtctgtgtttctttttttccctgtaagcctggcctggtcctttcgtgattccctgtagtctttttctcaagtgggcattaaagcaaccttatctttcacacacactgaaagaacctagtaactgagagatgatccagccagattctgcccttacctttacccctcaccaccccactaggggacaaaacaagcaaatatactgactgacccaagccttgttgttccgacgaaaacactggcgttcagcatctttcccgcaaaccgagctgcagcctccagtttcagaatagtgccttccataaaatctgtgggagttttccgtttatgttgcttgtttttaaacaatcttcttggaaaagaattcagtgctgttaatggattgccgtcggagctttttttacattacacctgtcctctgcttcctgatctccttttgatggttagggagaatatgttgacttagaatagcaaggagccatggcaccccaaggaaacaggaaaaatctcagttttcatggatgagaaagtcccattctatt

SEQ ID NO: 38241 - DNA, 1025 bp, Homo sapiens
ttccttattcgaactggagctaagcactgagatatttcagccatacgcttgttagggagtgtatctatgtaaatacaagtaattttaagtagacaaggctatattagtagaacctgattacttttatcttgctggtttcttccattgttttattagtatgtttcaaatatttaccatggtgagccgatcagcttctgatctatgtggatcagtatccaacaaaaactgactagaagagactgtggttgtggatgcttgtgaagagaatggaaaatgtattacagtgttaatgtcctctacaattccagtgacttagtattcagttaagacacaggtaaggtgttggttataagccggtaattcaagttaggttaactctgtttcttttccatcataaccagttgaaaagaggaagactttacatttaattaggtagttcgtagaatgtaagtgtgagaatagaaaaatatatttaagaaactcagtcattgttctttacacaaattagagtggattggtagctttgggggatttaagtgggttgaagtagaaggtgaaatgatgactgttaattatcaaaaaccatacataaatgtgatttgtagtttattttgaaacctactgtagtttaaattcatctggtattcattacaatgcagttcttaaagaagatgaaactgtatagctaatgacccaaatgtttccttcttatctaatcagggatccttctttagtagctagattagatgttattcagaaaggataatataggaaataattactgtatttcatttgtggagttaagcatatggcctctaattcattttcatatgcaatatatgtaaattagagaccaatctatattattttcagccatggccatgcaagaatatgattcattctctctctctctctgtgtgtgtgtgtgtgtgtgtgtgtgtgtgttagttaaacttgcatgtgaagtatgacttgcagtttgtagtaattttgtgatgctggtacattttctcatcttgtttggg

SEQ ID NO: 38242 - DNA, 1122 bp, Homo sapiens
cccaggttggagtgcagtggtgctatcatagctggctgcataggtgccttttgactcgcctccaccccacccctgcacattttcatattatagtcccttatcagtctcagggcataactctgcagtatgtgtaacattcagcatacttggtgaggccacgagggggagatctgatgatggcatctagggcaggtataaatgtgagtgatactgcattcagctgccatcccttccattctggaagagtgtgtgtgtgtgtgtgtgtgtgcgcgtgtgtgtgcgtgtgcatgtgcgtgcatccccgcatgctgccagtgggtggtggggaggagtagagaggactaagaatgagggagggaggtcataaaggacacaggaagccttggaaagaagggcacgtagcaatctctggggtaaaacagcagaactatagaaatttggttctaggacagtctttataaaaagaataaattcaagaagcagatgaatgggcttggttgtgacctggactgcaacgcggtctctgctgtctttactttcacattcttgtccttcaaggctcaatgttatgtcttttgtgaagcgtttttcatcccccacttagatgcattttccgtgttggagtagctgtgttgtgcacctcgtttgtatttgtctccacacacattatacagtatcttgtttgttttcagagaacccctaccatccccagcctagccacctttgattcatcttagtggattgccagtgaatatttattacaggcccaggacatgtagctgttcaataaatattggtgcaatggaagactctcctctgtgtgagagttcatgaagggaaccaggaggtgaattttaagggtcagtggcttgcaacactcctggaagggctttccaggacctcttctgaggtccgaagaagcaaagatcaccccccacaaagtcacctgtatggaattcaggtagcgatagagcttgtgaacaggatctccaaattctccaaaacatagtaaagctgctatttactgggcacccgctgtgtaccaggcactgggcaggatgatatgctttacatgtattacttgcaattcctaataacaccagtgtctgcaggttgctgttg

SEQ ID NO: 38243 - DNA, 1027 bp, Homo sapiens
ctttgcagtagataatctttgtgtggaggggttctcagtattttttaaattatattttataaacttccatgggctgggactggttcagagtcttcataagctcatagaaatgctttaaagtttgaacttaattaaatttttttttctagaagttaacttgtgggttttcttttcctcttctcttcagttatacttgaaaaggtagagagaattgctcttgctttcttctcgagtataaaaatgtcaaacattgttctttattcttcgctgaaaccatacaggtaaaaagcccacagtcaagcttttgcagacccagctcccagctagatgagaagcagctgcaacaggagaactagcgtggggagctctaaccagagtaggctttgctgtttaggtttagtggttgctattttctacctctttgtgaatggagaggtggaggcggatgaattaagccaattaattggaaaagaaatacttacttcagtagcataccatctgaagcaataggatggaagtttaagacttgttaattaagaccatgaaagaactccatggacaatgttgaaaagggttttcacattaactgtgtgtgtattaggaagggaaaaatgttttcactgagattcctgaaaccatattgcaacatgagtttccctcttgaccttgcagcttatgttggtctgcttttcaatattaaaagaaaaatgtggatcccatctatgaagtcatagctcatttaggggtgatgtggtagataggtcctggttagttttgaaggacctaattgctatattaggttttattttctaatccaagatggtgactttttgttggaggtgggagatactaaagaaaaatgttccatctggatggaattttgtgggcaggtaagtttttagtgtctccatccacaaccacaacaacattgtgtgccctaattagttacgtgtgtgaagtgggcctaactggagtagccagtgagaatgacttggacgttttcagaagaattatttgcaggttggaa

SEQ ID NO: 38244 - DNA, 1382 bp, Homo sapiens
actgtgtagcccaggctgaagtgcagtggcatgatctcagttcacggcaatgcctcctgggtcctggttcaagcagttttcttgcctcagcctcccaaatagctggaattacaggcatgtgccaccatgcccagctaatttttgtattttttgtagagacggagtttcaccgtgttggcctggctggtcttcaactcctgacctcgtgatctgcccgcctcggcctccgaaagtcctgggattacaggagtgagccactgtgcccggcctatttatcttatttttatgagacagggtcacactcagttgcccaaactggagtatagtggctcaatcatagctcactgtaacctcagaatgcctgtgttcaagcgatcttctcacctcagcctcttgagtagcttggaccacaggagtgtgccgtcatgcctaattttaagtttttaactaattttaaatttttgttgttgtagagatgagggtctcttgctatattggccagggctgtcttggactcctgggctcaagcaatcctcctaccttagcctcccagtgtgtgagaattacagacatgagccactgcgcccaacctagtctttcttttttaaagcattgttttcccaaaggctctgaaaaccttgttagccaaaaaaaggcacagcaaggtccgccaaccttgacttgacttcactcctgacttttaaatcaatacataaaggcttttgtttattttttgttattttgctcttcagtaaattagggcacctaaatttatattctgagtttcgattaaaaccacccaactacattcatgtctctggactgaactttggtattttctctaaggtctgtaacaggtaacagcacattgaaaaattcagtggaggtgactccatttactgagttgaaaacctttggatgtattcgactcccttttttcacacacgccacatctagtctgtcagccttctcttggcccagtgttgtaaatgttccagaatttaaccagttgtcagtctttggcaccaccctggtcctcatctcttgtacaggtaactgcctcagcctcccttgtttttccacaccactgtcccccatgatttaccctcaacactgcagtcagtgctcaaagtctgctacttctttgctccgaagtctccagtggtttcccatttagagcaaatttcttatctcccccacttcctcctctgtcctttcacacacatcaccgaagtgtaaatggtaaatttctacatacatccactttgcttataacacaccttttgtttcttgtatgattgcaaactgtaaggataggaagaatcgtaactttgcttcttgatagccatatttgctttccctagcagctttaacttaaaatg

SEQ ID NO: 38245 - DNA, 1030 bp, Homo sapiens
gataaccagtcttgtgacaatatacgtatacttctgtttatttccttgctggggttcgggtggggtagttattgttcaaccaaaaaagccagcgagtcagtcaggcattgattgatctcataaaatgatcccccagcagtgtcctgggtcctggtggaagaaacagcagcactaactcctttccatcacccacagggccgtaattctaaccagccctgtcagtaaggggcaaccatgaatcaaatcaagcctgttttggccaccctgtgggtacttggagactggctggtggataggactggtttttgtctggcctcaatcccggaggctttattttgtagtgatttccttagaaaaggatttgaaggtgtaggaaagcagtgtgtcttcaaggctttgcagacagactttacttcatcttcaggatgtttcctgcaagaggggtttcctgcaaaacccctagaggccagatgtgccccacaggactggaaccacttccaacctggagagttgtatgagtggatgtctgcactttgaatagttcttgcctgctttagactctaattttcttgtaaaagatttcttatctcccacagttttcttggtaaatggagtaacacataaggcacataagactctcagggacgtagtaaaatgcactatcacgtaacacgcaatgtcaattgaaaccctatccaatttaatgcagatatgtcagtgctgtccaaaagaacttcttgtgatgacagaaccgttctgtagctgtgttgtccattgacaggtggtcggattgtggccattgagtaactgaaatgtgaccagcatgactcaaggaccttaattttaaattttaattgagttaattataagtacttacatgtgactagtggctactgtattagacggtgcagattagaatgtggcatttggggattttttgggggtatatcataatgaacataaaaaggcattagtgattaaaagatccaaatattagaatttctttgtaaataaattaacataaattccc

SEQ ID NO: 38246 - DNA, 1159 bp, Homo sapiens
ggtaattttggagcctttcataaagatagcattccaaaaataagaatttgtaggaagactttactttttttaagtaggtatttatttggaaggaggtaagtggattttttttttttttggtcgggggccgggggtgaggggatggagtcttgcttgctctgttgcccaggctggagtgtaatggcgcaatctctgcccactgcaacctcagcctcctgggttcaagtgattctcccacctcagtctcccgagtagctgggattacaggcatgtgccaccatgcctggctaacttttatattttagtagagagagggtttcaccatgttggccaggctggtctcaaactcctgacctgaggtgatctgcccacgtcggcttccccaagtgctgagattacaagcgtgagccaccgtgcctggccgtcagtaagtgaattttttattgggaaaaagaaccttggaaggcatggtaagtatttattgactgtgtttctgggctttatttatgatttgtaattgaattgatagagggtatcaaaaatgtagactgtgaattggtttcctcctctcttcagtcagacacacagatgcatccgttagtttccatttcctcacttagagttttgtgtttttaatgctgttgtcgttctggctggctggaactcactggacggatggtgcatggatgttttggcaacagctgccaatttgtagccaaggaccagtattggaagcgcagatgtgggacattgtgtagccaacaccccccaagccccctttaagaaatataattttgaactcctttcagaatctttcagtcatttccaaagattcttgatgtgtgtggaatgaaatgtgggcccgactgtgaattcattgttaacaaaatatgttcacacaagtcataaaaacgtatttgtgaatcaaaataaaaaaatgtcaggtcacatggtctgatttacgtaagtttatttgtgggccatatttgaaatgaatgtctggggtataaagtgaccttcctctacgaaggggaacacctgtcccttctgtttttgctggaaactttcaggtctagctgtactagagatggtgcctactttatcattatcatttattattatttattattattattttcttctgaagacagtggcttat

SEQ ID NO: 38247 - DNA, 1050 bp, Homo sapiens
caacctctgcctcccaaagtgctgggattgtaggcgtgagccaccatgcctggccaagagactgaattttgtgtttgatttagttaatgtaaaattaaaaagccatgcgtggatagaggctatcagtgcagccatagaggcaggatacgcatgaaatggtggtgaaattcttcctgtgtatccctatgctctgttcttgcttttggcaggaagtctttctgggtattctttcagctatcctcatggtgtgttatgtagacaattctgacaaagttaaaaaaattgatattttactcaaatgccttttagtcttttgggcaatgttagaatatgtttgcccatggtatctgtgccactataatgagaagataataaactacagcctagcaatttattgctgagttcaaaattatctttgtctacctttgtcatttaccttatgtaggttttcccttagctccacgtaaataatgttggtagctccatctcatttccatcattgagtaattctcttgtgattgactctacttctgtgctgttgacacagccagtttccctgtgataccatgtaaattttaaaattgcctttcaccatattactaaagaaagtcatctgaattgtggaaaaattcaagatttcagaaaactgtaaaagattgccactggagagaataccataaatgatgttccatatttatcgttgcagcacttgggttatttctggtcttctccatgatgtatgaagcttttaaggaaaatgccaggaagaatatacacgaaattgttaacagtgattactggtatattgggacttggatgatttcactgcgtaaataagaggaggaggattctaggtagttttgacatttatttaaatgtttagtaacagaatgaggttacgttagcaggatataaaaggcacatattttgagaaagacgcaaaactgctttagttacagaaacaaaatcagcctccaaacaaaaaaacaaaaactgtaaaattgtaattaataaaggcccaagtatctagaaaacatcgtatgtctagat

SEQ ID NO: 38248 - DNA, 1048 bp, Homo sapiens
tgtgacctccaaggagcacatatgcataggtgctaatttgtaaatgaaaacgcatgctaatagttttctcaggtgctgagatgcagctacatatgattgatttaagcctgttttgagccacagaaatctgcatcccagggaaagtagagaagtaaataatttttgttgcggtgtactgtggtatgaatgtgccccccaaatttcatgtgttagaaacttgttccccaatgtagaggtgttggggtcatgagggctgcaccctcttgagtggattaatacctttatcgtgggagtggattcatacctttatcatgggagtggattccttatagaaggacaagataggcccccttttgtctctcttgccatatgttgccttctactctactatgttaggtaatggcatgaaggccatcaccatatgcctgtccatcagtctttaaaatggtgagaaataaatttctgttctttatatgttacgcagtgttaagcattctgtaatagaagcctcaaatggactaagagcgcaagtgtgctgcaaaagaaagatgcgtgaagtttgtggaacacaagcagagtgactagggaaattgcggcagcttcaatatggtcatgtgtgcacttcattttcccatatctgggagatgtaataagagcgagaaaaggaggagacccttttagtattgtgcttttctgggtaagtcagtcctctttgacgtcctaatagcatgatgtgagctgccagctgtgggtttctcagccaatctaatgcagggaaacaggcctgtacctgtttctgtgaacatggtagctgggtgcagtgcagttatagtaataacatgatgagcttcttgagtactgggcagtttgccttgggaggggacagcagctacttgagacctgccactcaggaagggccagagttttcgagattgtgactcttaataatcctcgagtggggccgaggtttgacaagtgaagggttctttgtgcttcttaacaggctgcttctagaaggctttgtgtgcttcagggcattctctttacc

SEQ ID NO: 38249 - DNA, 1058 bp, Homo sapiens
tcaattgcatcatacaggactggggatgtttttctccattcttttggggatatggggggaaaatttgacagtgctttctccctgatagttcttttctcttataattagcattaatggatgatactgtggctgacaataatgcaatatccatcatacccctgttttttaaattcttttaggccctaagagtttttccagtagccctcactctccagggtgtgtgtgtgtgtgtgtgtgtgtgtgtgtgtgtgtgtgtgtgtgtgtgtcaggagtagaatagggttgagaatatgtatgtgccagtgtactttactttccctggtttcacatgtttcagcttggcatgagacagtttatacccagtgggggaatctgcccgtaaaacacaggtacctccgtaagtctgtctccacccttcactgtgttcctaacagtttttttttttatttttattttttaaacgaagttttgttgtagatcagagaatgagagatgacattaaataatactgtagctgtcccttgatgcacagaattcatgcttctgtgatggacaattccatatactcctcaatcagtgacttatcttttaaaatggaatttgttgtatttttagcctgtggggttgtttagggtggtggtatctttcagagagtgttgcacatagatagattacgaggagccagttccctagaggagctgatggggagagagattttcagaaaattcttagaagggcaaatagggtcagctgtcatctttgtttattttaaccactgtgaaatgtggaagagaatgcattggtttttcattgtcatgacaacagaggctcttcacacccctgggcacaacaggaaatgaacccattcatttatccaagtgtgagtctcagaatcccattatgtgaattccatggagtgttaattcaagtattttgatagaatgttattgtgtattctccagcagtatttaatagttgcctaatcctactcaagtcactaaatacccttcttgatctgctgtttcctcatctatcagaaggagataagattttcatct

SEQ ID NO: 38250 - DNA, 1050 bp, Homo sapiens
tcatcttctaggttgaaaacaatccttttttcctgtgtccccatatgtagaagaaattgtgttctttcttacctctgacttcagggccagttccatcagagggacttactactattataaggttttactttgagagcaagttcctcagaattgcccttattcctcactggtcttctatttctaatctttcttccattttagcccctcactttctttcccagcacccagcaggtcacatcacatattcgtatttgccgaggagccattaaaacaaatccattcataatgttggttgttttctgcttttgttaaaaaattatcgtctatgggccgggcatggtggctcactcctgtaatcccagtgctatgggagatcaggtgggaagatcacttgaggtcaggagtttgagacaagcctcggcaatgtagcgagatcccgttcctacaaaaaatgaaaaaattatctgggtttggtggtgtgcacctgtagtcccagctacaggaggctgaggtgggaggatcacttgtggccaggaggtcgaggctgtagtgagtcatgatcacaccactgcattccagcctgggcgacagagtgatttcttgtctcaaacaatatcttatcctttgtagatatcaacaaagtctggatgctgaactgagcgtctagatattttctccattttagttctttgcaacataaactcaatcctcaccctaacataaactcaatcctcaccctttctctcaacatcttgagtgcaaggaatgtgatatttgcttcatgctgcttctctaatgtttgagtttttaaaaaaatcctcaacagatcctgttaagtggaagttaattccttatttctaatgtgcttcacatggatttttacctgattctctttgaatcttagaatatttttattggatcttactgctgtattttttttgttgctgtttgtttgtttgtttgtttgtttgtttttttgagacggagtcttgttctgtcgcccagcctggagtgcagtggcatgatctcggctcactgcaaccttcgcct

SEQ ID NO: 38251 - DNA, 1047 bp, Homo sapiens
cggtcccatcttcagggtcttcttttcctttgttgccttgctagcagatgtttcggctgactttctgtaatggtccttgtctggatttttctctttcaaggaggttaggccttctgaactgtattatttcaggtcatacactgcataattccaggatatcttataacttttgctggatgccaagtaaggactcctgtttcatacacatctaataatctaataatacacatcaggattccctcttgtgtttggatgaggtgcctttattagcatgggtaattggcaagataggggcgtctggttctgggaggcgcttggagacaggtaaaagtagaaggccagctttgtcagctttctctaaaaattatatttttcacatgtggatctttgccattgcagcaagagctttcgaaaagatcattcttcttatatttgcgcaactcctttctctgaagaacgcaaagcacttatatactttattcaaaatacttcagcaagtcctggagggcggataagaggaagcagccagctggtctgtagttcagggaattgaggcccaaacggggttggtgagcagaactagacatcaaaatcaagagtctgtgcatggagtgagggtattaaaaaccttgcgatcagtttctcatagggctgccttccttgagggtctcttccaggaaacttgtgtcagcatctaaatatgcgaacaaagcttttggggaacattgtttaggacaagctccctggaggtatagttgtgaattcccctaggaaagtgtatctctctgcctttcaaattgttacaggattgctattaaatatgtttctaaagtaacttcttttgcccatatctttttcatccctcattgggagcaaatcttaccttctcagggatgaggtgaccctaaatcaaaataatagcctttggatttaaagattttgcctgccgtggtgtgaaaacacttttctataggccgtttaactttcagagtatgtgtatacaaatcaatatatttgtctctgttcgttaatgtaaagctatttgta

SEQ ID NO: 38252 - DNA, 1070 bp, Homo sapiens
agccactcccagctgcaggagtgcgggaggaatgagagaggaagtggagcgtgctatgcactggacggtgtgttctctgattccctggggtgatgagggggcgggccactgtgctgggtgatagcgctgtattagtcctctcgtgttgctgaaatactacagactggggaattcataataaacagaaatgtactggctcctggttgtggagcctgggaagtccaatatcgaggaacctagtgagggccttgtgggtgcgttgatggggcagcaggagacccagtgagggaggggaagtccactccacgaagataccacgagtccattccgcctgcctagggcctcgggtttccttttcattaactggcttgcgtgtgcgtgttgcatgcacgtgcacacatctccatatgccagggataagtaactgggctgcatgcttcgtttcccctgcttctccagttccgtttcatcctggtgctcgacagctgcccagatccagctgaacttctcactggctggaccgtcagtggactctgtgcgcttgttttctctgttttctatccgctcacctcactgccagcccagcgttgccaggtcctctctgtggagagctatccctgataaagccatcaaaatgaatctcaccattcacacgctgtggagggaagagctggggagaaaccagcaaactgaaacatgcagcgtttccctgtctccgccaggtctcccggcagcacactcatcctgaggagactcgcccctccaagaagcaggggaggcagagtccgtggctctcctcttggcagctctcccagctgtcctggctctgaagcaaggcttggggtttcctcccttctccagcctgccagtgggtagcggggcacccggggcccagctggccgagctcagctaagttgaagtctctgctgagtttcccggcacagacttgtcctctgtggtcccagttctggattcactggaagggaagcgttctctgctccagccctcgtgagcctggtgggagtgtgtggctagtgggtttcggcagcattgggaattggctgttggtt

SEQ ID NO: 38253 - DNA, 1066 bp, Homo sapiens
taatgcccgatagtaacctctgcctcagcagtgttactataggtcattgcagactgttctaacagaaagcaggaaacagttcctcttgggttacttaaacttggtcagtttcttcagcctagtgtcagattacagtgtgcagccaagagctctgtttgacttcatgcagaatttttaaagtttttaagtttcttgaaaatgtaatttcatgaactcttctaaggctactgtaactgaattccaacccacagatatgttacacacgattggtgagtatagattgaatttatctctctacgttgtaaaacaccaccaacagtggtagacaactgaagcatgtggtctcatttttcaaacaaaatatgttctcccctggactgactctaatacttgattctcaagaatgagccaaactaggaaattgatatttaatatttattgaaaggcaggagacttcaatcttacagtggcatatcaaaaaattaaaaaggaaaacagctactttgaagacatagcaagctttggatctaagttctaatgtttttcataattctttggctgagaaatttgccatgcatatgaaaaatgtgattctaaaaattttaagtaatgatgaatgagcattatcctttaagagttttttacatgacatttgcttgtttgttttaccaaaggactgataaagactcattttgaaatacttatcatttgaatttgaaatttccactttgccttgtaatcgagctttaaaggttgaggcagacgtttaattttgtttctgaatgaagatggtatattgagttcttggtactcctgaaaatatcttgcaaaatattcaagtgattgcatgcttaaggatgttttagctgtctgtattaatcagaatagactttttaaaattattatttaaagccgatttgtgaaagctttgcgcttcactgtcataacttgcagtcgaatacaagatataacacaacatattggaattttcattgtgtagtcctattatgattttgtaattatttcaagatctctagatgcaacccagttttgatggcacaaaatt

SEQ ID NO: 38254 - DNA, 1039 bp, Homo sapiens
ttgtcactcaggctggcatgcagtagcatgatcatggctcactgcagcctcagcctccggtgttcaatcaatcctcccacctcagcctcctgagtagctgggactacaggctcgcaccacccaagcctggctagttttttctattttgtgtagagatggggtttcaccgtgttgcccaggctggtcttgaactgagctcaagcaatctgcctgcctcagcctcccacggtactgggattacaggtgtgagctaccacgccagcccatttgcacttttgagcccctgacatgttgggtggcaggactggctttaatgaaggcctgttagagagcagcagagatgtgtgtttgtgggtgggggaggggactttgttactttatgttccctttcaggtcaggcttagacagggaatctaatctatatttggcgtattggccggctgtgccagactaagtgccaagtgttgttcctgggaggctgaaatatttaaaatatttatctctgctagtgaacaactggcctgggttatgtgtgtgtgtctgggtggataaagttggggaagatcattttatttttcattcttagaattaacgatggcaaagagctagctcataaaaaggactggaaatgaggggaagcgtttactgttaaggctgcccttttccatgaagagctctgtgttttgtgtcctgctgataggttttggagtgccaagaaaaacccattgtgatctcagccgggtgcagagtgtagcagctagccccatgcctgttggaggatagaagagtaatttgagaccaaggaattgattgtttcaagcctgccaagccaaatgttacagagccattagccacacacagggttgctatgggtaggtcccttcagttctctttcagaatgtcactataaacgtgctccactgaagtagaacccagagtcatcaggaaggaggtggagaaagggacgtgccactgcgtaggttcgtgcacttccagcatctcatttctcctcactgatggctgtgtgaggcctgtgcag

SEQ ID NO: 38255 - DNA, 1031 bp, Homo sapiens
gtttgccataccatccttcctttgttttaggaataagcaagtatttttcttttttcctttttgttttttcattgtcagtattcaacataatgtgagcaagtattttttttttcttttttttttttgagacagagtcttgctttgtcacccatgctggagtgcagtggcatgatctcggctcactgcaacctctgtctcccaggtttaagtgatagtcctgcctcagcctcccgagtagctgggattataggcatacgccaccacacccaactaatttctgtagttttagtagagacagggtttcaccatgttcgccaggctggtcttgaactcctgaccctaggtgatctgcctgcctcagcctcccaaagtgctgggattacaggtgtgagccactgtgcctgtagcctgagcaagtatttttaagcaaaagaggcaggctgacagttcacaagttatccttcatgtcctgtgatgccatttgtacttaaatataatgttaactcttttggaaaaacaaaaaaaggactccttgtacattactgctttgaatacttgcacagaacaaacaaattacaagcccaaatgttgttgtttttaacaacctttcagcagctatgaatgtttatgtgtgaagatgcatgtatgtcttgattgctggagctacactgcttcccgagaacatgaaaggacactttgaacacttttggaaatataaacagtagcaggaagtagactgccatgtctgtcctaaggcatcatgtgaagttggattgctcttggttaaatgtacaaccattaaccatatacagttgtttggtctacgctgaccatttcacaagtgcacatacaaaagcaccctgtgagcggatgacgccataaatatgatttcctctttgcaatacgccatacagttgtattaactgtggatctcttggcccatcctgggaagagaaaggctgattttcttggggtcccagtggcacagggctcctgattcaggcctcatcacagaccacagtaataagaaa

SEQ ID NO: 38256 - DNA, 1038 bp, Homo sapiens
agccagcggtgttagacagcagcttctatggcagcagcaatgtgcagcagcagcaggggtaccataggaactgtgcccagagtagcagctcagggaccattctgccattatatttatattcacttttaattataggcaaattaagggggaagttattcagaaagttctagaaaagaggtgataacttccaggtcattgccatggaaaggggtagttagtaacttccaggtgttgccatggcagtggtcaactgacatggccctggtgggcatgtcttctggagaggtgctttcacctctttcccccattgcagcgagtcttcagtctggtttggcattcaagtcctgcccagccccagtcaagcctgcctcataccttaataagaatctataaatattttagagtatttcttttcttttcttttctttttttttttttttttgagttggagtttcgctcttgtcacccaggctggagttcagtggtggcatgatcttggctcactgcaacctctgcctttcgtgttcaagcgattctcctgcctcagcctcccgagtagctgggactacaggtgcgcgccaccacacctggctactttttgtactttttttaaaaatagaaatggggtttcaccatgttggccaggctggtctcgaaatcctaacctcaggtgatcctcccgccttggcctcccaaagtgctgggattacaggcatgagccaccacacctggccattttagagtattaaatctttctctccatcaatcaaaatagtagtagcttttaaagctgcctactttaatggtcagtattattttatttaccagaactttttcataatcaagaattcaaagctctctaaaataagggctagcaagttaatatacatttattgaacctgcgaggcggttgaacctgtgaggcggaggctgcagtgagcgtagatcacacactgcactcctgcactccagcctgggtgacagagcaagattccatctcaaaaaaaaaaaagaaagaaaaaagaagcttctccaacc

SEQ ID NO: 38257 - DNA, 1047 bp, Homo sapiens
actcaagttcttatgcttttcagtgctattttgtcattaagaaaacatctagatttgtgggcgtgggtggctcatgcctgtaatcacagcacttcgggaggctgaggcgagaagatggcttgaggccaggagtttgagaccagcctgggcaacatggtgagaccctgtctctaccaaacataaaaaaattatctgggcatcgtgctgcacacccatggtcccagctactacaagaagctgaggcaagaggatcacttgagcacaggagtttgaggctgctgtgagctgtgatcatgccactgcactccagccggggcaacagagcaagaccctgtctctttaaaggggaaaaaaatctagattttatttattttcttgcaatttaattggatagtaattggttttttgttgtggtttgcctcattttttttggttgcatggtaattatctataaatagattataaacttcttgatgatagagagcatattttatactttataaaaatattttcatgtggcagaaaatagtgacaaaatcagagaactctgaacttcctgtgatcctagaattgagagttaagccaaatatacaaaatctttgaagcctcaggtagattgggtgcttggtcttcaactccattccactctgatcctagggtgtcatcctgtactgcagatattagaaagcaaatacacacactcttccccaactccctacagcaggtttctaaacatccatccagcccagccaatctgatgcacttgcatgagatgtagaaggtgtaggttgactttcgcttcccttctgctgcctctgttgagagcacacaatgctggaggtgtttggttcttctgcagcagggttcgtgaaagttgcagggtttagtcagtaaccacaagtcaagaaggaggccgtaaggcatgcatgttgctggtgcacgtggttctgtatgtggcatgattctggagctggcagtagtagtaatggcgtcctgattgtagcaacgataatggggtctggagccagaaatgtccaattcccaatg

SEQ ID NO: 38258 - DNA, 1051 bp, Homo sapiens
gtgagaagagtttcagggcaagctgtataagaggttatgtgacattaaataggaagtttgtagtaacctactttttatgcaacatggctctgcctgttattgaaaagcatcttactttagctgcttgaccactgagaatctataagaatgacctcagggtcaaatatatgtaagaaaattgggtgattcatattgcaacagtgactacttctttgcgtacctgcccctcagtatgaggtagaagaatctccgtccctgtttttagcttaggattatttaagagacctcctggcttgatgcatacctggccagaaagggaatgaatgactgttgtgcactgaatgcatatccctgcatcataagtccagtttctgaagctaagtttgttatgacctcttggacaacagatcccaccagtaaatgtggttaaatgtctttagcttattcagccatggcagaaggtaatggtgtcgagttttttgtgtttaatgtcatacactcatcatctaaggccggtaacaacttgggacaacataaaaaaatgaggttgattcaagtcacagagagaaagtttaaatggagagagcctgaactatgttgctgatttcttttcttttctttctctctgatggagtctcactctgactcccaggctggagtgcagtggcacgatctcggctcactgcaagctccgcctcctgggttcaagcgattcttctacctcagcctcctgagtagctgggattacaggtgcctgccaccacacccagctaatttttgtatttttagtagagacggtgttttgctgtgttggccaggctggtctcaaactcctgatctcaggtgatctgcccgcctcagcttcccaaagtgctgggattacaggggtgagccaccgtgcccagctgctgatttcttaatctgtggcaaggactactagttgcctttccaaattccattttcaacttttcctttagcaacagaacattagcttagttaaaggctatactcagcctcctttgcggtcaagctgatgtaagtcaaagtgttg

SEQ ID NO: 38259 - DNA, 1027 bp, Homo sapiens
tttagatttttattttccctgagcacatttaatgcacgggtagctggggagaatcagtgggggataaaaacccaacctgatttcccaggctatcaattctgtctacttgacagtgatttctcccttccctagagtgttttataggttctgttagttgcaacccttttttcaaagtcttagaatactaacctttaattttattttagaatgcatactataaagattgtgatttatggatcaatgtctcatattcatgaatagcactagctcatggtattaatggggaaaggcagatgaaatggaaaggagccggagggtaggctgtggtggggcacactgtgaggggcagaacttgggaagcggcccaggcgctgaagtcttaccatgtgctccagcagtatggacattcacccttcgcttcagtgtctttgatatgttggcatgatttcctattaagaagacccaaatcatttcaaatgactggtgatgtgtgtgagagtttgcagaactgtatgtgtctatggctgtggagaaagaatgggggggaactcacttcattaatattttacagtaacaactacttctgaaaggttttaaatgtaactcgtgaaaagcaccaactttcgtacataacattttctcctttcgagattgctaatttgtggtgcagtttgctataagatcatcttgttttgcactctatcaatttaattctgttcttttatttaaattgctctggttcctccctgtccttcaacaatcattattattagtagcctaaccacaggtatatatctaatgttgtctactctaattaaaatacacaattgttttcatgtttgagtgttcatgcatctcatataatttattcctttggagtctatccagtttgcaaaacagacaaaattttgaatgattaagggctgaataaaatattttcttgccattgcaaattcaattatgttttgtactttgcactggataacaacttaagtttcctaaaaaggcaaaaaatttcaacacatca

SEQ ID NO: 38260 - DNA, 1239 bp, Homo sapiens
gtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtag

SEQ ID NO: 38261 - DNA, 1224 bp, Homo sapiens
gtgccacaaaaacctttcatcattttcacttcttcctctgtaatatgaaaacgagacaaattcatcaggttgatttttggggatcgatgctgtcagggctcgcagagacgagccatcagatgttatttattacatgctttaccccgtctcctagctgctgtgagaaagcccacagtttgcaacctcacaaagcaaagagccagctggaaagtactgtgcatccagacaggtcacatagtcatgtcctgaaccaagatagctctttttgccatgatttcctacactctctgatttttctcattaaaaaaaaaaaatcttgaatttattttcttaagctctagcattctaaagtttaaacatatgagcctttgaatactcctgtctaggaaagagccgtgtaaattctaagtatctctataattgacttttgatatgttacttgtgtttaaacccaatttgcaacaccccttttgttggctaattttgtcgctatgttgggtagcagaacttgtgacgatcacactaataacataaagtttcccacctttcttgttgctgttttccttgttagcatctcagacttcccaattctgggaatagtctctaggaggcaaggttttcagctttggaaatgcatgcgtgacacagtagtgtggtatggaaggcgtgtggacttgaagatccggctccagaaacacgctctgccaattaccgtgtgtgaccttttataaattacatccatgagctgtagttacctaaaatagtgatcctctctccttcactggctggaaggattaaatgagatagtgtttataggaaatgtactttgtgttccttagttgcctccccccgccactccccgtggtaggaactcttgagtacttgtcaaatctgaactctcggcatttttacctccttcagggaaaactattggacaggctcttactgaacacccgcttttgtgcagaatgcacttcctgatactctgggagtttcagaggctactaaggtgtccttctggccctcaaggagttcatctggagacagggagacgacacattttcttcaataactaagaaaagaaagggcaatgaagaccataaggaaataacagtgaagtttcttaggcatccaaacttgatggaggggacaaaggaggcttcaggaagttttaaactagaacaggacttcagcgctcttaacattttggtcagatacttctcc

SEQ ID NO: 38262 - DNA, 1038 bp, Homo sapiens
tcggtgggcatttcctctctctttctgtctacctacagccaaaacaagttctggttacagtgacagttttaagtttgccatttgtggttggttctattatagaggctgggggaggaaggcaagcagtcctcacttcttgcttcctgccttgctctagagtgtaaggatcagcttctctaatcccttgacttttcactgctctatgtagtcagggtagacaaggggtggccctcaaacaacagccacctctggaggtctagcgtgactaaaccactgtcttcttttccaaatccagcactggggaccgacgtgtgggcctcccatctgacttgtggagtgaaagaaatgggaatagagcagcgctgtccatatagtcgagttttgtaaatatttgtcagatggaactagagatgcattatcacattcgacagtaacaagtggcaagtgttgagctcttttaagtcttgctttttatttcttataatatgcaaataactgttaaaatggccagccagttggctgtctgttttagctaaggtaggtctcttgcaatttttgcaccctagggagatctcaataggagtaggtctagccctaaactgtgcaggattaggaattctgatttactgatctggagggcggctttgtgttaatcagagttctaaaggcggacaaactagactgtgaacttaatacttaccctgagaagtataactgccaagtggacagttgcagaaattggttattgcctgtgttctcgatcagaaggttattagctgtgtcagagtaaaggcattgaatgatcccattagtaccttccagctgtggtctcctctctagagcgtacctgcaggggagggagtactgctagccacttatggagcatatggacactgtcattcacccacccaggtgtccagttccatgactctggtgtgaaacactgaatttgtttgttacctttttttttttgtaagaaaatacttgtttttagtacctgcttattatttttttaaaataaaaaatatataaggaagt

SEQ ID NO: 38263 - DNA, 1200 bp, Homo sapiens
tcattctgttgcccaggctggagtgcagtggtgcagtcttggctctctgcgacctctgcttcccgggctcaagtgattcttcctcctcagcctactgagtagctgggactagtggcgcatgccatcacacccggctactttttgtattttttgtagagatgaggttttaccatgttgcccagcctgcctccttattttacttgtatgttttttaaattattgctgctgctaccaccaccaccgctactattactgctactgactaatgtttattgaatgtttttatgtgtcagggatagttttaagcacgttatatgaaatcactaatttaaaccttaacatctctataaagtgggtgtgattattgtccacattttacagatgatgaaaaagacgaattagtaaatttaagtatctgccctaatttgcatttctgtgagtagcctctttgaattctttatcatttttgtgcccaaggctatttatagttttcttactgaattattggaacttttaatgaactatagataatgggctttctctggtgtgtgtgtgtgtgtgtgtgtgtgtatagtaaatacaggcatacctcagagatattgcaggtctgattccagagcacagcaataaagcaaatgtcacaataaagcaagtcatatggagtctttggtttcccagtgcatataaagtttacactgtactgtagtctattcagtgggcaacagcattatatcaaaaaccaacgtacatattcttaacttaaaaatactatattgctacaaaatgccaacaatcccctgagccttcagcgagtcatctttttgctggtggagggttttgccttcacactgaagactgttgctgtttagggaagaagtcattgaatgctggggcagctgtggcaatttcttcacataagaaaaaatcaagttttccacattgattgactcttcctttcataaaagatttctctgtagtatgtgatactatttgatagcatttttcccacactagaccttctttcaaaatcagagtaatccttcccaaactgtcctgctgctttatcaactaaatttatgcaatatcccaaatcctttgttgtcatttcaacattgttcacagtcatcttccatctcaagaaatcgctttatttgcttatccgtaagaagcaactcctcatctattcaagtttgaacatga

SEQ ID NO: 38264 - DNA, 2154 bp, Homo sapiens
tgcaatagtgacatcaaagatcactgatcacggatcaccacaacagacataatagtaatgaaaaagtttgaaatattacgagaattaccaaaatttgacagagatatgtagtaagcactgttggaaaaatggtgctgatagactagcttgatgcagggttgtcacaaaccttcagtttgtaaaacactgcagtatccgtggagcacaatgaaatgtggtatccctgtattgttttgcccaagcctattatgtttcttttgatttttctatgatgtatttctttctacatatgtttatttagtttttataatgtcatgtgtcacttaacgatggggatatagtctgagaaatgtgtcattaggaaatttcatcattttgcagacatcatagagagtacttacacaaacctcatggtatagcctactataccccaaggttctatggtctagcctcttgctcctaggctacaaacctgtactgtatgttactgggctgaatactgtaggcaacttaaacacagtggtatgtatccaaacatagcaacagtatagtaaaaatacagtcttataatcttatgggaccactggaatatatacagtctgctgtcgactgaaagcatcattgtttggcagatgactacatgtgacattacagtgctttttttttgagaccaagtcttgctcttgtcgcccaggttggagtgcaatggcacgatctcggctcactgcaacctctgcctcctgggttcaaccgattctcctgcctcagcctcccaagtaactgggattacaggcgcccaccaccacacccagctaatttttgtatttttagtagagacagggttttgccatgttggccaggctggtctcgaactcctcacgtcgtgatctgcctgcctcggcctcccaaagtgctgggattacaggtgtgagccaccacacccggccattacagtgctttttttgagacagagtttcgctcttgttgcccaggctggagtgcaatggcctgatcttggctcactgcaacctctgcctcccgagttcaaccgattctcctgcctcagcctcccgagtagctgggattacaggtacctgccaccatgcccggctaattttttgtattgttagtagagatggggtttcaccatgttggtcaggctggtctcgaactcctgacctcaggtgatccacccacctcggcctcccaaagtgctgggattacaggtgtgagccactgcacacagccgaaattacagcttttacagtttgagtttggtggcttgctttgggaaggcctttcctaatctgcaaaccataacaatattctatatattttttctcctggcttcataattttattattttgatctttaacctcagtggaagggtgtgtgtgtgtgtgtgtgtgtgtgtgtgtgtgtgtgtgttttaaaggtgtgactttatttttcctaaacgaatagccagttaaactagtgccatttattggatggttccgctttccccacgcatgcacttgaaatgcccttttctcagagagacacagagagagtgtgtgtatgtgtgtgtgtgtgtgtgtgtgtgtgtacatgcatacatgcatgtatgtgctgtgtgcatgtgtgtctgtgttgttctgtctctgaactttctactctgctccattgatacctttatccctttgtaaagaagcagcacactgttttgaatacagtagctttgtgatatgatttgctatagataaggaaaatctgcttcctgttacatacttttttttttcattaaaattacagtttttatgttcatgcttacttgcatttttacaaattgagcttcttctcccccatccactgtgagtttagggttataagaaaaaaaactctctgcacttattagatagtctactgcactgggaatagcagtaagctgtttacattttttctttcatctgatacaacaaaccttgagagttggtgccaatatcctcatctgtagatgaggaaagtgaggctcagtgatgaagcagtttgtccaaggctgcatttctggacattggcagaaccagggttccagaccaagtccaggaaatttcgaaacctctcttaaccattatgcaacccagacacgtggggttttctcacatgacgagggc

SEQ ID NO: 38265 - DNA, 2021 bp, Homo sapiens
gagagaaattatttacccagtgcttttttttaatgccagacactgtaacccttcctcggctcttttctagagttgggtctgtggtttggaatacaaaggtgaggaatacacagccctggacattcagaatggggcagtaggctgggaggagctgtgcgcacaaccccaggaaccttctactttttttttttttttttttgagacaaagtctcgctctgtcacccaggctggagtgcagtggcacgatcttggctcactgcaaactctgcctcctgggttcaaccgattcttctgcctcagccgcctgagtagccaggactacaggcgtacgccacaatgcctggctaatttttgtatttttagtagagacggggtttcaccatgtcggccaggctggtcttgaactcctgaccctaggtgatctgcccgcccgccccgcctcggcctcccaaagtgctgggattacaggcgtgagccactgcgcccggccccttctaccttttagaagaaaatgcaacaacgtgtcttagctctctagtggaggaacagaggtctcaggtggatccagaaatgctttgctatagagtggcatttaaactgggacattcatgtgtctaaattacctaacagtttgagccctcccttcccccgaggtggttgcttcttcatttgaattctctcaggtgccttctgttggttcttagaggtgaacatcagaaaagtaattttctttggagaagtttgaagcagcctcccaaacagaagtcctgttgagctcccactgggagttttggaaaagtaatctcatttattaggaatagtgtattgattttgtgtgtaaaatggactaagaggcctgtgacaatgagtccatttgaaattgcaaatttaaatatctaatacaatagttgtgcggaaatactacaccagaatataaatgattagctgcttagtgaatttctcatgtgcatgtaattaattggcagtggtggtggggatcaagtttgttttcatatcctgagtcctttaatttaccttttcttcaacaattactggtgtaagtataggggaattaaatcttagtgtcttttataaaaatatatagttttgctttgtcattcatttattgttttttggtctacattatccaattttgtattacacaatagaaggcacctaatcaaagatttcttgtttttactgcatgattgcactcttaattttgtgaaagcataggtttacttccagactgagaggtaaatgaataattattttgtgatttatttagcacttgccgccccaatcttgtttttcacgtctgcagttatggctgaaatatcttattccattcccagcctctctgttggtggtatctgcctgatctccacctagtgtcattgtgggatcgtggccacacatgggccttccagggctgtgctgttggtgaccagtggtgcttgtaaccctgaagtgttggcatggcctcagctgactgggctttccctcatgcccagggcttaaacttgaactctgcctgctctgttagcagtttttctctacatttcttttaaaatagactttcacttcttccttcccatcccccccaatacaactgccctggcatcctggctttttccattcttgacaaatgatctgtccactgtaactgtagctccactgtgctgatatctgttgaaattagacctagaatctaaatgtggctccatgaaactatgggtgagacattttttttcttcaaatagtctatggtttattggcaccccaaaccacctatccataccttctccactgtgatgctgggggaagaaaatggggtaatatatgtgtaaaagtgactgagaatgaaaagttctgcataaggtacaatgttagctggggtttttgcatatataataagaagacaaatgttcactaccactcctgcctgccttccctgggcatatcgaactgattccagcctaatagcatttcttatcatataatgggaatcacaaaccctc

SEQ ID NO: 38266 - DNA, 1831 bp, Homo sapiens
tccacctgcctcggcctcccaaagtgctgggattacagacgtgagccaccacgcccagcccccaagcttcctcatctaacatgggacggttaatgacttacctctcagggttgactgggaagggagcggctgaatgagaaccaatgttgggaatgtagacagggtcagaaaggttagccctctgatacgtgctaagcaaagattagagttggtgctgaaaacaggtctcttgcctaaatcttggattagtacacaacttccacatataaagagttaggggcatctttaggtagataaatctattttaattgttccgtaaatatatttagaagaattttggtcaacatggatttggtgcaaatttcgttgcagctttttttcccccttttgttattctaagctgccctacaatgatatttttagaaatttctgggaactcaagactgtcattgccagggcagagccaaaacaccagaggttctcgtagaccagtggttctcaactggggaatgttctgcccctcatgtgacctttggcaatgtctggagacatttttgattttcgtaactgggagtgggagatgctattggcatctagtgcgtagaggccagggatactgttaaacatactataacatatgtgacagcctccccacaacaaagaattatccagcccaaaatgtcactagtgccaaggttaacaagtcttgctctcagataattctttgcctatcacaggcattctttgtccccagctacagtgtcatataagccatctcaaacaagggtatattcgttgtcccccttatccacggtgttgcttttcgtgctttcagttacctaaggtccaaaaatattacatgaaaaattccagaaataaacaattcataagttttaaattgcactcggttctgagtagcatcattaaataccacctgggacttgagtcatcccctttgtccggtgtattcgcactatgttacactattccccaaccctcattccttactgtataggaaaaaacagtatgtatagggtttggtactatctgaggtttcaggcctgcagtaggggtcttggaatgtatcctcggaggatgaggagagactaccgtattttttccggaaagtctaggaccatttctcaaactaagagaaggacaaagttggagaggaaactgtttctgttctgcatagtttgagatatgtacaattttgagacccaatccaatttttttccaaccactttcttgtgtgttttttttttcagtatcttaacccacattgatgttttatcttctgtaagcactaaacagtggcaagttacacaaataaaatgtgtgcttactacattttaattgctcttttttatgcaaataataatagatggtttttttgttcttacacattgattcctgggggaattttaatattttattaaatattaaataaaatgccctatttttttcctttcaaattgaaccaccctagttataatgagccatcagttctaaaatgaatcctctctgttaaaatggcagcttgttctaactaatcatgctttgagtattctgctgtagttaatcaaagttaaaataggaggttatattttaaatataaattctacttttaaattctaaatttgctatttttccattctggaatattatgatagggttaccagataaaatacacgatgccaagttcaatttgaatttcagataaacaacaaataacttttttagtataagtaggtcccatgcaatattggggatatagatattttttaaatttgttgtttgtttgaaattctaatttaacttacttaatgct

SEQ ID NO: 38267 - DNA, 1056 bp, Homo sapiens
tatggaacagcttctgccctgaaattttctgattgagagatggatgtggtctggagtatgtgaaaatgggatagatggagggaaggttaggggagaggtgaacagggcctcttccagggtcttgtggaagaccctgttcgacgtttcctcacgtagactgtctgatgaggctcttccagggtgtggtatggccagggtgtgttaaatgtagggagcacaaggcaagaaagggctgcaccaagctgcttcctgcctcagggcctttgcacttgctgtcccatctgcctggaatggccttgcctcacatcttcatatgaccttggctccttgtcatctattgactcacctgtcacttcagaaaagcccttgctaccatctggtctgccagtcactctttatcctattttcatgttttattaacattcatcaccatctgcagttagactcttttgtttgcctagtgcccacaatgttgcccgacgctcactaggtgctctgtgaatatttgctaaatgaatgaagaacttgaaggaagctggcagtgggtggactcgctgagattaaggggcatggaagattactcaaggcagcctcagcccctttctaatgttttgttttgtttttaaattcagactctgtggactcagttcaattcacacaattgccaagtgcctgtctgtgtcgtgcattatgctagttagatcccaggaatcaaatgaattagacctgaaggagattacagaccagttctatggttcaggttgttaatgtgggcccctggatagaattctagatattacttaatttttttgtgtgactaccctctaactgaaatttagcgttttcttctagtatgaacgtaggcactaaaccacagtagaactggcagtgtgtttgactgtcacccatagaaatagatattttcatatcacattacacttgttgcagctgtcttgaaatattgtttatgctcatcatgacttcaaaattacagtaatttttgacctgctgctggatctttttatttcacgcactaacacagaagaacatagatta

SEQ ID NO: 38268 - DNA, 1347 bp, Homo sapiens
tatcactccttaaaatcatgttaatgaagattcctatcaaatgtggtccccaccccctgctctgggtttactgcttccctgtgaatcttctccacacttttgttaattttgggatggaagtttgagagagatacttttttcatagataggttggaagtgatgctcaccttatcaggactgtaagaggatattgcaagctttgatgattgagcagaaaaatctttgcacagctggtcagaacaagcttgtcctgccttgtgggagggacagagttttccaaatgatcttttggttaagaccttaattaaaaacagcctaaattcacttgtggcaagaatttattaaaggaagataaccatgagcaaatccacgttgtggtataagaaaagggagcaccatcgttaaaaaagtcagaggcttgaattctggtgaacttagcacaaagaagcaagaaaactttagactggtttcttaacagtttgctatctgtataactaggggtgaattgatctcaaagacctaagaatctgtggacttaaagacactgatttgtggcataattcgaggtagtttaaactggaatatcaaggtgtcagaagaaaaatgtacaagtaatacatctcagtttcttttctcctacgccacttaaatcttagacccaccgaaagctctaaatgtatcagtggatttttcattatttccaaaaatattctgcttgctctttctgaataaactatagagagaaacacaggtttctcttcaggtgccttattaagtttaactgttgtatagtacagctttgcttctttgtttcatttaggaccagaaggggtccaggtagctgaatatcccttccttgccctgacatccccattcactgcagcaagctttataatgcctgtggtcatccttggtatgaatgagcactggagaccccaccatgggcagtactaagcagaatcaggcttctgttcatcagaatgaacaaaggcacacgcataaaatgagagcgtggcagatggagaggggtggggagcctagagggtgactggctgcaggcctcagcagtggagacaagggcacaggaacatggcgccagggccgacagatttggcgtcagccgtggatgctctgcatagcacccatctgtaaatgggtgtggtcctggacaagtgaggtcctgctggattatttaagaatattttatggtgagttgtatttgttctttccagcaacagctctttgaagtagtttagtggtatatccattttacagtcagcacttcagactcaagtttggtgatcacatgccccaagtctccaactcctgggctcaagcaatcttcct

SEQ ID NO: 38269 - DNA, 1058 bp, Homo sapiens
gcccgtgggccggaggttggacaagcttgttctagacgttcttcctctgtctctctatgttagatgctttcccacgttagcagtccttttcccctcctctcttaaatgaccaagcaggactaggaaagcataaaggcaatgagaacacgctgcctgggatttaagcccttgaattccaataaggttctaatatggacttctactaaagcataatggttaattccatttagagagtggggaacatctttcatactttttaaaacatcaggccaggtgcagaggctcatacctgtaatcccagtgctgtgggaggctgaggtgggaggatcacctgaagccaggagtttgaaaccagcctgggcagcacagtgagaccccatctccacgagaatgttaaaaattagccaggtgtggtggcatgtacctgtaatcccagctatttgggaggctgaagtatgaggatcccttgagcccaggagttcaaggctgcagtggttgcagtaagctgtgattgtgctgctgcactccagcttgggcgcagagtaagactcagtctcttaaaaatttaaagtcattattcccaggtggagtgtactactgagaaatagaagtcccttggttggacctagcttataagaaacttcaaagcagtcattgccaactacaggtgatgattggtaatttgagcaaaatttgatagcttttgaaatggcatcaatttaaaagaagtagtttttgtttcttgatccggggcaaggctattattctggtttccaataccctttatccatctgaagagcatcaaaattggcgggtgccaatcaagtttggaaatggaactgagcagcatagtaacctatagaaaattcatgaatatagaaaattcaagatcatacattaaagaattgtcttttttttttcaaaaaaattttttttctaaaaatgtagtgttatattaaaatgtagtgaatattataataattctaaaaatgtagtgtttatattgttttcctgcttaagttaggccaaagttggtaaaatgcattttagaaccctat

SEQ ID NO: 38270 - DNA, 1027 bp, Homo sapiens
tagcattgataccccctctacatttgtttataaaacagtggtacatcttgtaatcagtagcttcttagaactgaggaattcgttttgtcatcactctgaagggcagtttagccagtacagtaagtcttcactccataggttcttggaaattgcaattttaaatgaatgagatatcatgaaagcaatttgaccataggctaattgatatacataagacttaagttccttccaaaatacgtacaatgttaaacactgaaataaaggtaagctatacatacatttaagaaagattaatttaaaaacaagtaagatgattatttaatcagttattccagctcggggtttctggtggatggagcctgtcccagcagctcagggtgcaaggcagggcaccagccctggacaggatgccatcccatcacagagcacattcgtacacagccagagtcactcagactgggacagtgtagacatgccactttgcctcatgtgcacagctttggggtgtgggaggaaccctgaggacccagagaaaacccacgcggatgtggggaaaacgtggaaactccaccgatagtggccatggccaggaatccttttttttttcctcattaatgttataacaaaatgacattgaatgaaatgttattcaaggacctgctgtagttacaaattggttattagacgggttgaagtctctgcttggccactttctagctgacgttaagtttctcatctgacttaaaagtccaggaaagacgaaatgatattatttagcacagcagcctgacttatagtagagcatcagtacatattacctatagttgttttcatgaaactatttcaccagaagtttagggatttatcctcaaaggcattaggagtgcctacacggcacataagggcattgttttgtatcataccacaagtagcacttaaggttggaatcattgctgaccccaatgtaaaatgcctctttctggaccagaaaatggaaagtgaaatttgcaattcatcccatgttatt

SEQ ID NO: 38271 - DNA, 1487 bp, Homo sapiens
gctctttttggtttggttgttatgagcgctctcaatgcaaagcttagaaacctctccagagaaataatcagctctccaaggagtgctcttgcagactagcatgttgccttgcttgctggtgtgtatcttcctataaattcctggtatccagtgtccatacaggagaaattggctgacttgttttcttgctgtgttgtatgacagataatcagaaatgtaactctggtgccttgtcatgtgcccagaggaagttaaatgtgcttgcctttaatatgtatatgtatacacacacacacacacacagcagttagaaaatagatgtttgtaaaatatgatttttttagggaatatgtaaaaactggcatctcttcagatagacatagaggtacttaaaaaccttggttaatatgtcttgtttgtatactccatgtggtgtattttacacagtatctaaaggtgttgcctgattttgaattagttaaaagacaggttagagacgtgggagaagagtatgttgtatttcttgtctgatctgaggaattttatattcctgaagtctataattaggtgcttgtgttgattgtttattgaaacaaagctgaaggtgggggtgaggggagtgccacatagtggaaaacactctatggcaaacatctgagctttacttaaaagcatgggctgcaaagaaatgtaaattcattggcttaattggaagagagtatttatagaaattgaatgatccagtaaaactaaaagcctggcttctttcatcttcagagacctgccttagtaaatgctgttctggaaatcccttgcctgcaaagtggactttgccatccaatttctggcctcctggcagtcagtcactttgacctaaccctattgcttgactcgtatttactacgtactttccttttttggcttagggttgtactgaaaatgtacatgtaaagaaaaaaatgtccatgtacactgaagttttctgattttttatatagctccataatttgatttcaataactattacaaagaaacttttataagaagatacaatttgaaaatcttgctgtgcagcctcttcccatctactctgcctgcctactacgccttttatagttcaccatatccattaggttctcgaaaattcttccactgtttatgcaaatctttaaatttttaaatacttttattttccttcttagaaaaggtgacaactagatgctattctgcaccttgtttttacatggaatcatataccttaataagcttttcagacactctttcaatcttctgctattatgaagttgcagtgaataaccttgtatatcacttcatacatgtgcaggtatatctgtagggtaatttcctataaggggatcaggatttgggccagcagatatgtgcatatgtatttgtgatcgtgtggctagcccctcctttttttaacttttattttaagtttaggggtacatctgcaggtttgttat

SEQ ID NO: 38272 - DNA, 1054 bp, Homo sapiens
ttgtgtcatctctgatttctttgaagagtgtttttaattcttgttgtagagatctttctagtgtattcctaggtgttttattctttttgtggcagttgtgaatgggattatgtttctgatttggctcttggcttaactgttggtatatgggaatgctagtggtttttgtatgttgcttttgtatcctgagacttcgctgaatttatgtatcagcttaaggagcttttgggctgagactatggggttttctagatatagaatcatgttgtctgcaaacagagggtagtttgacttcctctctttttatttggaggcactttatttctttctcttgactgattgctctggccagggcttccaatattatgttgaataggagtggtgagagagggcatccttgtcttttgccagttttcaaggggaatgcttccagcttttgcccattcagtattatgttggctgtggatttgtcatcgatggctcttaatattttgaggtatgttcattcaatatgtagtttactgagaatttttaacatgaagcagtgttgaattttattgaaagccttttcagcatctattgagataatcatgtgttttttgtctttagttgtttatgtgatgaatcacatttattgctttgcctgtgttgaaccaaccttgcatcccagggataaagcctacttgatcatgatgggtaagctttttgatgtgctagtgggtttgttttgccagtattttattgaggatttttgcatagatgttcatcaaggatattggccttattttttcattgtgtctctgccaggtttcggtataaggaggatgctagcctcatagaatgagttggggaagaatccctcctcctcaattttttggactagttacagtgggaatggtaccagctctttgtacgtctggtagaatttggatttggctgtaaatctgtctggtcctgggcttttcttggttggtaggctatttattgctgattcaatttcagagttcattattggtctcttcagggattctgtttctttctggttcactcttgg

SEQ ID NO: 38273 - DNA, 1069 bp, Homo sapiens
ctttttgagaagaagtcttactctgttgcccaggctggagtacagtggtcccatcttggctcactgcaccctccgcaccccaggttcaagcgattctcccgtctcggcctcccaagtagctgggattacaaaagcacaccatcatccctagcttattttttcttttttttttttttttttttagtagagatggggtttcaccatgttggccaggctgctcgatctcttgacctcaggtaatccgaccacctcggcctcccaaagtggtgggattacaggtgtcaaccactgcacctagcccgttctctctttaatctcccaattaacgaacatctactgcgacagcatccattacctagaattgtaggaaggtatataggatagacgtagcaaagaggtaagtgggtaagaaaataaacactcataaaaaggagacaaactgtcagagtggtcccctagctacacctgccacaattgcctcctgagaagtccttgttctgcacgagctaaaattcccattcaaataaattgttgctcttcctataatcattgagctgctgaatagagccagggtccttgatagacgtcatagtttgttattgactttatcaccagtaaaagttaatactgtcatccctttcctgcagcaacacactaccatttttttttccaaaattaatttaggtaaagaacatttttcttagtataattttcattgaattcagtattatcaagtttgtatatttttagagcttttggatcgctattccagcccacatttttcatagcaatttgtctagtatttcttcaagatctttttatgttcatttgaaaaatgaacatgacttcatatgtattcattagcaatcactgccgtaggcctttctgtttgatttttcttctgaacctcagagatagtggctcattatgaagtagaaaaaggctaactaagaccttgttctgaacttacagtgggtaagcaagaggcttcagatccataatctctatcaaaatgtttgcccacattactgtaacagggagtcattcagaatgagagtggaggaatttg

SEQ ID NO: 38274 - DNA, 1100 bp, Homo sapiens
caccagcagtcagcttctgctctacgccctgtggccttgggcaaccttgctggctcccatttagcacgtccaattaatattgctcaaagggtggatttgcatgccttctgttttacagtactatgtagggggagcatttcccactcagatgtaatgtccattgcatgataaagagacacagctatttcttatgaagtgtgttcaaatataccacctctctctaaacttttaccttagttccatcaacccttactttcctaactgtagccttcattaggcctttaccaacaggtttcggtcgtacaattcagtactagctaggggaagtgttccctggacagacataatatccattcctataaatcatttaggtaaagaggcacaacttccttatataaagcctacttaaacatcccagctttgatcatcctagcaatccttacatttttatgttctcacaatcttaactgtagcccaagtcagggcttgcccagtgggttttgatagcacagtgcttaaggctcccatatcgaggagtcccaggaattattcttcacctcccagacgattttcccacttgtgtccataaggctgtgggtacccagcaggggactgggccaagacacctttgctgtctgtcagtctttttcttgattaatctgcctgactattgccccaggcaatttcagatcagatccttcattgtaatctctgcctctgactttttaaatttctccaaactagggtaaatgtagcaaacatttttcaaacccctttatgtcgagagaccagcaggacttccctttgatctatccagccttccacagtgttgcattaaaacatttgttttaacctcattttatttcagtttccattttattcatcccaattttttttattttccataggttattggggaacaggtggtatttggttacatgagtaagttctttagtggtgatttgtgagattttggtgcactcatcactcgagcagtgtacactgcacccaatttgtagtcttttatccctcactcccctgcgtccccaaagtccattgtgtcattcttatgcctttgcatcctcatagcttagctccca

SEQ ID NO: 38275 - DNA, 1079 bp, Homo sapiens
catttcttaatagccatctaaagatttccaccatactgggaaaagtcccatgactcttctctttgtttttcctctgtttcatccctatcggtgtgttctttttttttttttttgagacggagtctggctctgtcgcccaggctcgagtgcagtggcgcaatctctgctcactgcaatctccgcctgccgggttcaagcagttctctgcctcagcctcccaagtagctgggatttcagctgcctgccaccacgcccagccaatttttgtatttttggtagagatggggtttcaccgtcttggccaggctggtcttgagctcctgacctcgtgacccacctgccttggcctcccaaagtgctgggattacaggtgtgaacaaccgcgcccggcccagtgtgttcttattcaccttatttcttaacaaccataaaaaatttccaccttcctgtgaggagtcctgtgactcttcccccctacccttcatcattctcttgttaattaacctaatgtttgtattagcatctgtaagactcatgaggggaaactgagcaagtacatctcataaggcttcttgaactatctctcgattttgtggcaacaaggttaaatggggcatccacattaaaggggcgcccctaatcgcatcatttaccatgacttgggtagcaaggcatattcagtgcttgaataatctggtggtcataaacccaggccccacatggcatgaatacaaagtgtatcagctgtttcagcttgacgtttataggtggagtcaggcagtcccccttcttccaacattcaaaaccaaagacactgctcctaaattactctcacagtgcattttagtaaagcctcctcaggaagctgatgataccaatctaaaaaatgaaacaattccttcacactataccctctgctttcaatggcttcttgattttgccctttcctgacactgccttcttggtgcccaaagtccttaggggtgctttctgatgtcgctgcataatttttcccttgtgggagcgaggttctgtgagtctactggctgaagcatagattgactgaaatctgaacttgg

SEQ ID NO: 38276 - DNA, 1025 bp, Homo sapiens
tggaaaacagttaacatggtgcgtagcatattataagcactcaaatatttgttgtgtaataattaatactaaaggtctgtatctatcagtggtattaataataatctaattcagctgccttataccaaaaagggatatttgtgggctcacacaaatgaaagtctgtggcatgtgtgcctttgggtatggctgtatctagcacctcccttgaagggattgggactcagcctttccccagctcttctgtgttggctcacttcccaagtagctccaggctcgcaccctactggcctaataatgcccagtgaaaagaacccagtactttcccagtggttcccaagaaaaatcccaggattgactgacccttcctgcattggtcatggtctcatctttaccccagacacttgagccttgggattgaggccaggattcagtactcacctctgcaactttgatgggaagagtcgtcctaatgttgatcagtctcaagtcttgtcttttcatgcttggagactaatagaaactaagaacatcagtagagctccttccccagtggaaaaaaaataggggcaacaaatatcaggcaggcagactatagatgttccccactggctccagtggtaattcttttggggttttgtggttttttttcgttttgagagagagagatgggagacttgctgtgctgcccaggttggtctcaaactcctgggcccaagtgatcctcttgcctcagtctcccaagtacctgggactacaggcgcattaccattgcacccagctctaactacatacattttcctacatagattttcagaactgcttaccagtacaactgtttctttgcagaggcatgttaacgtccatggggctgaggttttaacgttagcacataccttgtttatagtacaagttacccttgaaagtactgccggaaggtgccacatggagttccacacagaatctcacagagccaggctttaccactgcttggaaccaaatggcccatccttctgttgattact

SEQ ID NO: 38277 - DNA, 1027 bp, Homo sapiens
tggatgtgagtaggagtcctccccatgccccggctctgagggggtcgtttcaaactgcctggtttcttagttcctcactttcacatccacgcccacacgttcttttcttttctctcctactgttttcttctctctcattctctcttccctcctcagcttctaagccagaagtttgaagtctctttacaaagagactttgtttagatactgtcagagataaaaggatttatatttgatgagcatccagcaacggcatccttaaagaggtccctgcagttggaaagtggactgctgttcatctgttacatagatgtctgtgtgcacccacgtgtgtatctgacagatgtgtacacgtcttcagcttgtttctaataagaatctggaaatgatggcttatgggttatctatgtgtatacgtacaactgcatagttacagaatatctttatccatggttctaatagcagattaactcactttctgggtaaattaaggcaagacttaaatgcctccatttcgtctgtagagcagggatggtagcatgatacttatacagccacacgtatgattacatatgtaatatattttgtgaattttagagcatctaaatagccactataagcacagtattgaattattaaagcattttggaaggaataattctgttacaggagggctttgaaaagatactaattcagatggaagatgaatacatacctttttttgcacattttggaattttgttgacagtttggtaacccgttttggcctctggtttagagaaacatattgtgcactagtctcagttcttgcatacatcacatacatctgtttcctttactttcttttctttttagttgttgatataagaccctcagtaattacctgagtttttgatgcttttttggatgggttgtttttttgtttttttttttttttaattttgaaccattccatcttctctgtctttctctatctttttatcctttttcgcctttcttcccccaccacctgggagccatgaggcaa

SEQ ID NO: 38278 - DNA, 1025 bp, Homo sapiens
gttgattttctcactttggactggtttttacttcccgacttctgggtaagggtggccgatgggtccatgtggggcagagtgtggccacagctccttttatggccaagccttgtttctccagtttcagtttttcttgggctgtttgcaaatttgtttcgcagttaaaaggggatttgccagctgggatgggggaattgggaggcagatggggcttccaggagcgaggatagggtcgttggcctcaggtgccgctctccagttaggagtattttaggcacctcgttccttattgtcaggtttaacttcatttgttctcccactttataccttagtgaatttgtagatgtgacaaggctttcgcagttatatagctttcccagatcagtatgttaagaatttaagcagaagttattgagaaaagcaggtgtcttgctttttcacttttcgttcttctttgctcataaaacctttttctgaatctcgggacgacagttatctttcggatggaacgtgatctggatgtctatctaccttattgacttaatcctgttttgtagtggttggttactcgcactatgcagacgtgttgcggtgctgaatacaacatttattactaaagccagacactggatcaccgtcacggcagatgtcagcacacctgttgtaatcagtaagaagttacaagtagtatggagcatcattaatcctgctgtataaagcagtcttttatggagtctgattccttttaagtaaagaatccttacagtggttttgtgaactttttgggtgcttacttttcctaatcaatttttattttccagactcatctttcaagaggactttagactaattgcagataattaaggtactgatttattttaaaccttttatgtttgagtgctgtgcgtatttctgcatgttagaaaatgcagagaggtagcctaatgttttagctatttgccactatcatgttatggaaacattgtgctttacatagcattaaatcgaagagatattttcattta

SEQ ID NO: 38279 - DNA, 1456 bp, Homo sapiens
ttagcccagcgtggtggtgcatgcctgtaattccagctactcaggaggttgaggcatgagaattgcttgaacctgggaggcggaggttccagtgagcggtgatcacaccactgcactccagcttgggtgacagagtgagtgagactccgtcttaaacaaacaaacaaacaaacacatcaaacaaacaaacatccttaacttgccagtaattcactcttacttttcttcctgtggaaatgtgcttatgttaggttatttgcatgaactgagattattaagttctaatatttttctgcacattttggccactattatttcatgtagaaagttgagagaattttattcaaagctgcctttgtgtgaggatctgatagcatagaggtagtagaaatagacattttttaaggggtaactcccaacaaaataaaagcgaagtaccagttgtggcagggatgacagtggttattggatcaccgagctgtattctttctatcagctctctccaagggactcagctttctaggagggggagatggaaatcttaaacaggtttgatagcttccctaccttttatctgcccagacaacaaaaataaaacagctcacagtgttaggatttggggtgataaattaatttggagatatctaaatgtaaaatgagatttctgggcacatggcagtgcggtctgtatgataaacaactggggttgaaacagtaagtgcatgaactagacagactctttttgaccagaccttgtgttataggtgaatgaaatttgggaatcctatacttggaattctggaatggctagcctgggccaggaaaaatcactttgtaatctaagaaggaattgagttaagaagatttgttcatcacaccacatttccatgttgttgaggaaaatagattggcagtggtgacaaggtcaaggatgtgttgttcgaagttgtagaagataagcagcaatttaaaggcgttacaatacatttttaagagtggaaattgcattgaagagtggaagaaaagtcgacataagagaattagggcatgttgtttgcccaggctggtcttgaactcctgagctcaaccaatccacctgcctcggcctcccaaagtgctgggattacaggcgtgagccaccgtggctggcccttaatatgttttaaaaggatgtttaatactcttcattactgtgttatgcaatagttgcatgatgatttttctgatctctacattctattttttttctttttaaaatggagcacagaagtacttagtttctgatgtttttccatcttggcccagtaatttcctttttttttgttattttatgaagcacaaaactaaatatttttgaaccaagagactactgtgtggtattaattttgattttgtactaaattcatgttatttacacaaatcaaatagtgtcaaccttaaaatttttttaagcaat

SEQ ID NO: 38280 - DNA, 1052 bp, Homo sapiens
cttcttgtagcatgtgagaaataatacttcaaaattcaagtgtaattgtattaatttttgtgaataaactgctatggagtgctgaagtgtgttaagatgcctagtcttttcagaattaccggcattatggtattgaacttaaaatattttatgtttataatattttagaattttcatgagtcagataaacatatacccagattttcagaaacttgacatttgcttaattgcttaataattcacatcaggcttagagatttgtgaaatatttttgggataatttatttagaaatagcgtgtgtttaaatattaattttcttttttaagaaaatgggcagatgataaattaccatgaaagcttcatttaaaaatctgttgttagtattgtcttctttaattttggggagaaaaaacttctgagatgttaacaattgaacatgtagtgttggctctttttggccttcaatttaaaattgtcatgtgtttggattaaagacatgatgtatttttagctattgggcaagagatggcaatattgcattacatgatcactgcagttacactattataaatgaaagtgaatttcatgttacaaatgttcttctaatgcaattattaggcgtcattaaattagtttacactttatttcttctgattgattttttaaaaaactttttagcagtatttatataaaaattggacaaattgaccctttcagaggcagtatgaccctttcagaggcagtatgatcttgtgcagatacccgtctgcaatatgtgtgctgaacagatgtgaaaattatttagtcactggcttactgcttgacaccttcattgctctgttgccctgactgtgcttgtcctagaatctggttgttgtcctctttgtccataggagcatatgaaggtgggagtttttgaatttgaggacaaacatttgttacctttaatactacattgctttcatactcactaaaaactaacctttgcatagtatgcaacttgtatagcttattaatcttcaagtctattaacatataatatggttaaaga

SEQ ID NO: 38281 - DNA, 1031 bp, Homo sapiens
taggatatttttttatcccatcaaagctatctatatatatatatatttttaaatgaacagcatttgtcagtgatttttacaggggtgaaaaagcacaagacagttccattactattataaaatgttttacttttgttgtgggggtaagtttagaagtccaagatataataatttcagatgtgcttctactgtttcctttacttaaaagtagggactattttgaggcaatataatttgtatgtttcagtttttatttctctctgaaaatcactttttagggtaccatgccttggaaagaaagtttacatttttttccgttaaaaacccatcctcctaactctgaaatgactgtctcagttactaaatgtatatagcttgggggaagtgaaggcacagttggcagttagaggtttgtttttatgttcatgggagtatatgtgcttatatttaaatgttcactcttctagcagggtttgttgatgttagtaatatgctacatatgcgatttgtctgaattgtttaaaaatgcataattacaggaggatttgattattcagcaacagttccagtagctaaagactatcatatagatattttcttccagtatttgacagtggttctgtgagctatgagtagcataaaaaataaaaagaagatactgtgactctttaataccctagaggccgtagtcttaggatattcttactgtagagatgaaaaaacagggcttcattaacaaactgaactgctatttcacctcttttagtagatgtgtaattctgtgggtttggtaaataacaaaggcttttttcctaaatgatttaatgctttcagatttttgtgggaaaattagaaaaagcaaaaatgcactcagtgattttttttttaaacccctttgtttctggacaaatggacaaagatagttaagtgtcccaaaaatggttttaacaggcttccctctacaaccccatacataccctggctgtccataattccaattttgggtaggtagtaaaatgtgatattagact

SEQ ID NO: 38282 - DNA, 1031 bp, Homo sapiens
tcccctagtcagagactttgcaaatgatttctacaaaaataaactataaaatagatgatataatggggcctattattcctgatttgattttaatttgcttccttttataatttttccacaataaaacagagcctctcagaaagtaaaaggatgtaatcctagctcagatggtatagggtccttatgtcttgagctattatgatggaaggtacccctatacctccactgatagaaatatgatgggcagacattttctttggtgaaaagtagttcatagtttactgtgatatccactccttggacttactttagaggactgtttactgagggcaaaatatgtgcatgattacatataatcaaggttaatttttatcaagggtcaccatgtttttgctatggtctgacaatcatgacctacattaaaagagccctgtgggtctgtctggtgtatttttgcttgatgtctgggtagtttatttcagatgcttgtcagtttcattatatatttttgtttggggctcttgctggattttcaggtacaccataaaaacagttctctttgcagttagattgtcatgaaatagcttctgttttatggtatgaaaacactctttaatcttgaagggtgagtaattttgggaacattttccatttggtggtgtgttatgttcaaatggtaggttattttgaaataggatagactttgcagctaagattccagatttagttcagttaattcattctttagtgagtttttcttgggaaaatattttggaattttcatttcaaatgcatcctcctcatttaagaaaaatccagatgagtagtttatttcacaatataataactaaataggatttataaagcagaaatttataaatcctttcttttgctgggacaaaggcaatggtgaaaattaaaaaaaaataaagttaggacatttaggtaactcaaagacagaacttaatggctgttaagattggagtatttggttttgtagtttttaaaccatatttaattttggccatatc

SEQ ID NO: 38283 - DNA, 1090 bp, Homo sapiens
acaaggtaggggatatttccatcaccccagaaaaatttttcctacctctctcccatcaaccctccttttcccttcccctcccctctgcagcagccactttctgattctgatttcacttgttcttgggagtcatatgaatggactcatagtatgtacttttatgtctggcttcttttattcaagatactgtttttggattcatccatgttgttgcatgtataaattcgatttgcttctagcaacagaaatgtgtatactagcaatcaaatacaaatttacttttaccttaaagttgagagattgagtagtgcttttttaagaggattgttagtagacttccacagcaactcacatatattgagtgccagtccctacgctcagtgctttacacacattatcttatttaattgtgttttgtgattgtttgtttagttgtttacttaattctctacggcagacatgttcggtgaaagcattgacatctgatgaagaagttgacttggtgtttgacaaaagaaactgtcttgtgatataaaattctgattgttttctcaggactaagtactaagcattgtttatggcaggcatcgatgagcttaaatcatgaaacaggaggaaaagtgtaaaaggacaatggaagagagttactgggtgggaaagaaagaagtgcagtagctagtttagattcgtcttatacaatctgtgatgaaacttttgagacagagtctcgctctgttgcccaggctggagtgcagcagcgcaatctcggctcactgcaacctctgcctcctgggttcaagcgattctcctggctcagccttccgagtagctggcattacgggcctgcaccaccatgcttggctaatttttgtatttttttggtagagacagggttcaacttgttgccctggctggtctcgaactcctgacctgaagtgatccacctgcttcagcctcccaaagcactgggattacagatgtgagccactgagcccggcaaagttgcctttcttcatagaagaaagttgcaaaatatacatgaatgaaagtatattacatacaatacggatgcctgaaaaaaagcatatgt

SEQ ID NO: 38284 - DNA, 1035 bp, Homo sapiens
ttttccgtctctcaggggtcactgttctgcattgtgttatgttcaatgtcttgaaaaattattgttttatatgttcggcctgttttttggtcgtttcatgtggaagcttttaatgttaatgttatttctgagaccatatatttatataacattgaattggataagattaaacagaagaaacattatttagaaagttaaaaaaatttttctgcgtgagagcctgttgttagttatttagaatcacttcttaatcacagcaagatactttgttttattgaagatttgtttccctctagattttctccttattaaatagtagaacatagagaagagaacagttaaggtcggccggattgcttctgcaggtttgtgtccatagagaagctgaatgtgtagaatttcaagaaggtaattgagaagtccgggagtagagtttatctcaacaccaaaagaatcatttttaaataaatacagggtgagaaaagtgaagaatcaaaagagtagcttttgaagcacagtattcctaaggtcttgttttaaggatatgtttctgtgtttgttttttattgatttgagatcatcttaatgcgtgttagaaaatttatcaggctgaacgagttgatcctaaaatgctgcagaaaagttggatgtgaaatgggaaagaaaactaactttcatgagatgcttcgtaaaatctatttcaattcagggtgaaaattgcaaaactgtctgccaatgcgtttttgatggacattctggctatttgtgtgagtcttctgcattgaggttttatttattgagcttccttttgcttcactctagaccaggtggtttacatatgttatctcatcttgtccttctgacaaatcctgtgaggtatgtggtgttaatctcattttaaagatgaagattttcaggcttatagggtttaggtagttgacttaaggtcactggtagtaagcagggattatggctgggtctttgactgctaggcaagtattaacacctcatcacacacatgggctgctttttctg

SEQ ID NO: 38285 - DNA, 1100 bp, Homo sapiens
ttagtcatctaaatatcagaaggacattcctggtgtgaatgtctattcagctacttcatgcttagggctctagggattctgtcaatctgaggtttcgtgtcttagccctggaaaggttttaagtttgtccttaatttccataccttcattttctttatgttctccatttctggcaatcctgttatatgtgtcagcttttgtggactggtcctttgtgcagtgatccacctgcctcagcctcacaaagtgctgggattacagatgattttaaagtgatggtgttatttttcaggaggctaactctattattggtatatgatagatggggaagattttacctgtgacccagaatgaacatgtttgttatgtatttcagtttaaaattaataatgtgtgtgaccaagacactggtgtttactattactgttatgctcttggataaagctaagaatattaaaacttgaaaaaattaatacataatatgttacatatttgtgggtacgtgtaatattttgttatgtgcatacaatgtgtaatgattgagtcaatatttggggtgttcattgccatgaatatttatcatttctgtgtactgggaacatgtcaggtcctctcttctagttgtatatttgaaatatacaatatattgttgctgtctgtagtcaccctactcggctatcaaacattagaacctattctttctatctaactgtatgtttgtacctattaaccagtctctcgttatccctcctagtccttggcacatccccttcccacttgcgatatctattattctattctctacctccatgaggtcaacatttttagcccccacatgagtgacaacatgcaaaatttgtctttctttgcctggtttatttcacttaatgtaatgatttccagttccattcatgttgctgcaaatgatatgattttgttctttctttatggccaaatagcattccattgtatatatgtaccacattttctttatccatttttctgtgacagacacttaggttgatttcatagctttgctattgtgagtagtgctgcagtgaacatggaagtgcaggtatccttttgataaactgattttt

SEQ ID NO: 38286 - DNA, 1085 bp, Homo sapiens
caagttaacgtggaagaagtatccttttttcacattttctctgaatcttatctccatggatcttcttagaaaccttcttctagaaattatttcctcattccatatttccaacctctccaactcccctggaaccttttcattggtatttaaacatacctgggtctaatcggccccctgtgcccctgttagctattgtcctacattttttcttgccttcccagccagacttttaaaaattcttctcttcttaatttcattcttatactcattctttttcccctttattggttttattgtgaaatatattaaacatacattagcgtttataaaacacatacagtttaaataataataaacacttaaacatctgccacccagtgtaagaagtataacattgtcaagaccgtagaaactgccgtgttttcaatcataactcccaagaagtaacctttatcttgacttttgtgagtcatttccttacttttattagttaatgtatcatctattaagtatgtctttaaacagtgtgttgtcttgtttagccgtattttgaactttatctgttgaacttatactgtttgtgttcttctgagatttacatctttttctcagcattacgctttgagatttattcatgttaatgggtgtaaattcatagaatttgctacaatttattcattttattattaatagagttttgaatttttcccagtgttttgctttcatggacattcctgctatgactattttaaacatgttttccggtgcacatgtgtaagaattattctagaatatgaacctgggagttgagttactgggtaacatatctgtgtacattcaaactttattaggtaacgccaatttcttttcacgaatggatgtagtagtgtgcattctcaccagtaatggatgtgtgcatttgttgttttccatttttgtcagcacttgatatggccagacttaagtttttgcaagtctgttggtgatgatggtatttcgttttggttttaatttacatttcctttttttcttttcttgagacaggctctcaccctgtcgcccaggctgaagtgcagtggcaggat

SEQ ID NO: 38287 - DNA, 1049 bp, Homo sapiens
aatggcttactacagccttgagatcatggaccaacatgattctcctgcctctgcctccctagtagctgggactctaggcacacaccaccacacctggtgcttacactagcactatttactaaaaatttagtctttaccaccagtgttttgggatgccatttttgtcaaaacgaatttccaaatttacgtaggtctattttgggctttctgttctgctccacggttctgtttatttgtattccatctacgctgtttgcaaaggaagttttatttatattatagtttgacatctgctagggctagtcctttcttgtagtctgtctcccttcccttccctctccctctccctctccttctgcctctccctctctttctctttctctctctctctttctttccttcctttctttcttcctttctttcttttctttctctttctttctttctttctttctttctttttctttttctttctttctctctctctctctctccctctccctctccctctccgtctctttctctctctgtctctctctctctctttcctttctttcttttctttcttttttgagaatctcactctgtcacccaggctgtagtgcagtggtgcaatcttgactcactgcaacctccacctcccagattcaagcgattcatgtgcctcagcctcccgagtagctgggattactattagccaccatgcctggctaatttctgtatttttaatagagacaggatttcaccatattggccaggtggctggtctcgaactcctggcctcaagtgatctgcccacctgggcctcccgcagtgctgggattacaggtgtgagctaccgtgtctggcctagtttttctttttaaagtgtttttctgagtattctttcatgtgaattttttcaaattaactttagtatcatctgtgtaactccatgaaaaattgacttggtatttgtattggtaaattagaaattaatttttttcttttgagacagagtttcactctgttgcccaggctggactgcaatggcacgatcttggctcact

SEQ ID NO: 38288 - DNA, 1035 bp, Homo sapiens
cttcacagaagtctgtatacgtatcctcatttcttccccttaaaataaagctacaaaacatttaaactaatctttcacagacccttgttgcccttgtaaagcagatggaaacacagtaacaggtggcactgtaggctggggaggactcttagtctcagctgcccagccgccccagtgcccctgaccttctccctcagggacctcagtgggagtcagggtgatggagtcatgctttcagggaaaaccacttctcctgcataacgttggtatccttgggtctcttgataaaggtgcatgatgactgtcccacagctacttgcagctgtccttgccatctccacatctctgttcttccattcttcccttttacatgaaaacttggcttctaaagcatatttcttccttctcgctctaaactgtgaactttagatcagtgactatctttgtgtctttatttttccttgtgtctggcatgtgatacatgaacaaattgtagaatgaaaacatgaaatgcttgtgaacaaaagttctctgaaaaagggatttggaggaaacagactttattccagtgcaccatgacacccggctatttgaagcctttagtgtaaaacaaaggtgcattctagagaatgaagaggaggcttgagttgtataacaaaagttcccacccaggtttccaatcaggtccatttgtgcaaatgaaggattgaaacttgcttagttttgattggccaacacagctgagttctgattgttgaatgcaataaggtttttgaaatatggtattcatggaatctggagatcttgggtgctcctgccagctccagcactaactatggaaactgtgggactttaggcctcaatcattgcctcttcttaaatcttaatcttctcatctgtgaagtaagggaatgatattttgtcatctttaagtattttttattatgctatgaattttaagattttgtacaggccgggcatggtggctcatgcctgtaatcccagcactttgggaggctgaggtgggtggatccc

SEQ ID NO: 38289 - DNA, 1083 bp, Homo sapiens
aattttttaaaaagtcaaccaaatgttatggtcagtatcatagggagtcaacatgtgcatgaatggaagaaataagctaaggttgataagctgttttcgtcaggtctcccatttgtgtgactcccttattttttcttatctttttttttttttttttttttgagatggagtctcgctctgtcacccaggctggagtgcagtggcacaatctcagctcactgcaagctccgcctcccgggttcaagcgattctcctgcctcagcctcctgagtagctgggacttcaggcgcccgccaccatgcctggctaattttttgtatttttagtggagacgaggtttcaccgtattaaccaggatggtctcgatctcctgacctcatgatctgcctgcctcggcctcccagtgtgctggaattacaggtgagccaccgctcccggccttgactcccttattttttctagcagtgggaatacggtgtggagacgggtaggaggtagtgtaggggacaaaagtaaaaaattggaaattgtggcataaaggacatctgtgctttattttaccttctctgaccctatgaaagtcatcctttttgacagttctttggcaatttttatcttccaaagccaagagttagatgctgcttaacagttcttatataaattatatcatttttaagatactcctatcagattatccttagcttgaaggtttgaaatcctccctcaggcaaaacacatcttagaaattactgtctgaccctgtgatattttactgatactttatcttttaaaatttatcttgtctttcttgttatttgccatcagacagacatatggtggtaactgagaacctttaaggggaatataattttctttgagcttatattcttgaatttattatcattttaaaaagcatttttttccccctgtaacactctggctttgcgaaaactaactcatatttttacactttatgtctgtaatgtacaaaatttatcagttcctattccatttctggatacgtaggctatctacaaatatttgaatggatatttcaaactcattatttcattataacctgac

SEQ ID NO: 38290 - DNA, 1036 bp, Homo sapiens
gtaatatgtacaggtctttatgtaggtaaattatatgtcacaggggtttgctgtacaggtaataagtgtagtacctgttaggtagtttttggatcctcacacttcgcacatcctctaccctcaagtagcccccagtgtctgttgtttctttctttgtatccatatgtactcaatgtttagctccctcttattagtgagaacctgtggtatttggttttctgtttctgcgttagttcgcttaggataatgtcctgcaactccatccatgttgctgcaaaggacatacatgaacttattctttttatggctttgtagtattccacataccacattttctttgttcagtgtaccgttggtgggtatttggattgagtccatgtcttttccattgtaaatagtgctgcgctgaacatacatgtttctttatggtaaaacaatttatattccttttggtatatatgcaataatgagatttctgggctgaatggtagttctgttttaagttctttgagaaatcgccaaactgctttccacaatgagtgagctgatttaattcccaccagcatgtttaagtgttctcttttctccacaatctcaccagtatctgttaatattagactttttagtaatagccattctgactggtctgagatggtatctcagaccagttgtgagtcaacagatttttctagtactattcaattgttgtttattagaggaggcaatgatgagtttgaagtgaatgaagaattagcttatctgaataccttatgtggaacaactacaagcgaggatatttacaaggaaattaataaagcattacttagttcaagctgaagtggaatctgctaagatgtgttacagctgatacggtaaaaatatgtgtgaagcagaacaagtcttagatttacaaatctgtgaaaatgtagagtgtttaaagcatatgttcattgtattattcgtcactagatactgatgaaagtatttgtatctgtcatgtgctgaactgaagtgtcattggtgaacttcatttcat

SEQ ID NO: 38291 - DNA, 1060 bp, Homo sapiens
tttcgattcctatatactcaatacaacaagtattacagattcgttatattaggcctatttacttgcttcctcatatcacgaaaactttcttgggtagatgcaatgcaaggcattacccttcaccttagtcatatgggttaaacaaaataggtaactccggaattaggcaaaatcttgtgtgcaggaatcttgaaaaactgtattatttttcaagctctccaaaagattgagttgacaaaagaaaaagtagcatcaaatgttttattttaggtccttctgtactgcaagagcagaagtagaccaatgttaataattttgatttctcagattcactgaagagatgtgggtctacaaacactttaggtacttggatcaactattctcaacatgaatatgatactgaattcatttatgcaaatgatttttacagtaggtttgctgttatttacttttattattattattttttgagacggagtctcacttgcagtggcacaatttcagctcactgtaacctccgcctcctgggttcaggctattcttgtgcctcagcctcctgagtagctggattacaggcatgtgccagaacagctggctaacttttgtatttttagtagagacggggtttcaccatgttgcccaggctggtcttgaactcctggcctcaagtaatccacctgcctcggcctcccaaagtgctgggattacaggtgtgagccaccatgcctggcctgttatttactttaacatgggttattttctaccagttacatgatcatagctgagccttttgtgaacctaaactttagaataaccatcaaaacaaaataaatgatagtagacatatgactctcttttccctttcttcaaaccaataaattaactaaattaaaaacagaaatgcaacaatatgttttgccctatatctttatagcactttacaatgattgtatgaagttgagaacagtaacatgagatactattcaagatgattcaccgtactctgtttcctcaggtaaagaatttgtatgatatgtttcagaaagatattttttaataa

SEQ ID NO: 38292 - DNA, 1061 bp, Homo sapiens
cactggagtgcagtggcatgatcttggctcactgcagcctcctcctgggctcaagcaatcctcccacctcagcctcctgagtagctgggactacaggtgtgcactaccacacctggctaatttttctatttttgatagagacagggttttgccatgtttcccaggctggtcttgaactcctggcctcaagtgatctgcccacctttgcctcccaaagtgcagggattacaggtgtgattatgagacattttatattcataaaaatttatttcttgttagtctaatgaatgaggagactaaaggctaacccaaaggcaaggaagcattcagaagagattctgaaataatcatgaagtcattctgaatataaaatggcttcccacaatactaaaaatatgctgactatgcattcagatgtgaaaaaatgagagagctcattaacttttgaatggacagcattaaagtaaatatttctatgtttaaatagaaatgtaatttcttttgtatataaattacatcttactggttttctggcgttttttttttctctctctcaacctccataattgactatctttaccttctcagtgtgtgttttatttttgaggagactgctgcatgtgagtttaagatttaccaggtaatttctgggtatcattttgttgttctcacagactgttgtgaaaccttccttctcacttcctcctttctgatgagattcaggttttaaaaattcctaggattaacagtgtttgggggctgagtttgctgggtttgacacggttgcattttagatatctagaaaaacatgtcaagtggtgaccaggactttgttggggccagaatgaatttacaagctagtgttttctaggatatttgtattgatttttctctagcagctaatcaatcagtttcagttgtataagtgatggagcaaacctttttaagtgtgcagggtgagtggtgtggaaacaacacctttcaccgcactgtctctggaatcaaaatgtagagatgatggatgagctgtttttatagctatcgtgtgcttttctagatct

SEQ ID NO: 38293 - DNA, 1032 bp, Homo sapiens
tgtgtgtctaataattaccataatttcaaagtattgtatatttcaagatacctgaaataattgtaatatgatatgcaaatttttataatttctcatgggtgaaatcacagccactacaaatagctataacttgttgcctacattcacagttgtagaattggtaaattttggcaagaaataaatgaaaacgaagttatgattttttatttttattttttgcacccaagttcggtctcttcccactctcttagtctgttcagtctcaaatagctttcttaatgaagatataaacaacaacaacgacaaaaattaataaaagcgcttagcaacaccaagaaaataatccaaaaatgattaggccagaaggtttgtgctgtcttggcccttgaccaagacctctagttgatagatccttcaaggttacctctctcagcccccttctagaagattaaccatgtcttagaaattggtgctaagtagttccttcttatttgatgatgattttaaatgcatgtactattttgtctgaactagaatccaaactttccatgaaattaacatcattccctgttgaatctaggtgtcatagctctataaccttcaattagtttacaaacaatatatatgtctccttacctgtgaacaaggaatgcttaagaacacaataggcttggaatttgcaactaatttggcccaatcttgagtagatggccaaactaaaatcttgaagttattttgccccaacatagagcaacagaaaagactcaagcaagttccttagagattgtagctgcatagttctagatatctttaatatagaagggagtagccacacaaaaaatatcatgtttaaaaacataaccaacaacttgtattattgaacatattttaatttaaaaatgtatattttagaacagcaatatgaataaatgaaaacgtgtgtgaaaataattcattattactctgaataagcctacttttcctaattatccctaaaaagtttatttttctatttcctgattatctctttta

SEQ ID NO: 38294 - DNA, 1045 bp, Homo sapiens
gcaccctggtgggtttctgctgataaatataagaacctgtagtttaaaactggcagagctggactggggattagaaaagtcactgcaactttaagcagcagattctttcacttggggcaggatgtaagggtgtactttctctaaagatgccgtcagtacaaatgcggaggatagattactactgcttgctgctaacatgacaggacattcagggtgccactactgttgagtgtggagtcagccttggaggaaaaaatccccaaaaccttctttggcaattgtctcttatgtagtggacatattttaggcaaaatgacagcatttgtgcattgatgggattaatgcttcattctaaggattaaattcgttaatattttttctttgtgtacttttttattcctaaaacttttattttgagcatgcaggagacagggatttcttggaaagaatatgaattttgaagtcaggcagacctagatatgaatgcaaattctgttgcttcttagccacttgtaacaggcaggcgtagaattcagtgtgtaatcattaaacattttgttttctttcctcacattggtgaggatagttttcttttgagtatttgctttagtgcctttaattaatgaaaaacaactagttaaaaggttggctaattcctttatgatatacacacacacacgtacacacagagctacctatctcctctcttactttttattgtcagtctttttattacaaattagtcttctacatattataaatttaaatgctaactagaaccagctaaaaagtcaatacacttgttcaatcaacacttttatttaacacatagtatgtgctgtgtattggaaggtctggtgatgatggttccaattctggccttctgaagcttatattctaaatggaggatgctgtagactgctgtgaatacggtggaatcaataagcatttacattgtgatgggaaagacttttgtggttagggaagcattcctgcaggcagtgttgtaaaatgtggagcactttacaaaaaatatgttcataat

SEQ ID NO: 38295 - DNA, 1031 bp, Homo sapiens
gtcacaagggaaatgcaaatgtgaattacaataagatactcctatacatgaagtacaaccaccagaatttaaaagattaacagcactaaatgttggcaaggttgttgaacaactggaattctcatacattgttgctgggaatgggggtttccacccactttggaaaaatgtctggcagtttcttattgaagtcaacatgcacttatcctgtaatccagcaattctactcatttactaagagaaatttgtcaaaattagtcacaaaaaagcttgtataagcatgtttatagctattttagtcgtaaccaccaaaaattagaaacagcccatgtgtttatctgtagaagaatggacaaaatggaatttatccacaaaatgaactattatttagtgactaaaaggaacgaactaccaatttaagcaataacaggaatttaacaatattatgctgagtaaaagaagcattacacaaaaaaagtgcaagatatgatttcattcacaagaatctctggaaataatctgtggtagaaaaaaaactgaatacttgtaggcacgagggtagggagagattgtctgatgaggtgcataggattactttctagaggaaagtattttatatctttagagtagtttgggctacacagtagatgattgtcagaactcactcgcttaagatctttcctttttttctttttttgtagttgttgttttaagagacagggtctgtttctgtcacacaggccagagtagagtggtatgatcatagctcactgcagccttgaactcctgagctcaagtgatcctcctgcctcagcctcccaaatagccgtggaccaccatgcctggctaatctttaaaaaaaaaattttttttggtggaacataatttctttttttttaaattatactttaagttctagggtacatgtgcacaatgtgcaggtttgttactcatgtatacgtgtgccatgttggtttgctgcacccgttaacttgtcatttacgttaggtatttctcctaatgctgtccct

SEQ ID NO: 38296 - DNA, 1085 bp, Homo sapiens
tgagagaccagagttggatgcccaagtgttcaaatagtggaacctgaggatcaaccttactagacatattttttttaactttttcagtgttaatcttttaacagaatcataaagaaggtaatttagctatctattgctatataacaaattacaaatatgcctgaacatatttttttacttagcttactctggtgggtataagattgaatatatggtagtttgtttctactccctcttacagaatttactttctgaattactagcagactttaaaataagatgttgttacatcatatttactgattctccattaaactcttaatccttagctatccaatatgtacatatctaaaagaaatatatcaatttattgtgaattggtttatatgttaaaatcacagattatttatataatggcaaaaaaaaaagaaaacaaaaaaaagtgttgagagcagatatctctgcctattttccagtcttaggagatgtatcagtcagggatctccagagaaatagaaccattgaaccacagttgtttacacacacacacacacacacacacacacacacacacacacacattaccacaaatgtagaagcttaaaacaacccatattttttatctcacagtctctgtgggagtctggcatagcttacctctactcagggtctctcacaagttagtcaatgctgaggtctcatccaaagactcacatggggcaggatctgcttccaaaatcacttatgtggttgttggtaggattcagctccttgtgaactgtagggttgagggcttcagctcctcactggctgctggatggaagcttccctcagtttgtgggcctctccaatatggcagctcacaacatggaaatttaacttcatcaaagccagcaagagagaggacctactgcgagaaatgcatccaaggtcctgccccagctctgtggaaaacacaccccacttctgcagccaacacagcagacaggtttctggccttgcctgagcacaccgcatgggcaggagcagtgtgactccacactgcccaactgattgaaatttctgaggttctctctttccatcca

SEQ ID NO: 38297 - DNA, 1050 bp, Homo sapiens
gcaaaaagtttgttttaatgagtccatataatacacagaaatttccataatttaccaaatgatttataatttaaactgcatctgtatatcctttgagatgatctattaaaatgaatgaatagctcaagttatgtttaaggcataggtcataagtttatttaagaattagtcataagagtatttattaggagggatggtatttgactcaaatactttgaaaacctagaagtcatagaagaaagataaagtgattttaaaaggtatttgggggagaaaagcatctgcatataaagtcttctctctctctctctttttttctttggtagaaacagggtcttgccatgttgcccaggctggtcttgaactcctgggctcaagcaatcctccagcctccgcctcccaaagtgtgggggttataggcacgagccaccatgcccagcctacatataactcttgggtacaggtatacctccttttattgcactttgctttattttgctttgtagatattgtaagttttttcctaaattgaaggtttgtgtcaaccgtgcttcaagcaattctctcagcaccgttttttccaacagcttgtgctaactttgtgtctctgtgccacattttggtatgtctcacaatatttcacatgttttcactattatatttattatggtgatctgtgatcaatgatctttgaggttactattataattgttttgagatgccacggactatgcccatatgagatggtgaacttaattggtaaatggtatgtgttctgactgttcccccaccagccattcatctccctctctctgtctgtctttcttccagcctccctattgcctgactcacaacaatattgacattgacttagaggcctacaaaggcctctaagtgttcaagtgagaggaggggctgcatgtctctcactttttgtcaaaagctagaaatgggcaggcatggcggcacacgcctgtaatctagcaatttgtgaggctgaggtgggtggattgcttgacctcaggagttcaagactagcctgggcaacat

SEQ ID NO: 38298 - DNA, 1027 bp, Homo sapiens
gcaggagaatcgcttgagcccaagaggcagaggttacagtgagccaagattgtgccactgcactccagcctgggtgacaaagcaagattatctcaaaaaaaaaaaaaaaaaaaaaggaagagccttcttcataaaataaattatagagcccacactgtagtcttgaactttgaaatcctaacccctggccagaagaggcagcaaaagatgatgaagtaaatgagcttcaagggtgagaattgttccccacagaaagccacccactactctgcactttatgtgcaggaggtaatccaggctgtgataccacacccagggagaaagccatccaaaagaaacagagcaaaaggaaacaaagatatgcaagaatcaaaggtctacaccatctcaaagtaagaggttttaaactcttcctttgtttcctggaccagaccttcacaccttgctgtttcttctcatcctcctctgcatggcagagcccagaacactcaggattccacaaacacatcgtatgtaacagaaaaggtgactgagccccagaaggcttacatggcttcccagtgtcaaaacgggcagtagggaagggagcccaaatctggtgctcctcagtcctgtgcacagcaataccttgtacatttccattttcctctcactaggcttagaccactctacagaaattacttgacttatctcaagggtactgaacagagttcaccaataagaaaaaacagaagatgaaaacagaaaaaaataacagcaaatgaaggtggtgattttttaaactatagggattgaaggaatccactcttgaaataactaccctgatgctttaaaaccttcagggcaaggatttcttgagaattttattgggaagacagccttcttgtgtttttagaagatgcttcacacaacagactttaattagagagtacttggctggtttgttttccttcctcttcattctgttcacttcttattcacctgactctcagattttttaaaaacaacttttaccaacttaaaagaa

SEQ ID NO: 38299 - DNA, 1001 bp, Homo sapiens
tggagatcacactccatcccatacccccccatatatagtttcagtttcaagtgccatgcgtcaattagattgtagagtatgagtctagtcagttagcatctctgagagatttttaaattaacgctgtattgtgtatatgcagcaagggcagaagcaaccctggtatataatttcacatttagattataagtaagatatattgcaaaactgtagtaggcagccaatatgatatacctgcttatgtatagcagatgactgagaaaacttcaggtaacctattttaaaaaaaaaaaaaaaaatcagattatcactgccaataaagtgatcctaggcccagtgcggtggctcacacctggaatcctagtacattgggaggctgaggtggatggatctcctgagctcaggagttcaagatcagtttgggcaacatggtgaaaccccgtctgtatcaaaaatacaaaaaattagctgatcgtgttggctcgcacctgtgatcccaactacttgggaggctgaggtgggagaaacaattgagcctgggaggcggaggttgcagtgagccaagattacgccactgcactccagcctgggtgacagagtgagacctatctcaaaaaataaaaaagtgatccttgcatagttttagacagttcatcagaaccataaaattgtgtattttgtctagtccatctgttgtgaagaataatatagacttactcccatgaggacagtataatcagctttgccatttagcgaaaaagagttttcctgtcctcttggggaagtccatctacctggtgagtaatttccaactattatggacatttagaagtagatgaaatattttagactaggcacagtggctcacacctctaatcccagcactttgggaggctgaggtgggtggatcacctgaggtcaggagtttaagaccagcctggccaacatggtgaaaccatctctactaaatatatatatatatatatatatatatatacaca

SEQ ID NO: 38300 - DNA, 1033 bp, Homo sapiens
cctgggctcaagcagtccttccacctcagcatctcaagtagctgggactacaggtgggtgccaccatgcccagctcattttgttttttagttttcatagagacagggtcctactatgtggcccaggttggtctcgaactcctggactcaagcgatcctcccatgttggtctccgaaagtgccagtattacaggtgtgagccactgcacccagctgatccttcttacccttttttgtaatcatcttctccctccattcacacccagttcctgacaactactgatctgttttctgttctcatagttcaatctattctttttttaaactttacttcttctttgctaaaaaagcttttgtactgtacctacagaaaagtatatggctgtgcacttttgtaaagtgaatacttccttataactaccagtcagatcaagaaattgaacatcaccaagtaccacacaggtccctgtcatgtcctccatttactgtcctctccccctcctcaaaggaagccaccatgccttattctgacaccacaggatagttttacccattattattctggatataaatgtaagaattcatgtttgagtgcttggattttgggtttttggggatttgtttgtttttgcataacattatgttggcgaactaatctgtttttaaagtagctgtagttcatccattgttattgccaggcagtgttctacagcatgcgtatatatatcacagtttattcatcctattgattattagccgggcgtggtggtgggcgcctgtagtctcagctattcgggaggctgaggcagaagaatggcgtgaacctgggaggtggagcttgcagtgagctgagatggttccactgcagcactccagcctgggcgacagagcaagacttgggtattttcaaaatcccaatattagtattgcagcaaatacagctgacagggttcttcttgtttttttcttttgttccacttgtgtgtaaacttttccactggggggtctggctaggagtgtaatcgctgagtcat

SEQ ID NO: 38301 - DNA, 1031 bp, Homo sapiens
accttttctcttcatggtgccttttgaagaacagacgttcttcattttaatgtagaatttatcaattttttttttatgttagtgctttttgtgtcctcttaagaaatgtttaccttctccacaccatcataaagatacccctcaatgtactgttctagaaattttatcattttgccttttacctttaaatctgcagtccaattggaatttattttaatttaaggtatgaggtgtgtttgggtttcaggggaagttcacgtttgttttgggtttttttgcctcggaagctatccatttgagtcaatgcagtttattgaaaatatcattcttgtctcactcgcctgcctggtcacctttattataaatcacatgtatgtacatgtgtgggtctgtcctgggcatctattctgttcctttggtctgtttgtcagtctttccacccatacacaggttaactaccatagctttatagtaagtcttgatattggcaatgtaagtatttcaatgtcgtatttttcttgaaattgccctaactattgttgttcctttgtttttgtaaatttgtcaagtttcaccaaaaatcctgctggaattttgattaagatcatattgattttataggtcatttgggggaaactgatgttgttataatatcaagtttctgtccttaaatgaagtatatgtctccatttattttgatcttctctaatttctatcgataatgttttataattctctgtatatgtcttacatatcattttattaaatatgttcctacatgtgtgtttccattgatactattgaaatgattttcatttttgttgctacttagaaataaagttgattaaaatatatttattttgcccaactaattcacttattaattctaatagtgtttctgtagggtatttttttagattttcttagtatacagttatgtcatctgatagtcatagttttaatttttccattccaattctcatgacttttatttccttttcttatcttactatactggcaagaatgttcag

SEQ ID NO: 38302 - DNA, 1072 bp, Homo sapiens
ctcctgccgaaggcttgacagtgttgcttggcaaagagccaacttcagaaattttcatccactggctatctctgtgtagtatcccttgctctacaacataaaaaagaaaatcaactgatttctgaagtgacataaagacgagagaatggagaagattgagctgtatattaaattgctttctggttatcaaataaagactcctttgtcataaaggccaaagataaaaaagaaaatgtgtatgtttaatatatggaacaaaaataagtctatttttgacatagtacttgaggagaagatgggtcaaaaagcccagccacccctgaaatgaattttagactcttattattggtatgatggggcagagagagatatcagtgatggttgcattgctgatagaaatgattttttacagtaggtgctaaattagatgtagaaaggagagttatcaaacctacattgtcatgtctgaccttccaggtcccagtcgaggaatcatcataaaaacgagttgtgggcttatctagagatgcagcaataactggcacagaacaattttcgagcttctcttcaaatggggtgacaccaggggttattcggggtagggagggagatgcattggctttgatcagtttttagaactgtatagcagcttatctgtgggtcagagaaatttcgttttctccattcttttttcatcactttttcccttgggtgcgatgtggattagcgtctggaagctggtatgaggctctgagcattaatagagtttgcgcagatccagactctgttttcgcaatactgggctcaagctcagcctcgctgaatgttagattcagtaaaggcacattaccatctctccataaataaaaggaagagaaatacttaatgacaatgtagaaatacatagaactccaggatactaattagcaaaactcacactgcatttattttatccagttgcacagtgttactctctcatagttatgtctctaacataacttccttttttaactttttgtttaattatattgcctgtctttaagaaaataatttataggtatcaggcattatt

SEQ ID NO: 38303 - DNA, 1066 bp, Homo sapiens
tgattagtgattcagctttctctttttgtacttgttgctttaaacattcactagttctcacttcagttgtaacatgcacatgttctcattttaaacaaagccaaatggtttttaaatccatggatgaaaaatcattttcaaatcgagtattcatgataaattttgaatatgtaatagatatgtacttaaaacttcactcaaggattgcaaaatacttatctaaacataggtgtttgtgtgtattttgtaattttcaggacatagtttgataatggaatagtgcttgttagcatgtatctctatcagggtttcttctggcttctctggcttcctccttcacatttctcttcatttgtgtctctctgatgttgctgctgcccattcacagtagagtcctgttccttggtaggccatggctgctcagatgcatcccagacatacatgcaacagactcgggggcatttccttttgaatggtaccccagccccactatatccaggactgaattcatcactgtatttattacctcgatgaatattacatctctccagctactgaaccaaaaccagaatgtcatcctagactcctcccactccctttacccactacttttgattgttctcattttcccagatctatacctgtaatttatctgggtttgacctcgttctctttgtggcaatggcaatggccacaaagagaacgaggtcaaatctagataaattataggttcacttggtggcagttttctcctgaatttcctcatctctccccaactgattttcctatttccattctcactggcttctcccaaaacccaatccattctctcactgctttgatggggatacttataaaatgccatccagactgttgatcccctgtgtaaaattcttatgtagccctcagtcacttacaggatacagccccaacatgatccataaggcccttcctggctagtagctccttaccttttacctcatattccatgctttccccagtatgctacactctctgtggtctcagtgtctactcataagttgttttttgtttctagaagccaccg

SEQ ID NO: 38304 - DNA, 1040 bp, Homo sapiens
ccactccagccatgtactacgcagatccaaggaaggagtaccaaacacatctcagtttaggcggccttgcgcatcagtgttcaagaaatatttccattcgactcttagagtaccagcaatttttgaaacactgttccattttctaaatttttttgagtcttttatctctcctattctatttaatcaccctactatataaagccatttgaataattcatgttcactggttcagaagtaggtgatgttttgaaaattcatttttatatgaattagatatatatgatttagtaatttgtatatgtccccaattatattcttaacctgttttttctaatagtgttttgacatgactttttaacacttgtcatctatattgacaacctcattggcagggtagaggtatgtgatttctttttttttttttttttttttttaatcgttaagcgtttaaccatgaactctcaaatacaaagaaaagaattgcctctgtgtggatttatttaagactgtaatgaattaacctaatgccatttgaatttagattgcttctgcctctattctgataagttagcgaacatatgtgacattcattcaattatggcagctgtttaatcatcaatagtaatattttatcttaatcataatgtaggctgtatcacctctagatttgtgtgcccatatgagaagacgggtatcattctcttagctagcaacaggattcctcttaggaaaggagctggctttgcttaggaaactatcttgataaacagttcaatggacaaagttaaaacctgaggacatgagttacaaggaaacaagactaggaaagacagaactaactgctcagcagtagaaaaaaaatagagggatttttttctcttagcataaatgagagaaagggtaataaaagagagggaagaagtggggaataactaatattcagttttaagtggtttgcatttttccctgtgtggacagaactaagccagaaaacaaaaaattgagagctagataagacctggagaatgcaggtcctctgg

SEQ ID NO: 38305 - DNA, 1113 bp, Homo sapiens
agctgaggcaggtggatcacttgagctcaggagtttgagaccagcctgggcaacatggtgaaactctgtctctataaaaaatttttaaaaaattagctgggcatggtagcttgtgcctgtagtcccagctactggcagggctgaggtgggaggatagcttgagcccaggaggcagaagttgcagtgagccgagatcgtgccactgtactccagcttgggtgacagagcgagaccctgtctccaaaaaaaaaaaaaaaaaaggaaaaataagactggtaaaatatacactacagtgttaacactagttatctttagcagaatccctttttttcctttttgtgctttttctatatttttgaaaatttctaaaatgaacatttattccttttgtaaagaagggaaagagaaaggaaagttttccagtgccattttgtggagtgatgggacaaatttgtctgaaaggaattgaaacgggaatgggaggtttagaaggaagaacgatggatgtaaggaagatagtgagacatggatcaactctgagctgcagccactggagaatttgtgtggtgggattactagaattcaagcagctggagaggtgcagagagatccctaggagcaagactggtgtgcatgctgctgtggttgctttggcatggaatccttctaagagtatcaaactgtataaagtaggtaggaaacagaaccttgtatgcctggtaaactttgccaaggagaagggtctgctctctgcctaggctggtttttcagcatatgatttaagcatattttcctttgactcttcatatgtgtttattgatttctttttctgcgccatattctttgtttctactgtgatgcttagagagatggtaggtagggtggaaagagatacgctttgaacttggcagaattcagccgacatagatttgatccctgctctatcacttatgagctctatgaccttggaaaaatttgctccagtgctcctagccagcagtgttagaatgatgctgataataatcaccttgcaaggttttaagcaagatacatttatgtaaagtcaccaactcagttcctttcacgataatgggcagccagtaaatgttactt

SEQ ID NO: 38306 - DNA, 1024 bp, Homo sapiens
gttgtgaatgaggaatcaaaatggaaaggttatcattttcattagctaggaaagaacaagaccatacttttctccaagtgtaattacagcggttcactggcaacattacactgcagtaattagtctaaaggtgtatgtgagggcaggcttttgcacagacactagaaatattatttcagagttgaaggtcacagccttgtatttaacatgttccaggcagcttaggggggaaaaaaaaaaactaatttgactggagctaaagaaagacatttgacatttcccagagtcatacattcagaaaccagtcaggtcgaaaaattgtattttattttctacaataaaaggcaaaacttagctgcagaaatagcatgtcagaatattctgtaggataagcacagataaaattcaagtttattagaaccatgatgtaaatgattacaggaacttttgatatgtgtggggttttttttgtttttttttttgagacggagtctcattcttgtcgcccaggctggagtgcaatggcgtgatctcagctcactgcaccatctgcctcccaggttcaagcgattctcctgcctcagcctcccgagtagctgggattacaggcatctgccaccgcacctggctaatttttgtatttttgtagagatggagtttcatcatgttggctaagctggtcttgaactcctgacctcaggtgatccacccgcctcggcctcccaaagttctgggattacaggcgtgagccgctgcgcccgggctgatatgtgttttaatctttgccttaggaagagaatggacagaaaaaataattgtcagcagctcttaaagggaaacaaaatagtttctttcttccttaacaccattttcaagaaacaaatgtctatcttacacaggtccatatatctacgtcctttgtgaattttttgttactctatttaaatagtaatattgaaatctttttgtaactcagcatctcagaatagaaattgattgacattattttccaaagccacgtcag

SEQ ID NO: 38307 - DNA, 2596 bp, Homo sapiens
gttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcc

SEQ ID NO: 38308 - DNA, 1033 bp, Homo sapiens
ttttgtaattttggggtggcattctttcagggcctgccttccaactggatcaaattcttctaaagtctgctgtctctaaaataactaccttcactcactgaagacataatgttcacagtaagactggtctaaaaattccattgttgtgtcatctttattgagttttaataactgtgttatacaagcctttcttcccttccatactgtgaaacagattaagtagcattagaatcagctgcattaaaaattgggtaaatgctgtggactgaatgtgtatgcccttgcaaaattattatgttgaattactaactcccaatgtgatggtattaggaggtggggcatttggtaagtaattaggttatgagagcaaagcccttatgaatggaattcttgcccttggaaactccagagagtgtgcttttcctcccataactatctgtaaagacacagagaaaagatggttgtctaggagccgggaagtgggccctcaccagacaccaaatctgtcgttgctttgatcgtgggcttcccagcccccggaactgtgggaaataaatttttgctgtttataagccactcagtctgtggtattctgttatagcagccaaacaaatagaacaagaaaatattcaccccaccaagaaaccatatggatctggtgctttttctaaggggggagggctagctctttgagcaattcctctatttcttttatgtgtattggaactctgatattttatcacttctagagtaaattttaatttttggaaaattatacattttatccatgttttcaaatgtttttgtttgtgtagggttgcataaatgagttttatatgctttaaatgtcttccatattgatggctatttctccttctctcttattttgtgtatggctgatttttcacttcccccacttcagttagcttgtaagtgagccatggagaaaatggcaacaaatactttaaagaagataatttttaaaatgagaataacaatttaatttctttagaagatgagaaaggtacacact

SEQ ID NO: 38309 - DNA, 1030 bp, Homo sapiens
ttgacataggtactcacagattggccacaacaatagaaaagacaaaggcagccaggcgctgtggctcatgcctgtaatcccagcactttgggaagccgaggcaggcagatcacaaggtcaggagttcgagaccagcctgtccaatatggtgaaaccccatctctactaaaaatacaaaaattagctgggcgtggtggcgggcacctgtagtcccagctactggggaggctgaagcaggagaacagcttgaacctgggaggcagaggttgcagtgagccgagatcgcgccactacactccagcctgggagcagagtgaaactccatctcaaaaaaaaaaaaagacaagacaagacaaaggctagcttttccactggtagctgaatgctatatactaatttaggaagtttttgtcactaagtatatgatacacatgttgggagtatgttaattattttctcttttaattgaagtgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacaggtaagaaagcattatataaaactaagtttttttaataaaataattataagaaagtttttaaggaaatattttgtgaggaattacgccatcattatcatctatactacattattattattttttttgttgtgtaggtttcatccatgtggtctgtatagatttgatgaatgtgctgtatatagttagtgggcccttctaatctgaataggtgttctcctctccagccaccgaaacgtgatgatgaggttgaatctacagctgaccatgggaaccttctctctttcgctctttggactaatgggagttgcttttggaatgaatttggaatcttcccttgaagaggtgagaatgtattattatttctaaaacttgggggttttggccgggcatggtggctcatgtcagt

SEQ ID NO: 38310 - DNA, 1046 bp, Homo sapiens
tactttgtttcccaaaacatataattacagatgggaaaggtgtgataaaacagtgtctctgtgaagcagtgttaatgaagagtttttattttttaattcttacatgtctggcaacgtaccaggcggtttgcatactttatttggctcaatcattgcaactctgaaaatagatatattatccctactttgtagatgagaagactgaggctcagaacatttaacttgcccacaggcatagagctggaaaaataacagaattaggacatgaccccaaagacttgcactttctactgctctgttgcctttctgtattaagataatacttaactcccagagtttttcatttcactgtggttttgtacagtcatccctcagtatccaagaagaattggttacaggatccccacagataccaaagtctgtgggtattcaagtctctgatataaaatgacccagtacagtcaaccttgcatatctgcagatacagaacccactgactgtgttttcacagaatagcttattgtaagttttctagaactgaacctggatgtgcatctggcacagtgtgatgctggattctgtgtcctcattagtctaacgagtctactctgttgcccacatcacctcccattaggaccactatgcccttttaaaaagtggtctttataagatgtaagtattatgacacccttctgcatacaactattcaatggcttttgattagccttaggataaaaatcccgtcctgccgcaccgacttgtccatcttgtgggtagccacttgttactacctctctcagtgtccttcccagacatgctgcttccactcctctcccctcagatccccgttttgcttagttacttcctcctcatctttcaggtctcaaagtagttgtcccttcactgaatgcaccgacaacctggcccagtaaagttactttgtcgtctgcgcccaaataatcctacccttccatctgctacattccttaaatctgcaatcccttgttcaaagcctgcaaaagagcatgagctccttgaagcaaaga

SEQ ID NO: 38311 - DNA, 1675 bp, Homo sapiens
tcccttgcaactttaaaatattctgaggtgctatcgtgcccagcatagcaccagacattcagctcacagtttgagaactgtggatataagcaaagaccttaaattgcgtgtcctctggcatcatgacttaagatttgcacgcatgtaaacaaaggctgcaaagaaacacaaagtaaaagcagtacatttggcatatagatgattttaaaatatttaaaaccttttaaatcatgttcttctcctgctttattctgtgggtgctatcaaggcccttgtttttcttagttcctttctacaggaaagagctgtacaaataacataaggctttcaaactctggggcagtaacaattcaaggaatcttctaaggaacctggcgttttgcgatggaaatgaactgtgttctcttttaggaccatagaattttttggctgattacaggaattatgttcatgggaagtggcctcatctggaggcgcctgctttcattccttggacgacagctagaagctccattgcctcctatggtatgaaggatatggttcacggcggtattgtggaagggttatgatcatgggccctaaagtcagagcgcctgggattaagttgtcacaggcactatggcccttgcgagttgctttctcaaacttccttcagtttccctatctgtcagttaagtcggtattacctgcttcatagggttatgggaagaattaaacaatatgtgtaaagcacttactagcacactgcctaacacaataagttagaaatataatttgtgtagaactctgacaacatacatttaaacagatgttagtaattctggtataaggtttgtcataaccaaatggaaatgtaggaaacatttataacgttcttaaaagatagaaaattcacctccattttctttgtacttgaagatggcaccactggaataaatacttaagacactgatactgcttatagtcctttcttcactgagtagttacataatacatcattttactagtggcttttcttttaaaaaagatactaaaattaatacttctgctttatttagatggcttctttacctaaaaagactcttctggcagatagaagcatggaattgaaaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataacct

SEQ ID NO: 38312 - DNA, 1034 bp, Homo sapiens
tttatgtgcactcatttgtatgtgagtgtttgtacacctctacctaatttgatcacatcaatagttagatttgtgtaggcagcacctgaatcaagatacagaactgtttcatctctacctaggaaatccctggcagtacctcttcataaatgactttgaaagtaacttggcaagattggtagcttttttaaactttcctttcactattatatacatgcaaaaaaaaaggatacataattgaataagtgaatcgctcaatgaattctcagaagaccgagatcaaggtgtcggcaggtttggtttctcctgacgcctctcatcttggcttgtagatggccgccttcttgccatgtcctcccatgatctttcctctgtgcctgcgtgccccagatgtctctctgcaggtcctaatctcttcttctaataagaaaaccagtcgattggattaggacccatcttaatggcctcattttactcattttaacttaattaatcacatctctttaaaggctctatctccaaatacatttcaggtactgggggttagagcttcaacctatgaattttgacataacacgattaatttagtcagctgggcgcagtggctcacgccagtaatcccagcactttggtaggccgaggctggtggatcatttgaggtcagcagtttgagaccggcctggccaacatggcgaaactccatttctactaaaaatacaaaaattagcccgtcatggtggtgggcgcctgtaatcctagctacctgggaggctgaggcaggagaatcgcttgaactggggaggaagaggttgcagtgagccaagatcatgccactgcactccagcctgggtgacagagtgagactccatctcaaaaataataatttagcccacaacactgaaggaatatttttttaaatgcctttattttctggctggtcatggtggcccatgcctgtagtcccagtactttgggaggctgaggcgggcgggtcatttgaggccaggagttcgagactagccttgccaacatgg

SEQ ID NO: 38313 - DNA, 1041 bp, Homo sapiens
tattcccccacaacaaaaaagtatgcagtccaaatgttcatagtgctaaagtgaaaagcattgacttagaacaaagattaacagtcaggctgagtaccatagcgcacacttgtaatcccagcactttgggaggcctaggtgggagaattgcttgagggcaggagttcaagaccaccctggctaacatagggtgttagactcaatctcaatttaaaaaaaggaaaaaaaaaaaggttaaccgtcagactaaatgtcctgctcttgatataaagatcacttttaaatttgtcaacaaactaagtactgtgggactataaagaaatactaaccatagttcttggcctctaggaatttataacctaggaatggaaagtgtattgcaaggaagagtcccatcagaggtactgtttagaaaaggagtttcatgagtaagttcaggaaacactgatgtatccttttttaaaaattttggtaaaatacacataacataaaatttaatacctgtgttagtccatttgcgttgctataaaggaatacctgagactgggtaatttataaagaaaagaggattattttgactcacagttctgcaggctgtacaagaagtggggtgcttgcttctggtgagggctcaggaagcttacaatcatgtctgaaagcaaagtgcaagcaggtgcgtcaaatggcaagagagagggagtgccacactcttttttttcttttcttttctattttattttattctattcttttttcttttctttccttccttcctttctttcttttcttcctctcctttctttctctttcactctttctctctttcttctctctctttctctctctctcttttctgtcttctcttctcttcttcttttcttttcttttcttttttcttacaggatcttaccctgtcacccaggctagagtacagtggcacattcacagctcactgcagcctcaacctcctgggctcaagcaatcctccttgtctcagcctcccatgtagctgggaccacaggggcgtgccaccatctccag

SEQ ID NO: 38314 - DNA, 1050 bp, Homo sapiens
gagttcataccataaatgttacgatgtttggttttataaaagagtacctgtaagtttttagtttctgtgtggaagattttttcagagagaatacagatagccttcttgtattagaattttgtcatatgtggtttgaaactgttcattggagctgaggaattttgttacgtttgttttaactagatatgattaacaaaatgaccatagcaagagcatgcattgaaatgagagaagttacgtgtgtttgtgtctagtttgggtaatatgattcattcttaagaattcttcaaactttattataatttttggaaataacaagtttgtcagttgattaaaccagtgtcttgttcataggcgaccttacgcaattatatagcagaccaaatgtttgtgttgttagtgttccttttccacccctaaattatagaaggactaagagtaacactccatacagaaactcagtaactaaataaccatattgcaactcagtaacaagataatgaattatgctgactttttagaatagttctgtcccaagaagaactctgaagatgattcagccttctgcatctggatctcttgttggaagagaaaatgaggtatgcactatatggctaaaatggggtactggtgatacagtgtctacatcgaaaacatttctactattttcttggtcagaaacacgtaaattgttgaaatttggaaataatttgggaatcacaattatatatttcccaaagaagtgattttggttttaattgttcaatttaagaagttcgtcgggtgcagtggctcacgcctgttatcccagcacttagggaggccgaggtgggtggatcgcctgaggtcaggagcttgagacaagcctggccaacgtggtgaaaccccatctctactaaaagtacaaaaaaattagccgggcgtggtggcacacacctataatctcagctgcttgggaggcttgaggcaggagaatcacttaaacctgggaggtggaggttgcagtgagccgaggtcacaccactgcactccagcttgggtgacagagcg

SEQ ID NO: 38315 - DNA, 1054 bp, Homo sapiens
tgctatacgggtcagctatatcagtatgctgatcagcttaggttttaacatttttacaataaattattggtttattctttaaaagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaatttgtctgtttctatgcttttatgttgttctctttccattcttttgctaactaccttggaggagacaaggagaaaacgaacttaaagtatttagactgagatagctgaggtttttaactcccaaactttgttgtacctcaagctcattgtagacactattgatattaacaagttgtttttggaatggagcatgagaatctattttccaaaagcttttcaagtgaatctgattagacagtgagaggcccaactggctagcaggatcagactcttcttggaagcttaaaatgatggatgatggtgataatcctcaagaaacaaagtgaggagtgggtagaagtttgacggaaaaaatcaggaatagctgaaaattatggagcttttctatttcacatattggtatagtgcaaagtatgtaaatattgaagaataagagtagggtcagattcattagggatttcccatatatactaagttttgaaggaggaaaagtacaaactaggggta

SEQ ID NO: 38316 - DNA, 1029 bp, Homo sapiens
ccaggatatggctgagaggaagcacatatgtaaattgaatgcatcagggatcttttggagaagtcaaacaagaattctgattacctcatcagtgatacctaaatgcagatttcttcttgcttcagacaaaatttttcaaagatactcaaagtatctcagctcttgttgtatgtgtgttttgaaagatagggttgaagaaaacaatgaaaagataacagggatatctgtcctccagagttgttcaggggattcagcatatgagaagttatttgcgaagttttagttcccagtctgggcatcagctcattatcattagtctctgatatgagttgtttaatgatgaacttgtgcaaagcacttgatcctattcagcgtcagacattcattgttaaaagaacacattgaggacactgttgtaggtcaggaaattgaaggtagggagttgagggcaagtagaagagagtttcattctggagttagttcagtaaacattgaatgctcatgatgtgtcaggctttatgctgctaccagaggcaggaagataaataagacagaacatgcagacttgaacagtacggtgtggtaagaggtgtgcccatggtactgtgcgattatagactggcgttggcccagtgcagggctagagggatgctccatggtgatgactgagttgagccttaaggcccggatgagctggccaggtagtgatgacaagagggagagggatttaaagtgtgaagttcaatttaaggaacagagatgatgcaggaagggctaagatatggaaggctttgatgaagattttggggagccagggaagaaggggagagatgatcagatttccattttgattgcagcttggtaactggattacagtgtggcagaactggaggctgggagaccaggaaggtttcaaccaagttagaaaatcatttttggtttagaagacagtgaggggctgggtgtggtggctcatgcctgtaatcctagcactttctcaggctgaggcaggaggatcacttgagctca

SEQ ID NO: 38317 - DNA, 1030 bp, Homo sapiens
tatgaattaagttaagtaacagcaccctcttacaggacacaagagaataatcatgtctgtacaggttggcccctggtaagatgctcatttaaaaatggttgtgtcagtttaatataagtgtgttcttttcttgcctacttaaaatgtatttctaactatgacttttcttttggaaaatgattgactttgggggagctctttcagaggtaaaggaagttaactagcagatctaggtaactgaaccttgtgtactattctagaaatgtttatacttctgccaaattgaagcatgagttcagtgtttgcataaccacctgtgcagttactcatagtagcattccagtatgcatttgctgaactatactcttcaattttgcaataaaagtattttcacatgttggctgctactgtgaaaattggtttctctcaaatgttcggaaagcttgtgctgcagttttgatgtggggggtgtggtttagtgctgcataacatttacttttttggtggaagggggatctgtgatgtaaacttttggtttcaatttctctatttggagctctttttgttagtgctaagaattctgagggtatccctatagatgctggttaaaaaacaaacaaagcaatgttgtcattgacagtttggtcaagtgggatgtaagctgctgagtggggtgaagacctggtctccttggggctgatttggggtttgggagtggtttggagggtggctgccattgaggagcaggaagtgtgggggttgctgctgtgtctggaaggacctcctaggggagagctagcaaaccaacatcaccagtgcccccagaacactcagctgtgtgtgatgtggctgtgtgtgcccttgctggtactcagtcctgttaaggcttgaagaggaaggtaaggagggtaagacttggagagggaagagttaaggagggagaatattaatgcagtaaggaagtaattcatattttgagacaggttcccatgtgtgaacacttgacttccaaacagcccacacttggctt

SEQ ID NO: 38318 - DNA, 1032 bp, Homo sapiens
cagacattactcaggaatctcatagaaccccagatgattatgatataaccaataacataagacccacctgattggcagttctgtgaatcaccctaaaatctctactaaaatggttaagtcctgtactctttactctggagtcctcttgtctacctttcagaaatggttgaaatatttagatgtggaattaatgagattttacatgtctacactcttgctttatatattttaatgtgataaatggcctcatgtatgtatattcttccttgtcccagactcatgttttttgagtaaaatctttaattggtcaaaatgtgttgtattgatcagtatgttatatagaatgatgtacttattgatttactgtaaataattacagtggagcaattctgttaggagggttcgtttttgccattttagcaaggaaaatttgccagttattttggctgaatttaaaaccccttacatgattagatcacatgtctatttctgctgtaatagaggagtgtaagtaactaagtttatctgaacttttaggagtctccttttaggctcaaattagttagtctggtgtctatacagggcctttgttaaagactggatttaaatattgggtggatctgtcttggatcctgttctagggaacgcttcttggaagtcccagacggggaactcatcataacctggttttaccccgtagcatggccctgtgccatcgacaccattagagcaaggctcagtgtctcgagctttagtttaattctcaacccattgatcgctcttgcagtcagcttaacagttgaatgcaatgctgtattttgttttttttttttttttttaaagctagtccagaaattaccacagctgcttctcagttaatcagatgcttaagactcccgtttccacattgcttggctgctacatttttataacaccacagctgtctggatctagcttgtgcccctcgccccccttacccctttccatctgccacctctcaccacttcctcacttgctatgtatcgaggtggc

SEQ ID NO: 38319 - DNA, 1050 bp, Homo sapiens
ctaagtgtatctttaatttccagaagttcggattggtttttcttcagaatatctgtctctttagaaaattttttgttcatactgtgaattgttttttcaatttctttatgctgatttttacctctgtcttgtatttccttgaacagctttaatagtccaccttttgaattctttatctggtatttcaaagatttcatcttggtttggatccattgcagaagagctagtgtgatcttttggggttgttatagaaccccgttttgtcatattgccagaattattattattattttttgagatggagttttgttcttgtcacccaggctggagtgcaatggcacgatcttggctcactgcaacctctgcctcctgggttcaagggattctgctgcctcagccttgcgagtagctgggcttacggtgcccaccaccatgcccagctaatttttgtatttttaatagagatggggtttcaccatgttggccaggctgatctcgaacttcctacctcaggtgatctgtctgcctcagcctcccaaagtgctgggattataggcatgagccaccgtatctggctgccagaattatttttctagttccctctaatttgggtaggctattctaattattcttgaatttatttttgatttgacttaaaaattttttttctcccttgaggatgtgactttatcgtttattgtaggctaattcagctcttggtgctttcagggatgaagactgtgtatgacttccttggttatagagagtctttgtatgacagctttcttagatgctggttgtagtagcatagtgcttggtttgtgagcaggttcattgtctcctgtgggattggaattgcgaggtctcttaaagcttatctcattgcactttttaattaattaatttttttctgcagtattttatttactgagttgaacagcttaggcttcaggccagtaggagagatgtccatgggtaaaaatcagttgtggctaaagcaggttggtaaatgcaatactcagtggtgggcagaggtcccagccttgatag

SEQ ID NO: 38320 - DNA, 1078 bp, Homo sapiens
aggccagcaggaaagtgatccaccttccaattacactcctgacccagagttccagctattctgatcaggcacctcttttcatctgcaggaatgttgatgttcaacatagaaagggattgtgactgtacccctcatccaagcttgaacctaggggacatgcattctctgtggatgcagttaccctgaagtattccagaaaggctgtctacaggtgcatccatgctgagctcccatgggggaagcctcagctatgtcgatagtggatgaagaggagaagaaatcaccttctccaagacccttcatgggcaccagggctgactggctgttggggtagagccacagacgttttctgctgagccaagcattgcaactgtgcctctgctaaaagaaacttcccagaaatgggaagttctgggacttaaggcctgccatcttgtgttttttgtttcatggagtgctcccttgatgtcatgtacttcttcttcccttaggagtagaaatccctgaagtccagactactgtgaatgcaactcttatctgggtctagctgcctagtggggctgccacactccagggtggtgctgggggatgtctccaaggaatccagtgatgtgacctgtcctcaagtatcccagcagtgggtaccagcaccagttctgatggggatggcaggggagtgctgtgagattccttggtcatgaaaagccttagtgtgttggttttctcaagtactggttgtagtagtagatgaactggtcacatggacagactcaggatctcttggttagccagggtgttgcaggcaatagtgattgctgaggtcacacatgacttttctccttcctgcatgttgtcttcttctgcctgaagatgctaatctcctatgtcagttggcctccaaccagaaggtggtgcttgcaaaagagtaccagctgtggtggtggtaggatttatgctttgccttatgtacccaggggaagtactctggtgtctcaggcaattggtggggctatagagctccgaaaagtttctgttctttttattaagctaccagggtaggattgaggggcaaagccag

SEQ ID NO: 38321 - DNA, 1072 bp, Homo sapiens
atttcacaaggcactttaaaaaatattgtcccttcaagttttttccctttatttctctccatgattttgtctaaatttaccagcaagtcacaaaaaaatgaaaattaaaaccctactggggactaggagctcgctgaattggcttacatcattgtaagcatggacatatttctgtgcgttgctgtccccaagcccatgcgctgttaagaatatgcattgtcgggacggcggtgcaaggagaaacatcctggagaggacgtacaggatacagaaacaagtgactgctgtgacatcattagtcaacattggttgagtgacagagtaaataaggcatcttctgttataaatgattgacaccgctgaaaatttagaaacatcttgctccaatagcagcattatcttctttggactatgcaaatcttttcaaattaaaaattcaagttaaaagaaactatttttaattgaccctcattgcggccattccttgatcaatatctctgaataagattgttaactgaacaatgcatcttctggcagaaatagagataatgaccgttttgttttcacttatttttcttgttacaaaatttaaaagtaacatcaattttaaaagtctttttgttatacataagttacattttgggaccttctttaatgattgctcatatagtattgctcgctttttgaatcagtgatctgcctaagcatttgcaagtcactcttagcattcctcaaaagttgctgttataaatgataattttacatagaggatggaggaaatgagaaaattgcgtttgtcttcctattgaggtaagacataagcaagtggaaaggtggtttccagccggggaatgaagcctgttgttcatgctgttgtgtgttgacttgtccacttggatggctcctaggatcatgcgggtccttgtgacttccatatgtcacagatcttgcgtacagtttctgtgccttgccctcctcccagtcttttctgccctgtggttatttctctactgccactgaagggtggcactcaagcttttccttatatgagattcatccccttcagggtatg

SEQ ID NO: 38322 - DNA, 1034 bp, Homo sapiens
ctgtctttctgtctatttaacagtgtgtgtgtgtatgtgtgtgtgtgtgtgtatgtgtgtgtgagctggtgcccggtaacaaatacactgatggggctccttgctctcatttcactacaggcggaaaacaacttctgtagagtggattctcctctcacttattatttctgtgcacagtgttagcatagataagaaacagttcctaccttctggaaatttagtttttacaactttatctcttatggaaatgaatgaacttgtttcatgagactactttagctcctgaaatctcagttgaaaaagaaaaatgagaactgtaaagaagcggagctacttgaaaaggccccgctggacacgtctgcaggttggttcgcacagatgtctcccctagctgctgcctcctttactctctgattgatttccccttaaccctgagtgtgaatgtccacttttgtttttcgagtaaaactgaggctctggtttccaaatctaccatcaagattaatttatttctttctgtagttgtagactgtcagcttcctgtttttaatcccaccagcttccggtcaaagatttttgccatattttcttcctgtgtttgagtagctgaaccccctatgtatcatcaaaagagcatggcctgcagttttatggaaacaaagcaagaattttaaaagagaaatgtgatcctagatgaggtcagacagaagtccagctttctgtgtccaaggtttacctaattgagttgaataatggctgtgcctacttctgacagccttgctgtttctttgcataatatctgcttcattgtcttgatgtagacagaatataatgccattaaaatgccagatgatggttttgaaccaagatgaaccattccaaattgccagattctgtaatatcattttaattataatgtcttctcaaacatggttaccccgaagtattaaaataatggttcttaattacaggttcctttgggtaaaatagacaaaaatcatgctgcacttgtagatcttgtgcatttacacgga

SEQ ID NO: 38323 - DNA, 1050 bp, Homo sapiens
attagtactgataataataactaggaaaattaaattcttatagtcatacagatcagaaagatggtatcagaactaggtaatctaggtttaataggttatctagaatgtagagtagcgaagaatttggcaagagatctagactctcaatcccttgtcaacttctttgtttttgcattttaactttgtattataaaatagcccccacatattagcagtttatttttgatgttcagaaaaaaagagggctgtacaattgtgacttcagaatacatcttaatgctccactaaaaatacaaaaaattagctgggcgtggtggcacgtcgcctgtagccccagctccttgggagcctgaggcaggagaattgcttgaatcgggtggcgaggttgcagtgagctgagatccaccactgcactccagcctgggtgacagagcgagactctgtctcaaaaaaaaaaaaaaaaaaaaaaagctttaaaatcagaagccaaatgattggttaattgtgatggaagggattttcagtcctttgatctgaaaacctgtggatataccatcctggtatatcctctgtagagtatacctctgtagagtatgaagattcttttgatggtatggaaggcaagttagtcattggtgagatgacagcacagtggttaagacacgggatcatgagtcacactggctgggtttgaaccctggctctgcctcagctagccttgtaaccttgcatatttcaaacttccctgtgcctttggaatgttcatctgaaaatggggttaataattatacctctcttctggggtaattatgaagactgtatggataaatatatttaaagcgctttgtgttagtacataaaaatgttataaatgcttgctattttcatatgcttaaaggtcttccttttttttaaatgaacaattatctaacatgacaagttttcttaattgaaaagaaaaataaagttagaaaatccttatgttacagaaaattttggatttcctgagactagttcatggatttttttctgtgatgctcttattttatc

SEQ ID NO: 38324 - DNA, 1050 bp, Homo sapiens
tttaagttacctggctccatgttttattctcctaatggtctatgagttacttgatggcagagcttatgtattttttcatcttgcttattctcacagcacagtgcctagtatgtatgactggatacttcattgattgattgattggttgacagggtctggctctgttgcccaagctggagtgcagtggtgcagtcatggctcactgcagcctcaaccacctgtgctcaagtgatcctcccatctcaaccaggactacaagcgtatgccactgtgcccagctaatttttaaaaatttttatagagacgaggtttcactatgttgcccaagctggtctcaaactcctgcactcaagtaatcctcctgccttggcctcccaaagtattgggattataggtgtgagccaccatgcctggtcgcttgaatgctttttaggcatatgttgaatagaagacaatatgattggagatgagagagaaaaaagctgtggtatggcaaaagaaatcaagatttgaatttagaatatctgacttaaaattaaactcgtcccataaccttcaataagttactcaatttttttgaaatttatttttttcaactgtataggtaggaaaaataaagctatgtaataactatgtttagctgacaatatgtaattcttactgggtgtctggcactattttaaatgttttacataaattaatacatgtaatccttaaaataaatgatgcagtaggttctagtattacagatatggaaaacaaagagtaggaagattaatttgcctaaggtgaccatgaggatccagtgaaacagtatatgtgaaaaggagtttgtgaaaagctacataaaaatattagatatctttataatttccaataggatactaatcagttttgaataaaagacatattctagagaaaccaggtttctggtttcagatttgaactctcaagagcttggaagttatcactcccatcctcacaacaacaaaaaaatctgaacaaacagaaaaccaatgacttttcttagatctgtcaaagaacttaagc

SEQ ID NO: 38325 - DNA, 1053 bp, Homo sapiens
ttttgagattcatccattttgtgtatatatcagtagtttattcccttttattgctttataatattccaagatatagatatattgcaattttttttttttttgagatggagtttccatcttgttgcccaggctgaagtgcaatggcatggtcttggctcactgcaacctccgcctcttcggttcaagtgattctcttgcctcagccttccgagtagctgggattacaggcgcccgtgaccatgcccagctaattttttagtagagatggggtttcaccatgttggatgggctggtctcaaactcctgatctcaggtgatccgtacatcttggcctcccaaagttctgggattacaggcatgaaccactgcgtctggccgatatattacaatttatttacccattcacctgttgatggacacgtgggttgtttccagtttatagcattgtgaaacaaagccagtatgaacatttgtacatgtcatagtatggacatgtgttcatttatctgggagaaatgacccagaaatattgctgggctgtataagtgtttaattttatgttagaaacagccaaacttttttcaaagtagttgtaacattgtcctcttacattcacaatatatgagagtagtttcctccacacccttgctcaccctggggattgtcagtccttttaacattagctattctgttgaatgtgaagtatctcattgtggttttgacttgcatttccctagtaactaatgatgtttaaaatcttttcatgtgcatactggccatttgtatgttttcttttgtgaaatgtctgttgaaaacttttactctttgttttggcttgtcatcttactaagttataaggttccttatattttccaggtgcgagtcctttgtcagatacatgtattataaatattttctctcagcctgtgatttttctttttcttttctatttatttatttatttatttattttttaggaagagtctcactttgtcacccaggctggagtgcagtggcaccatcttggctcactgcaacctgtagctcccgggt

SEQ ID NO: 38326 - DNA, 1034 bp, Homo sapiens
gctaattttgttttttgtttgtttgttttgtagggacgggattttgccatgttgcccaggttggtctcgaactcctgggctcaagctacacccgcccgcctcggcctcccaaagttgtaggattaaggtgtgagccactgtgtccagcagatataatgtttttaaaagtttgagagttaatatgctctctggtgtgccctaggtcccactactcctattgccttaaaactcacgcagtacacatttgtcttccatgggcttcagttgtaagagaaccctttctactctttgctgttcacaagtctccttttaaacagagcttgttcccaatgctgttttgttttgccctctgccatgttcttccggccatcacctcctgtggggaaaagagagagagatcacattgttactgtgtctgtgtagaaagaagtagacataggagactccattttgttctgtactaagaaaaattcttctgccttgagatgctgttaatctaaccctagccccaaccctgtgctccctgagacatatgctgtgtcaactcagggttaaatggattaagggctgtgcaagatgtgctttgttaaagaaatgcttgaaggcagcatgctcgttaagagtcatctccactccctaatctcaagtactcagggacacaaaacactgaggaaggccacagggacctctgcctaggaaagccaggtattgtccaaggtttctccccatgtgatagtctgaaatgtggcctcgtgggaagggaaagacctgaccgtcccccagcccgacacccgtaaagggtctgtgctgaggaggattagtaaaagaggaaggaacgcctctttgcagttgagacaagaggaaggcatctgtctcctgctcgtccctgggcaatggaatgtctcagtgtaaaacccgattgtatattccatctactgagataggggaaaactgccttagggctggaggtgggacatgctggcagcaatactgctcttcaagtcattgagatgtttatgtgtatgcatatctaa

SEQ ID NO: 38327 - DNA, 1071 bp, Homo sapiens
ttgaacctgagaggcagaggtttcagtgaatcgagatggctctaatgtactccagtctgggcgacagagagattcggttaaaaaaaaagttcgacttaaaataattctggagtcagaatgggtttacatttaattcttaacccagttcctcaaagcctgtagctctgttaagaaaataaaggccattggtcaagcctgcttggtcccaccctcatctccccaccctcccccaatcgctgctcccgccatttcctggggcttggaggaggggttaaaggagcggactgtaggcgtcacatttcccgcctgcgcgcttttcagtctcagtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcatttctgaaccaaaggcccttttcagggccgcccaactaaacaaaagaagagctgtatccattaagtcaagaagctcaatgtgtaattaagatgaatgatactgagctgacatcctaaaaaggaaagattaggggaactccaagtttgccctccactcactacatatgggtaggggagcaacgatattccaactctgaagaaagagtggaaaaaaagtagtgttaaaaatttgtattagtttccaagggacaaagaagcgctgcccaatcaatgagggccattcgtagctgtcaaccaatcagaactgatgagct

SEQ ID NO: 38328 - DNA, 1050 bp, Homo sapiens
acaggaatacagcgcattcaacttgcaaacacccttccactcccacaaagagcaagctgtcactggccaatcaaaacaatgaaccataatgaaacagtttttcttgctccacccacttggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgacatcctgcataagaatgaattgtgtttgccatgaccggccacactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaacttagccgggcgtggtggtctgcacctgtaggcccagctagcccggaagcagagattgcagtgagccgagatcgcgccactcccctccagcctgggagacagaga

SEQ ID NO: 38329 - DNA, 1050 bp, Homo sapiens
gaaacgtaaaactgacagacttgggggggggggatgtcccaattagcacggcttctgtatgcaacgagtcccatactttgttaaaggaagaaaggaatgtgagttctcctaatctgttaagtatctttcggtgtaagttctgacaccacaatgttaaaaaagtcggatctcaaaaaccaactgctccaagcgaagtgcacagctgtcttgcctaaagaggcctatttatagtagcctcgggtagtctggtctgggctttctcattgggtacaagtaaaggaacgaaatagccaatgaaaaggtagacttttaagtgtcgtttacattggcatttgtgacgacactctaaaattaatccaatcataaacgaaatctgattaacctcatttgaataccgcatctataaatgaacagggcctcggcgggagtgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattcaaaaggggggttattggacttagcaccacagtaccaatctttaatgttacgttagtactgcagaggaaataacttggaagttacagggaataacaatagg

SEQ ID NO: 38330 - DNA, 1027 bp, Homo sapiens
agcagcaaatgattttaaacatgttaatgtatttaatctcatttagttgttaaaatatgcctaaatttcctctttgggaacgcaagacttgcagagatgactccatggagagcggactctgccggcgggaactggagtcgttggtgacgtcatcccagtctgatctgtgaagggtagggccagcaggcagcaccaaagttcccgtatgcgcgttttcagtcttcatttaggtccgaattcccggcatataagaatactaccgtcgcttgtttttcagatttttgcggctattttcgttggtgtgttggtcatgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctctttataagttaattgttcctgtcaacaggtacgtatatttttcagccgttttttttttttcgttccaaattacatttggggtttcggcatacgattttttaggctacgatccttttatgtttattgtagtagggccttagattgcactgaaaaggctagggtaatagtgtctgtttaccttaccacttttattttgagtacctaaaaatgcatggttttcgacataagtgggaaaaccgcaagacactgcgtaaccgctcaaaatggcggagagcgaagaacaaagccggt

SEQ ID NO: 38331 - DNA, 1180 bp, Homo sapiens
ccatggccttggatgagatgccagtatcggggtgaacctgttttagcaccttgtacacatacacggagtagctctccttacgactgcgcttgcgcttcttgccatccttcttctgcgccttggtcacagccttcttggaacccttcttcggagcaggagctgacttagctggttcaggcatgctgtcagaaaacaataacagcagtgagaatgaacgcacttaaataaaagctcgtgtctagagtctctccttttataggcctttcatgcaaataaagaattcaaaatatccagctctgattgggcaatgtgttagtgacgcatacatgtaaaatagccttcaccttatttcctttctaattggttggctcgtcaaagaacaattttaaccaatcaaattgcgcctttcacaattctaccgatgactataactagcttcttattcctccatcgagcccattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaatctcaatgttcactgtcctaatttttaacgaacgcttctgacgttactggtcagttctttattgaaatccttgctcacatttcatgcactaatttatcttactggtgtttctttgcagtaaaaatgcgtttataaaggtatacaagaatagaaaccgaggttg

SEQ ID NO: 38332 - DNA, 1045 bp, Homo sapiens
atatcaatatttaaatgcttagttaatagaactattaccaatgagatatttgacattttgaaattttaaatctttataatctgtgtgtgttttacacttagagttcatttttattggaactgttaaatagctagtggatagataccctaatggacagttcaagtttacactacactcaggcacagtgctagattgcaaaatggaggaaaatctcaggggcacagggtgcccagggcgggctccccaatgtttccttcgtgaagcaggagcagcctcaatagttactgctcccaggggttggtgctgccgaccagccacagctactggtccccagaagggttctcagcccaagaacccctgtagccttggaatatctgcttcctttcatccctggagttttttttgtttgtttgtttttgttttttgttttttgttttgccttagagttgtgataactggcatccttgtctgattctgcccttgttgaacagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggtgcatcacttcattttgctttattacttttgcacagtgtgacttttggggaaagtttctcccttaacctcaggcccattgcagaccaacggatttctatctggcgtcccctttccacagagaaagtggcttcctcttgcacaaaggccacatgagtgggtttgccctgctaagctataggtttcacttctttttttttttttttc

SEQ ID NO: 38333 - DNA, 1102 bp, Homo sapiens
gatttttattaaagcacaactaaatacagaaacaaagttatctataattcctgctaactccacagagaaagactaagaatttagctgggaagaaattggcaaggcttcagcatagaaatgcacttaaactgggatttctaatagtttgttaaaagtgacactaagtgattacctcagtgttgcagttagtgtattttgctttaaaaggtatatttcaggactgaaaaaagcctttaagttgcagaataattcgtggtgacatttcagtccatcagaccagtggaggcaaggactaggaaattgggttcttcccagggggccccaaatcataacaggtaggagaccctatctttgctactcacaaaggcaaccttacatctgattaaaacagaatatcgtggatggagggcttcttgacccattgtcatgactgtgttcacagcagcactgcaatgttgcccagtaatgaatggttgtatgtggcagggacccactactctttctctgtaaaaccaaccctgtcctggccttccctagtctgaattgggttgctgtaggactttttgtttgcttgcttattgtactctgtttgttggattggttggtggctgatttttcccttaaatctattgtgtcatgcttacccgtattgaacccatggaatgttttgtaggactttgttttccaatttgctgaggtattttaatttcttttctaattcaggatttctgtgtgagccttcaaatgcacaactagcttttttctcctgacaaaaattaaacagagcagaaagcactaggcttaagtgattgctttaattttctttctttaacataatttgttgggagactttacaaaggaattattcaggagaagtttggatgatcacgcatggctgaagggtctcccaggaccatgcttttgcagctctctcactctgggtattctctttcattgaaggttctagtaaagatagaatatatttaggatgagcctgaattattaggatttttggtgatgatctctgacattgaggaggcaatatggttatcttaaggatcccaggggcatccagatatttctaatacattgatgttcttaa

SEQ ID NO: 38334 - DNA, 1073 bp, Homo sapiens
acagcctggactcaaagcccagcttagaaagaaactactcatgtggccttggggagttatttaacctctctggacctcagattttatatctattaaatgtgcgaaataaggtttctacctcttagggttgtcatgagtcgtattaatacatgtaaatctcttagcacaataccagcatggtagcaggttctatgtaagtatttcctagtattaaagttagtaatcaataaagtctcctatcccccattgccaagccaccataatttcttgcctagactgtcacagtagcttccttcctggtctccctatctcctaacatctggcccaccggatgaggatgggatatattgtgcaaccccagcagacatcatcccatagaatacaatgtaaatggcacctccttcctcccatcttccctgcacctacctcacttctattttaaacatacacatttcctcatgtcaaacttttcagatattttcccttcaccttcccactaaaactccaactccacagcagacatctgttgatgttgtctccaggggaagtggatttaggactcatcaatgcagggatcagaattgagcctttcagaatggaagacaatgaaattcattgagggttactacttgcagggcctgtgctaactgctccttaaataacttatggaacagatctcatttctgccctacagatgaataaacagagaccttgagtaattagttaaccggctttgggttccagggctaatgagttgtgaatgagaacagatgaacatagaaaaaaaaaatctcgagacagtagatagtaaggcagtgtgccttggatgtgctgacagatatctagatacagcataaagaaaatgtgtgttcatgagagttcttaatggcaacaagaggtagcatgatatccatgagaaatggacatttgttgatgagactaactaaacaaaggagacggatttctgggcatttttcaacacctattgcatgcaggacactgcactaggtcttgtaaaagacaaagagaagatagcatcaagggcctaggtcttgaaggagggctgagtacac

SEQ ID NO: 38335 - DNA, 1024 bp, Homo sapiens
taaaaatacaaaaattggctgggtatggtggcgtgcgcctgtaatcccagctacccaggaggctgaggcaggagaattgcttgaacccgggaggcagaggttgcagtgagccgagatcgcaccactgcactccagcctgggtgacagaacgagactctgagactctatctcaaaaaaaaaaaaaaaaaaaaaaaaaaactggagcaatttggagacaagattaaaaaaataataataacattgtagaatggtggccactcacaaggttacagaatttcccagtaaatgttttcaagggtggggcagaaggtatgatagacaaaagctttaaaaaagtcacacagtgcccatgaatgccagccctaggcctaagtcctaattactcaaactcaaactattttccatttcctacctgtgtggctctcaatctgtgctctgggctacccacattttttagtacttttattaattcttgagcagacacatacaatttttctgtgtaagacataggtaatactccagccatgtgcttcccctacagtttaaagaagagaatgcaacctcccccatctctggactaacctccatgccttctccaactacatccctttcccaactcccaagagatgaccactgtccaatttttatttatccctttttttttaagttttactatatgtttgtggcctcaacatgtcatagttttacatgtgtaaatggatctatagtgtacatattcttctgcaacttgctatttttcttcggcattatattcttgagattcatcctcgtttttgaacctacctgtaatctatttgtttctgctgctgaatggtattcccttttatacatactaccaaaatatatgcatcccttctactattgaaggacatttgggtgatttacaggtttttgaaattacagtgttgctagaaacattcttgtggagatctcctgtccacacctccaagaatccctctaagtaaacacctagaagtaaaattgctttacacaataccactgt

SEQ ID NO: 38336 - DNA, 2139 bp, Homo sapiens
gcagagtgctttacaaataaccactgtttccaaaagcaaatacactaattggcacacacacacagcagtacataagggttttgattgctccatatcagctgagcccttgatattgtcagacaacttggttttcctcagtttgatagatatgaaatgttatatcctatgcttttaatatgtacttcttatatatttttaggtgcttattcctcactcatgcttccaagaagtacctgttaacattttttgccatagttttaaaattttcattttgtcctttcctcatggatctataggaatgctttatgtattcaggattctaacattttgtccattatatattttacatatatctttgccaagctggtacttattgttttacttttattatgctatcttttttgatatacacgaattattaacaatatagtcaatttgatttttaacgtttacattcgtcagtctttccctttatggtttacgctttttgtgtcttgttaaagacatctttccaggaacagcgtgaggaggacagaagcacccaacaggactgctcaagccacctgcgaacactgctgctaccatgcccaagagaaaggcaaaaggagatgctaaaggtgataaagcaaaggtgaaggatgagccacagaggagatcagctcggttgtctgctaaaccagctcctccaaaaccagagcccaggcctaaaaaggcctctgcaaagaagggagagaagcttcccaaagggagaaaggggaaagcagatgctggaaaggatgggaacaaccctgcaaaaaaccgagatgcctctacactccagtcccagaaagcggaaggcactggggatgccaagtgaaatgtacatttttgagagctctgtacttatagtgactctactgtttgaaatactatttttttaaatcaagttttataaaagtgtagaattttggcttttttaagttatgttgttagcacacaggacacttccttgttgtcttttgtggaaagggcaagtaccactaatagggtgtatctcagaaactgaattgaaataagggaaaataggattttctgtcctggtttttgaagattgttcttgattcccttgattcccaggagagattctctgacattcacgtgtcagccactttggcacggaagccttacagtgtggggaaccaaaacttcgtgtctcccctttccccgatgccatcagcatagacttgacttccttaaaccgagagttttgatgtggccttggcaaccctaaaatcagctgtgttaggtaacaaaactcaggctttctgttgatgacatcgagatggtgtcacttaaaagagccaagattcctgttttcagtttgtggattcatcctgctggttttactttagtccctccatgtcaaagtgggcctgagaaaagctcatacatgcctcatgtgaagtgtccaccctctctgaaaatctttcttgttcaaaacagcaacgacatatcttgttaacttttacggtgacttttggaggaggggagtttggaaattgtaaaatgttatagattgttgcctatttcctgctgaaagtaaatgtttttaaaaagtatcatataaagctgaatacaaattggtttggggggagatcctttcctacccaaagtcataaatatattctttactgccttgtggaaattttatagttttgcctttcacatttgtctttagtctgtcctgaactgatttttgtgaaaattatgagttagaaattcaacttaacatttttcatattcgaagtggttgtctctgcactatttactgaaaagttcatcctttccccagtgatttgtaacactgcctctttcataaattaaatttttgtgtatgtgtgtgggtcttttgatggtttctattctgactgacatcaatttgtctaatcttgtagcagtacagtacagtcctgattattgcaactttaggaaaaggtctgataaaaaccaagatgcctccacattttgtcataattgtaaccaatttcacctctgtctccagtatcaccacaaaattgttcttccttggagtgtcttggctattcttagccaactgttcctccatattacttctagaattagaccaacaatttataaatc

SEQ ID NO: 38337 - DNA, 1045 bp, Homo sapiens
gacattttcttgagggccatatagcttggcaggaggggcaagaattgatgggttatgagaacaagagaggaacgcctcactgggccacagagagggtccaggaaattgtttgggctcgaggacctaaggtccttgggactatgcttggagccacattggtaaccgggtctggagttttgggagtgccagtgcaggggtcactctggtaagcatccaatgacactgacttttaggtcctggaaacattttgcggcctatcaacacaaattggtgagaatggggaaaagagggaaaatgtagagaaagtgactggaatgcatgctaatgattcaggttacgtttacgtcctttgagtttcatttcatcttacctataaaaccaacatagacattgaaatctagaatcctaatcataccaaagaaattatgtattctcttagtgtattgggggaagagctacgttcgggtgagcccggctagctcagtcggtagagcatgagactcttaatctcagggtcgtgggttcgagccccacgttgggcgctctggttttcaatcctaaaatgttttcaggtttctcattgcggtccaaaaaaagggcattattaaagctcatccctctggaagaagggaattgtgtgatcatcgtgaccattttagccttactgacttgactgacgcattccagccttctctgaaattctagctgaacttagtctcagtgatccctggtgtggatacacttctctggcctagaggttttgtaaaaccagatatacttaaacataggttatgtaagtcgttggtagggcatgagctcttgtatatttaacaagttcctgggctgattctaaagcacaaatcccagcaaaaaaggtttaggaggcaggaaggacccatgaccatgagttaaaaaagcataccacacacctcttcgttgatttcaaaagcccaattagccacataccttcctctcacttcactaacatagttctcatctcttcaggtctcaggacaatataaagaaaatgctctagctcaggtgt

SEQ ID NO: 38338 - DNA, 1001 bp, Homo sapiens
cctgccttagcctgcccagtagctgggactatagacgtgagccaccatgcccagctaatttttgtatttttagtagagatgggttttcaccatgttggccagactggttttgaacttctgacctcaagttatccacccaccttggcctcctaaagtgctaggccacagcacctggcctctactctttataaattaccctgtctcaggtattttgatacacagcacaaatggattcattatacagagtacgtccagtgtctgaaaaaactgctttaaagccgattgtagttttaaaaatgagtatcaatgtaattaaaactgagtctccttaatgcaacaagacttgaaaacccagaaactttcaggacacattattttaggaattctagaagatgaagggctaggggtcctttcgatagctcagttggtagagcggaggactgtaggttcattaaactaaggcatccttaggtcgctggttcgaatccggctcgaaggacgaaagttttgaactacgggctaataattccagaaataacggaactttacgaaaatcaggatctagacaggaagatgtattagactgctgtttaatcctttctttaatcccctttgtgatacaggaagtaggactctgttaatcacattgcagttccaccacttgaccctatgggtaagccttgccaaaagggtggttagagactccaaggctgaaggtgggaaagtgaacttgttttctttctggggccttcctgtttctctaggtgtcaccccagtaatcctaacagagacaacaattttgtagcagccccgtcttgaaatttcacttcttattggcatccctgtagcttttccgcctggtgtctaaggcacagataggacacacaataatgtcaggagagactgtccacatcctgggatccctcctctctagctgctagctctctattaggttagaaacattgaaagttagcatatactattttcttagttactcatgc

SEQ ID NO: 38339 - DNA, 1077 bp, Homo sapiens
cgcctcactggcttctcataggtacctgggtcaggacgaagccacatagttcctcgtgatgagaaactcacttctggcacctgtcgagatgccagattccatgccaagcccccgaagattctgactagtttggcaaaaaatgggatctggcaggtccacttcaaagcagcgccctcttccttttgttgccaaagatctgaggaccacactgctaaactgagcaagaaacatgcgtgggttggagatagaagtgagaataatgagtttacaagcacagtattaccaacccccaaaaacaaccaccacgctgggaaaattccatataatgaaacttaatgtgttacctttggcttctttgccataagcaaaatattggggacggggagtggataaggaagtaaactgggtaggtgtgtaaataaggacgaaagactgcaccattctttagatgacaaaaacagacgtttctgggaaataagcaaaggaagagccccacaagcagcggcctctggtggcgtgccgtgatcgtatagtggttagtactctgcgttgtggccgcagcaacctcggttcgaatccgagtcacggcagtaccttgatgtcgcctcaatttctcaacgtactgagcagtaccttgacgtcgcctcaatttttcaacatactggagtggagacagtctcggaaaaacccttgcaaaattgaattgacttacgatctaatctgtacacaaaaaacactagtattcatcatggtgccccaaccagtcagccaagcagagagtgtctacgcttgttgccttgtcttttttttcccctctccaaagattctcttcccaaccctacccaagccctacagtcttgttggcattggctgtatgtgaagaaactgaggtaatttttttttaatggaaaacttttactttcaaacactggtaggcatgaggaaaggactgttcaaaaggggatccaggtttgttgtggagatctttcttaaaacacaaaagacaaattattaatcacgcgtttctaagtatcctagctggaccaatgctgaaaaactgtaacctttgatcatctg

SEQ ID NO: 38340 - DNA, 1021 bp, Homo sapiens
gactcccaaattgaggatctagacataagaaacctgggacgatctcgatcatgggaccatcgagaatcagactcgttgggaatatccttcaagtaccaatttgtatgttgtattagtgagcggcttttacgaagcaaagactcattaatatttcaccgaatctgattcattgtctgcatgtattgactagacattcagaaggcagcaaatatttccataaattgctgggccattagccacagtttgaaatgtttaagcgtcctctttcaagtctacgaatacagccattttgctttgtttttgcgttaagaggaaatttctcgttatttctattaagactctaaagcaactaagaaattgttcctccctgtaagacaaacaggaattacgttgaagaatttaatactttcacggagaaggggcgaggatgcgggtgagatgaataacaaaagcacagatttgcggtcggccggttagctcagttggttagagcgtgctgctactaatgccagggtcgaggtttcgatccccgtacgggcctttggctttttcccccctcgagaaatttggttttcatgctctaagatgattcaaattaaccgtccccatttcttaacgaacctagaacctaagttcgtttccgaatcatctgaaatgctacatctccccaggtaataatcttcttcttcttcttcttctttttttaaatgttctttctgtttcctccaggaataagggttggggacagaaagctgttcagagcagagacctccaagactgggagcctgcttaatgaaagggggggggggcggggaagagttcaaggagtggaaaaataactggcattttttttaaaaaaataaagcttatttgatttcagattttccttccaaattagtcctgaaacctaccttctttctcaaattgtagagacacaagataaagagaataaatccttagaaggttgtggatatgtgtctctgaaaaccctttcgaatttaactgacagacgacattgtcc

SEQ ID NO: 38341 - DNA, 1123 bp, Homo sapiens
aggtatctgactcaaatttctcacctgtaaaatagagattatgggtcccatctcacagcgtggttgtgagcctcacaggtaaggtaacaatagaaaacacttgtcacaaaaactggcacacggtaacctggcatactgtgtgcctggcacctggcacacagtcttgtttaacaatctcacttgtctaccattgatgaaatagaggccgaggcccggggcgccaagctcctaaagcacttgaaaggagtggtttaggattagaggactcctgacagttggaagtcaacgttttccattaagactgtggtgtaaaaggtgttgaatgtaggcatgtggcaggtaagcgtcttcttgacttaatcctccaagaggaaaagcagaatgcacccatcacccaaactatggggcggagggaaggaacctaaagtggagaaataggtcacctatgactttaggaaatgctagttcagcttcaggttccatggtgtaatggttagcactctggactctgaatccggtaatccgagttcaaatctcggtggaaccttggatttagtcctctgcagtcaaatccccatcgtctctccacaatctatactgttgctcatacaaatcactcgaccaaattttattcctggtatttccacgtcacatctcttgagcggagtatctttagctgccaaccaaataataactttctttttgctgcgcacaatttgttctttggagaaaaaagagagaagcctcaaaaggaaatgcacgaggcagtcgctcgagtcctgctggaactgcaaatcaaagtctccagaaaagatctgcaaacaagtgaggagacaatagataggaggctagtgagaagagagaaaggaaatttggtgatagtcacgaacagagaaaagctgggatggaaactgaggaaaggacttacccactaaatgggtctgggagaggtgacagtcgccgaagccgagagaaaactgtcctcagacaagaccacaaggggatagaagctcaacttgtgagggctgggcagatagaacaggtgacgggaaagatacaactggcgatagtcaatagtcaatagagatagatgctgtttcgagtttgcacaagcaagttttac

SEQ ID NO: 38342 - DNA, 1032 bp, Homo sapiens
ctgaggctgcccaggcagttctgctgattgctttgtggattggcaaaggctccaggaagcaatcaacctagtgccacaaaacaaagcacccagagaagccctattcctgacccttcaaaaccttcttccttctgaagggggtagaaaataaaggagaattatccctggatcaggaattgattataggagagacaagcaatgtcaaaagaattttagataattagggtaactgtggtggccagcgctgttagtgctaaaaagtttgagtcacataaaggaatagcaaaccaccaggttggctagggctgcagcatgttgtgaccacttaagagaataatgattttgtagggatacagtatccagagagcagtaaggtgactcaaataatgaaagtatgaggaagaaaggagaaaaggagaggcaactttccacattatggtggaggaatcccttggatggactctggataaaggtatagccctaacctcctagcatctctgaaatatgtttgggggctatccctgaaacttttgtcacatccgctagacttccttttcccatcttacatacatcctccaaagccaggaaaaagaatgcatctctccatgctctagagcagcagctgctgaagggagactcataaatcctctgacagcatctttccttaaacatacaccatcacagttttcaaattcattgatgtgagatgagcacagcaatagcatcatctcccttatactatatatgatattctttattgtaaatgttttgccatagtttaacttgcagtattgatgaaagttttgtaagaaaagacaagcacatgctagtaatggtgttttataatgtgggacgagatttttcagaaaagtgacttgaccaaggaagtgcagctgtaagcagtgtcatctgtcttctattttgaccctcaggaagaagtaaggggactagtgccatagtgtctttgaactcataccccatatgaagagaacgtcaaagaggctggatcacctaaagggtttagagaaagtt

SEQ ID NO: 38343 - DNA, 1045 bp, Homo sapiens
atcgacaagctaagttacttggagagcagtcccctgatttcatcatgttctttaacttggcatcacatttgccccctcctttcattcctcttcgctctctttttcgagattcgtttctccctgcccatcccgcgtccttgagagaacatctgaggggtgattatcctccgagtgggtgagagagtacgtgtggccttctcctgccatcttgtggcaaaaaagcaaaagcacaagttcaaggcgttgtgttttccagccccagttaaaatgctttcttcttaactttctactgagtcagtgggctagggcagggtttccatttttcactccttttaattgcaggattcaagtttcttcaagagttgttagtgcggaggttaaaagggagcgggaggggggcgggggagttaataggaagagcgaggagtgggtaaaggagaaagtcctgttgagctttgtgatctggtcagagctgtccaaaagaaataaacaaataaaaaaagccaaaatgctttataccctaaaataaataataatacgatcgtgctttctagttctattagattaagtccccacacttacaactcaatttaaccttaattatctgtttaaaggccctgtcttcaaataccaaccacactgagggctgggacttcgacatgaagttgttttcttttgttttgttttttgagacagagtctcactctgtcgcccaggctggagtgcagtggcgcaatctcggctcactgcaacttccacctcctgggttcaagtgattcttcttcctcaacctcctgagtagctgaactacagacaggcacctgccacagcgcccagctaatttttgtgtttttagtacagacagggtttcaccatgttgtccaggctggtcttggactcccaaagttctgggattacaggcgcgagccactgcacctggtctgttttgggggaacacaatgaagtccataacagcacttaagaccattttccatgctttcatcccgactttctattccaagttctcctttataaaatatctaca

SEQ ID NO: 38344 - DNA, 1047 bp, Homo sapiens
atccatgaagtgctccctcctccaacactttcccagcctcctattcacagctccagcctccccacgtccgatatctacccccaggggaccgttactattgacagcgagcgcgcggagctgcatgggcacacaaggcggaggggacaccaaggtccgttattccccagcacgttcactgccccagcgacagcgcaagcctgaggcacgcagacgcgggaggaacccgaggcacagcacacagcaggtgaggggcgtggtactccggtaccctcagtcggccgaccatagagcttgtagacctccaggactcctagagagcttccggaagtgcctttggggcaagatgcgtgctggccggtgttgtgcctccgcagatttagaagttagtggccggaggggcctggtccgagtacagctttcatcgcctttactccccgaccttccttcgagtctgtttatccgttgcagcctcccttccccacgacggggcgcctctgcaactcacagtgagtacggtcgggctctgggccggaggaaagtgggtgctttgtggctggtccaggccgcagctgaggactggcctgaggggtccggagaggggcctgtgcggtgttcggcgccgcggaccgattctgacgccttagttgctgttgcaggcagagtacgtccccacgaattgcccttgaactttttgcgagggaaccttttatgaagctttcttcatagataatcgtgttgtggtatgtttttgtagtcgatcttgtttatcttaaaatggggaacgccccccccatgttattttttatccaactatttccagagtctgaattgttttcacttagcgctcttttgcgtttaggtcacaacaaaattctcagtttttaaaaaagacatattttgcttttggaagccccgtttatccatggaaaccaatttttgctgttactcttctttctttagtgtattcagaaactggtggtgtgttgactagataattgtacgaaagtttttttttttttttaatttcagggtaattcagaattcaac

SEQ ID NO: 38345 - DNA, 1043 bp, Homo sapiens
tctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacattgaaatgtatacagatgtactagctaaagtctctttatgtgtcagtattaagagtaatatgtagccagattacttaaatctcagaattactaagcatgtggcataaatttggagaaaataatatgactagaaaaattagtgttatattgggtgtgagaaaagactgtgtcttgaaagaattatcaaagctgatacagcacatatacagaattagccaaatggtataagacaatagaaaaaggctgtggattctttgaggacatcactagaaatcattctttgtctcaagttcacactcttagcatagaatattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggt

SEQ ID NO: 38346 - DNA, 1027 bp, Homo sapiens
agggagcagctgcttcccggcgggtgcagagaatcttccctcgaccgagggggcggggtccgtagcggaggtgtcggccctggggcctatgagagtgatgaagctgtggatctggtaaacagagtacaaccttctgctgcatatttttcatccattcagcgcaattttaagtagatattaaaggtaggcgccaccgagaaggtaatatttgagcagaaatctgaaggaggtgggtggaaagacctaagtggcttttgcggtcaggaactttctaggtagagggaatagcaagtgcaaaggtcttaaagcaggagcttgcttggcatatttgaggaataacggggagaccagagcggttggagcagtgaacaaaggcgacctttgtagggaatgatgtcagagagattggggtatggagaggaagagtgtagaggaaatgagaactgtatcgtgtaaggaattttgtctttttttggtgtgtgtttttggaggattttgagcagaagaaaacatgatctgacttatgttttaaagcttctttacttggagactcatgatgataatagattgtaagtgggcaagaatggaatcaagaaaacttaaaagttaagagtaattttttaaaattccaagtaattcaggtgggagataaggatatcttgagccagtgatcagattatgatctgctttgaaaatagagacaataatatttgctactgggtcagatgtagggtgtgacagtaagaaggcaaatataaatccaaggttttgggcctgtgggtgcaagagatactggagaaaagatctgaggtttagctttggtacctcgtgtaagttcttcaactctccccgtctcaatttccttctctgcacgaagaaattaggaatagtgtcttctttatagggttgtgtgagggttaaataattaatatatgtgaaacatgtagtatagttgtcctggctcattgttttattatgctgagacatgaagtgtgagtgggcattaacaagaagaaaattggagggt

SEQ ID NO: 38347 - DNA, 1034 bp, Homo sapiens
tttgaccaaatatctgagcaccctgtggccagttaagttgacacataaaattaaccattacaataccaatcttttattttctggctaataatcatcactttttttgagacagagtctcactctgtcgcccaggctggagtgcagtggtgtgatctcagctcactgcaacctccacctcctgggttcaagtgattctcctgccttagcctcccgagtagctaggactacaggcgtgtgccaccacacccggctcattttttgtatttttagtagacacggggtttcactgataatcatcactttcttggacttttttacttatattaagaatactaggaattggctttttaaagtttaagttcattttgactaagaaaaataattatcagctgggaaatgttaactatatacacattcaggaatatataacagcaaactgtttggaggctaagccactgattaagtgagccttctcccgttctcccacttaccgcatgcacattgattcaaaggcatgtgtcagcagctgacagatggtgtttcactgatctatagggatactcaagcatagtcaaaatcaagaatgctaaatccccacataccaagggcctgccccaaaggatggtagggaattgtctgagttcatttttgacatgttggatttgagaggcttctgtagggtatcctggtcccaaataggcagaaggaaattcaggtctgacacttgagatatctgacctgaagaataaggaaatcatcagcataaggacagtaattgaagtcacaaaaatacttatactctacattagccctttctagtttctgccctatctttcttgttccattcaatgtattacttttttgaaatttgtcatttatgctcactctccattttctcatttcctatggcaggctagctattctcactaccaaaattaccttcacagaggtcactaatgacatctttgtttttgaatcaagtgtctatgccaggtcttagattaattcaccatcttatagcatttcacactctt

SEQ ID NO: 38348 - DNA, 1024 bp, Homo sapiens
actgtacagccatgccctttaagacagtttatttgcttgcttgctagcttctctgtgtgtggtatcccatgataaaatttaaactatttaaaataagtcacctcccaccagaattccccatctttccccaaagacagtcacagttaacaatgtcttgtgtaccattctgtaactattttacgcaatcacaagcatccacaatgtttttactttgcacacatggcttcattatatttttttttccttttagttgcagattcctttccccaagcatcaaaagacaagtaattggtggtatatatttaatattgcaggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaactctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaatt

SEQ ID NO: 38349 - DNA, 1105 bp, Homo sapiens
gcaattctccagcctcagccttctgagtagctgggaccacaggcgcacaccaccacggccggctaattttttgtatttttagtagagatggggtttcactgtgttgcccaggctagtctccagctcctgagctcaaagtgatccacctgcctcagcctcccaaagtgctgggatcacaggcttgagccaccgtgtctggccagcttatttctttttagcactgaataatattccattgtctgcatataccacagcaaaagaaatatctgttaaaggactgttatccaaaatacagaaagaactcttaaaactcagaaataaggaaacaacccgattcaaacatgagccaaagaccttgacagacacctcattaaagaagatatacagatggaaaataagcatatgaaaagatgctccacaccatatcccatcagggaaattgcaaattaaaacaactgtgagatgccactacacatctattagaatgaccaaaatccagaacactgacacatcaaattctggtatggatgtggaacaacaggagctctcattcattgctggtgggaatgcaaaatgatacagccactttggatgacagttaggtagtttcgtacaaaattaaacatactcttaccatgtgatacagcaatcgccctccttagtgtttacccaaaggagctgaaaaccagtgtctacacagaagtttgcacacagatgtttatagcggctttattcataattgccaaaactcagtaggtaaatgaataaataatgggtctgttttttaaagagttttttatatttttactattgaacatcttttcacatgttaatttgtcacttatcttgtgtgtagtaatgttcatatcctttactaatttttctactaaagtctccttttactcttaaacagaagtgcccttaaaaatcaaatagggaacttgcatatcagcattttaaatgcacgtgtcctttggctgaacagttctaatatgtggcatttatcctagaaatatattcttaaaagaatgtaaaggtattgaatggtgttccctctagcattgcttttaaagaaaaaatataacctaagtatgcatcaatagga

SEQ ID NO: 38350 - DNA, 1112 bp, Homo sapiens
cttggaaactacacaaacgcgtggaaattaaatagcatgcttctgaacaactaatttgtcagggaagaaattaagaaggaaatgtaaaaatgtcttgaaactaatgaaaatagaaaatgtgacatatcaaaatttgtgggatactgcaaaagcagtactaagaaggaaatttatagcaataaacacctatatcagaaaagtaaaaagacatcaaatgcacaacctaatgatacacctcaaggaactagaaaagcaagaacaaaccaaactgaaattagtagaaggaaacaaataaagattagaacagaaataactgaaattgagaccaaaaaaaaaaaaaaaaaacccagaagaacaatgaaacaagaagttggattttttttaaaagataaacaaaatcaagtctttagctggacaaacaaaaaaggagaagacccaaatgaataaaatcagaaatgaaaaagacataacagctgagacctcagaaatacaaagaaaccattagagacttatgaacaactatgacaataaatttgaaaacctggaagaaatggataaattcctagatgcatgccaactaccaagattggaccatgaaaaaatagaaaacctcagcaaaccaataacaagtaacgagatagaatctgtaataaaaagtcttccatcaaagaaaagcccaggacctgttggcttccctgctgaattctaccaaacatttaaaaagaactaataccaatcctattcaaattcttcaaaaaaaaaaaaaaaaattgaagaggagggactacttccaaattcattctaggaggccagcattgccctgataccaaaactagactaggatacaaaataaaaagaaaactacagaccaacatcactgatgagcataggtgcaaaaattctcaatgaaacactagcaaactgaattcaacaacacattaaaaagatcattcaccatgatcaagtgggattcactccagggatgcaaggatggttcaacatatgcaaatcaataaatgtgatatatcacattaatataatcaagaacaaacaccatatgattatttcaatagatgctgaaaagcatttgataaaattcattgctttttgat

SEQ ID NO: 38351 - DNA, 1050 bp, Homo sapiens
agtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtgagattaccttcatagatctgaaaatctgatgttatccaggtttctgaagaacttctcgccaaggccatttgtgcttgtgtccaattctctgacctagattgtgactcaatctagtgtgtttcttaccaagtacataggcagagcagggttactgtgattgaaagaatccattttttttttggagacgtagtcttgctctgtcgcccaggctggagtgcagtggcacaatcttggctcactgcaacctccacctcctgggttcaagcgattctcctgcctcagcctcctgagtagctgggattacaggtgtgtgccaccatgcccggctaattttttatgtttttagtagagacgggattttaccgtgttagccaggatggtctcgatctcctaacctcatgatcctcctgcctcagcctaccaaag

SEQ ID NO: 38352 - DNA, 1021 bp, Homo sapiens
cactaagtgttcagtggacgttttgggcttttggaaacggaagtgatttgagggtctttgttccaagaaaggcggtgctgggcccggggactggaactcggtaggcgaggatcccctttgacgcccccctacagtttcccttcaaacacgtaggtctcagctggtaccctggctgcgctactggctttggcctcctggggccttatggttgaaaacagcaggaaatgaagctggaaaaagcgagagacaacagattgtctgctttcaggctccttcctttgtaatttcactgtgttgctttctttggacgctgcttgtgcaggacccagcctagctgtttcacaaattgcggagtttgcattcatgatttcattgcaatttaccgaatctttgagaaatactgattataaatcatgaaagaaatgcaaagcaacctgtctgtggttgggggtgtagctcagtggtagagcgcgtgcttagcatgtacgaggtcccgggttcaatccccggcacctccaccagttttgggagtgcgcactttctcctctcaatggaccgcctttccactttcctttctccctcccgttaaataaacctagtctcattcattcaattttctgcttgtctgtacagcctttgcagtgttaagtatctgtatcgatagcattgccacaccaggaaggtcttgaaccctttgtaaaagcattttcgcaaattaatcagcctggtttctttggatttcatgctatggtattactgaaaaacagaaaaaatataaaaataataaaagaccctttgttttattcactgttttttttttcttttcttttttgaattctgaagagttcttagagcaaagaacagcatggaggtggaatagcagaaacatatcttattgatgtctttcttctgagcttccaaccaccctataccttaccttttcttgaatcaccagatatggaagcagtgggccccgttagtattgtgcggtgataggtacatgaaggacaataaaatgctg

SEQ ID NO: 38353 - DNA, 1060 bp, Homo sapiens
ggtctacattgcctcgctcatttcttccctgctgagctctttgattagtttgctaagcagcatctcgggaacagcccccgtgctatgtgttctttcttgtcatggatatgtgttttttcttgtcatgctatgtgttctttcttgttcaaggcagagtcgcggctgggttgttaggatgctcgcgcccctgtacccggggcgtgcagggaagtgtaagaagggggcgaagggcgagaaacgctgaattctagcctgaattggtaggagagcctcgcaagctgagtcacggttcctgattccatttaaatagaacgttttgttcacttgtaggaatttccttttccatttctttcattaaatcgcgaacgtagtaatgacttaacgctggttacgcattcattacaatcgaagattatattaatttgcgatggtaagtgtcccaggtgtcaggatggccgagtggtctaaggcgccagactcaagcttggcttcctcgtgttgaggattctggtctccaatggaggcgtgggttcgaatcccacttctgacacaactatcttattctccttttactctactttctcagccatttctgtgttttcattctttctacctcaactttttttattctaactaaaatgatacactctcaatgaggtctgcccccttgcttttcagtcttgttcgctgtttagtagtgaatcacgttttgccccgctttggtcagttcgttaaaaggcgcattcatttaccacatgagcactcacccagaggcgtactgggaggaaactagactaggtaggaatagaaagacatgtatacagactccatcattacatactggccctgagctcataggttattgggaccgcagattacatgtttttcctcacggccagaaaccatcaaaaataaaagtgatgaaactgaaattgaaagcagcaaggttcacgctcaaggttatcggaaacaaggcaaaaggagagaaatgaaaggttccaccgagatttgaactcggatcgctggattcagagtccagagtgctaaccattacaccatg

SEQ ID NO: 38354 - DNA, 1031 bp, Homo sapiens
cctggaaggtaggagaaaataggaattttcactgagtttgagtgggaatggaactgactatatatcttacccttcctcctctttaactgggctcctccctctaaatctaggctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccagtgtcttccttttgttctcactgccaaactgcctgtcctgggatctagttatcttggccctgcactctcaacatgagtagcgaacacttaaattgggttttcaacagtcccagctttcactgccagggtcccagtcagattccaggaatttgcgccctaactttgcttgctaatcctggtttagagctatcccactaaaatatttaatcctaattcttagtccttgcctgtgagatatgaggtcttacaggagacctcagagctcccagcccttctcctcctgctaacccttctcacaccctcaagaggagttagaaaagaggtccttgtcattctcacctcttatggaaaatggaataagaaataatcatatcctttcttcccacccttctcctgttatttaggatttctgacaaagctggcttgagattggtcacttagagccgactgtctcctctgccttttgtttttca

SEQ ID NO: 38355 - DNA, 1073 bp, Homo sapiens
aaaaatgttaacatctgaatagtcacttggctggagcttctccctaaccctgccctttcttcccctatctccctatccctcctagatgtgaaaaggtgaagaccatggaggtgacttcagtatccatagagctggaaaagaacttcagcaattttccccgacagtactttgccctaaggaaaatccttaaacagctaattggtgagttgttcccaaaaggaaactagaagaaaccactagagagaagaaagtttttaggtcctaccttatatgggtttcagttatcctatgtctcacttttcttactcccacacacacctacccctttatctggcttttagtctcaccctgagtcacagaacttggagtgagaggaagccttaagcgttatctactcttaggtccattcttttctaaatagagacccagaaaggttaaataatttgccaaagtcatcgggtagagtggttatataatttaccatgtaaacttgcataaccttcaaaggccgggtgcggtggctcacatctgtaatcctagcactttgggaggccaaggctggtggatcacttgaggtcaggagttcgacatcagcctggccaacacggtgaaaccccatctctactaaaaatataaaaattagccagatgtggtgttgggcgcctgtaatcccagctcctctggaggctgaggcaggagaactgcttgaacctgggaagcggaggttgcagtgagctgagatcacaccactgcactccagcctgagggacagagtgagattccatctcaaaaaaaaaaaaaaagaaagaaactgaaagggagtgtcattatattaatgtgaatatgcagggaaaatagtcataaaccaggccagttcctggaaaacacacatggtcaccctatccctagaccatatgctgtcttgctcggcatccttcttaacactttccgtttttttctgcccctcagactacaccttgtacttctctacatagtgagataaatgataatgtcagagggagatgaagagaggaccaggcgggaacctagattaccagccactgcagactcaa

SEQ ID NO: 38356 - DNA, 1046 bp, Homo sapiens
ttgccctgctccgcggcgctcctccggggcgggagccgcgaggcccgggcgagctcgggcgggaccggaggctgcgaaggctgccgggagcgggactcgcagctcctggatatgccagcgttcctggaagactcctgggtcctgacgaaagacaagttgatgagtgagttggtcgccattaaagtgaggctcccggcccggagcagcgcagagaccaggacgcgcagcctcgcctgcagcactcggccctacctctaccccgccgctacctctaccccgccgcggcgccgacagcgagggccccgcctcccccagctggctccagagccaagccacccacagcaggaaagccacgaagaaaacagttcaactcagaccaaaagataaagctgatctcgaggtaaccgcgctcactaatgaagatctcgtggacccgcttgcgaggtataaagagaaacctagtcctactggagaacaaccaggaagcgatgtgagaaaaaaaccttgaaaccgaaggaacgaggacgatctgtcgcccaggctggcgtgcagtggcgcgatctcggctctcggctcactgcggcctccgcctcccgggttcaagagattctcgtgcctcagactcctgagtggctagaaccacaggcatgcgccacctcgcctggctacattttttttttttttttttttttttttttttttttttttttttgtatttttggtagggacgggctttccccgtgttgtccaggctggtctccaactcctgagctcaagggatctgcccatctcggcggattaacaatttaatcttcagcagaaaatggaaggcagaattgaaataaaggttctaatagatactgtgacaatgaagaagactagagtaaagatcaagcttgagaagacagaaccactaaagggcagagcaaagactccagtaacactgaagaaaagaagacttgagatagtcagagctattctcacgctggaataactgaggctgaacgcacaagtggagcttcagaaggcggagctctgcaggcctg

SEQ ID NO: 38357 - DNA, 1046 bp, Homo sapiens
tttttgtatttttagtggagatggggtttcactatgttggccaggctggtctcgaactcctgactttgtgatctgcctgcctcggcctcccaaagtgctgggattacagtcgtgagccaccgcacccagccgcacctactcttttgtaaagcacctgtgacaatgaaggacagatttatcaccttgacgattgtggtgatggggacctgatcccagcagtcacaggtcacaggggaaggtccctgctgaagacagacctcagaagggcagttgatccaggacccacacctgctttcttcacgtttcctgatcctgccctgggtctgcagtcacagttcaggaaacttctctgggatccaaaactaggaggttcctctaggaccttatggccctgcctcctccctggcccctcacaggacattttcttccaacaggtggaaaaggagggagctactctaaggctgagtgtaagtgcggggcgggagcgtggaggagctcgcccaccctataattcctcctgcaccacatctcctgtgggctctgaccaggtcttgtttttgttctaccccagggagcgacagtgcccaggggtctgagtctcacagcttgtaaaggtgagattctgggggtctgaagtgggtggagggtggggcagaggggacaggactgggttgtggggattttttgattcagaatttttgagtgtgtggtgggctgttcagagtgtcatcacttaccgtgactgacctgaatttgttcatgactattttcttctgtagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggca

SEQ ID NO: 38358 - DNA, 1024 bp, Homo sapiens
gttaagtaaagacatagtgtattattccacttatctgaggtgtctaaagtcaaattcaggggctgggcatggtgcttcacgcctgtaatcccagcactttgggaggccaaggcaggcagatcacttgaggtcaggagttcgagaacagcctggccaatatggcaaaaccctgtctctactaaaaatagaaaaattagctgggcatggtggtgcacacctgtaatcccagctactcgggtagctgaggcatgagaattgcttgaacctgggaggcagaggttgcagtgagtcgagatcacgccactgcactccagcctggatgacagagcaagattgtcaaaacaaaaaataaaaataaagtcaacttcaaagaaacagtagaatgatggttaccagaggctgggggaaggaagctggaggaaggggagttttgtttaatgggtacagagtttcagttttgcaagataaaaaacttttggaggtcgggcatggtggctcgtgcctgtaatcccagcactttgggaggccaagtcgggcggatcatgagatcaggaattcaagaccagcctggccaatatggtaaaactccatctctactaaaaatacaaaaattagccaggcgtggtggtgggcgcctgtaatcccagctacttgggaggctgaggcaggagaatcacttgaacccaggaggcagaggttgcagtgagccaagatcgcgccactgcactccagcctgggcgacagagcgagactccatctcaaaaaacaaacaaaaacttggagatctgtttcacatcaatatgaatatatgtaacactactgaactgtacacttaaaaatagttaagatggtaatttttatgtgttttttaccacaataaaaaccgaacaaaacaaggcatgatgattcatgcctgtaatcccagcactttaggagaccaaggtgggaggatcacttgagcccaagagttcaagaccagcctgggcagtgtggcaagacccaatctctcattaaataaataata

SEQ ID NO: 38359 - DNA, 1047 bp, Homo sapiens
gtgcctgtgagtggagctctattcagacccccctttccctcccagcccccgttgtctgcctgcttcctctgaattctctctcacttgaccactgtgacacttacaccctgttctctgaaacccagctacctccagggctggcggaagaccttgctgatcgtctcccatgaccagggcttcttggatgatgtctgcactgatatcatccacctcgatgcccagcggctccactactataggggcaattacagtaagtaggattgtgtgtggatgcagggaagagatagaacctcgaaaagaggcctgagtgggagggcctatttagataaactgaatcctgtcagaattccagacagtgatgcctaccccatcaccaccagtccctggttgtccctttgctgggaagaggagcaaccactgatgcctggtcccctcttctgccccagtgaccttcaaaaagatgtaccagcagaagcagaaagaactgctgaaacagtatgagaagcaagagaaaaagctgaaggagctgaaggcaggcgggaagtccaccaagcaggcggtgagcacctgagggacttctgggctgggggccactgttctctcctggcagtggaggaagaaggagactctggaacgctggcctacatttcaaggactgccgcgcagggctcaggtttctcttttttcctcttcctctccaggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgagtgccgcgggcctctgctgctccacaggaagcaccggaagcatgtatgtgcaccctaaattctccaccaaggctgagattgctcctgttctccaaggccagcacatgagagggactttgcagggactgaaaagaatataaattgcttcttttcgtggctttcaggtgtga

SEQ ID NO: 38360 - DNA, 1031 bp, Homo sapiens
gattacaggcatgacccaatatgcctggctttttttttttttttttttttttgagacagggtcttgctctgttgctccggctggattgcagtggtacaatcatagctgtgagtttgaactcccaggctcaagtgatcctctcgcctcagcctcccaggtagctggaactaaaggcatgtgccaccatgcctaatattttttgtattttttgtacagacctggtctccctatgttgctcaggctggtctcaaactcctgggctcaagtagtcttcccacctcggcctcccaaaagtgctgggattacagacatgagccactgatacccaacactaacctggctaaggtcacccaggctgtagagaggtagagctgggacaatggcctttatctgactccagcatcctcaggatttcctcccttatctgtagaatgtggataagatgaccaagaacacatcctagagggcacgatagccaggataggactgttctaggaacacacacgaggcgtgttaaagaagactcagaaagatgaaaaccaggaaagagccctgtggccgagatctactctgtatcctagagtattttatgtactttttgaagcattttttcaccagtacttaatagcaactgttagatcaagcattagctccagaggagtaaaaatcagattccacagatttgtactaatgtatctaacacaggtggtaatggcttttaaaaaaaaaaaaatgaaaaacagtccaggccgggcgcggtggctcacgcctgtaatcccagcgctttgggaggccgtggcgggcagatcacgaggtcaggagttccagaccagcctggccaacatggtgaaaccaagtctctactaaaaatacaaaaaaattagccaggcatggtggcaggtgcctggaatcccagctactcagaagactgaggcagaagaatcccttgaacccaggaggcagagattgcagtaagccaagactgcaccactgcattctagcccaggcaacggagcgagactccgtctcaa

SEQ ID NO: 38361 - DNA, 1011 bp, Homo sapiens
agaaaaagatgaaataaaatggtagttggggacatagttggctgggacttgacctgttgtggtctcgttgctccccctcggcagttctgggaggtgatcagtgatgaacatggcatcgaccccaccggcacctaccacggggacagcgacctgcagctggaccgcatctctgtgtactacaatgaagccacaggtaagggcaggagcccgggcagctcaggttcccttccctgtctcccacttatctgggatctctttccatttctgggcacgccttatcccctttgggtgaatctgtcattttgtccctttcgtgaaccaccgtcggggccaaagacgtctgctgccacctggtggcgggacctggaatgacaagtctctgatccctgctgtctcccatttccagtatatctataaaccttcccttctgccagatttcacagctcttaactttattctctgtaggtggcaaatatgttcctcgtgccatcctggtggatctagaacctgggaccatggactctgttcgctcaggtccttttggccagatctttagaccagacaactttgtatttggtgagttatacagatgatattagcagatgatataccatcgtgttcaacttatttgggtgcaaggacacagcaaaagttaggagatgattgttgtattggagtgctaatacagaaatgtgttctgaaatctaacggagggtagaggtagtgcctactattgctggtaaattatggggcagtagggggagaatatatcacagtgaaggagaaagaagatacatccgagggaattatttgaaaagttgaaagatggaaacatcatgtatcttccataccctgttaattgagcttttctcctgactgcattccaggtcagtctggggcaggtaacaactgggccaaaggccactacacagagggcgccgagctggttgattctgtcctggatgtggtacggaaggaggcagagagctgtgactgcctgcagggcttcca

SEQ ID NO: 38362 - DNA, 1652 bp, Homo sapiens
ccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctgcgagatgtgtgcttatttagggaaacacggctggctgatggaggcatggggcctgagttcagttgcactgctctccttaaattgacacttaatattgagtccctgtcctacggattcaaccaactggatattgggaaaagagttgtactggacatgtatagacttctcattattccctaaacaataatagtataaattatttacataatatttgcattagattaggtattacaagtaacgtagagatgatttgaagtacacaggttatatgcaagtactacattttatatgagggacttgggtgtctgccgatttggtatctcagggaggtactggtaaggacactgactgctttatagaccctcacatcattgtttctggtacccaaactgctctgagcaccagtcagtctttactgtagtctctgacagctcactacagccttga

SEQ ID NO: 38363 - DNA, 1035 bp, Homo sapiens
ctggacaccccggctcagctctggtactttatgttgcagtatttgcagacagcccaggtgaggaggcagggccacttaaccagcatgctctgctcctctcaggtctcactgagagactcctgcctacagactgttccctgattttctcttctctgtccctttcttcccattgtctccctcccatccctcctcctttgtctctgcctctttctccctagagccggggcatggacctggtagagattctctccttcctcttccagctcagcttctctactctgggcaaggtaagcagggggctgaaaggtatagagatgggaaggggaaagcaagttgtggggcagtagagtagactgagaagataagaatgaaaacagaacgaacagagatggagaaagaaagaatgaatgtatggggttgggggtgggtgggttgtgttttggaccccagctggaaacctctgttcctcaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgtggaaaccaattaccgactgtatgcctacacgggtgaggcgggacagagggcccctggaagaggaggttgggggtgagggaatgccagtttatgttcgtgtttacctggcagtctacagagctctctgacattt

SEQ ID NO: 38364 - DNA, 1031 bp, Homo sapiens
atgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaaggttaggggtcagacagcttgtccttgggtttctgagacttgagaggggctggaggagaccggctgaaatgcagtctggggtatactggatcccagcctcttctgctttctcttctcagtcacctgcagaatccattaaggcctggaggcctaaggagttagtattgtatgaaatccctacgaaacccggtgaaaagaaaggtaagtagaata

SEQ ID NO: 38365 - DNA, 1053 bp, Homo sapiens
gggtaggaagggaggcaggagctgaggccttgcccctgacagtttctttctttccagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcaggtgaccagaggggatggggagggttagggcaggcttgggaagcatgctgggaggaagggaggggctgggctctataaagtaggggaagggaccttctaatggaggatggaggcctggcagcaggcggatgtctgagccttttctccctgttcttccccagggcctggtggacccgcagatccagctacctctgttagccgcccgaaggtacaagttgcagaagcagcttgacagcctcacagccaggaccccatcagaaggggaggcagggactcagaggcaacaaaaggtaaggctgagggaggcccccagaaggctccacccctgagggaatgtgggccaggaggggcctcattcctggatcctcacctccttttctcctcgtccagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaacatgtctgtttatggctctttggtcccctttgctcccagtggtgacttttgtgcttctgagttgtcccctgagagcttgg

SEQ ID NO: 38366 - DNA, 1033 bp, Homo sapiens
tctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgt

SEQ ID NO: 38367 - DNA, 1027 bp, Homo sapiens
tccctagtagctgggactacaggcgcccgccaccacgcccggctaattttttgtgtttttagtagagatggggtttcaccgtgttagtcaggatggtctcgatctcctgacctcgtgatccgcccgcctcggcctcccaaagtgctgggattacaggcgtgagccaccgcgcccgacctcctgtctcctttcagtcctcctcgggatcgcgcatcacccgcattttctggtctctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccggaggtggtgcttcttgctgctgtggggactgtggggggtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccctctcacctcctccctgcccatcttacggcgccctgggtcctgttgctctcccagctccctgctaccccttcctgtgtgctgttctctgatccatttctagggtgtcctctgccttcatcccccgcccccgccactgaaggtccctcctgcctcctttatgggcctttcctgcaagcagccttcactccgtgctgcccctatgcctccccattcccaaatgtccctgactctaactttctggtgctgccttttgtccgggggggtcttccctccatcccactcccctccagacccccaaggagagccctgatgctaatggcagt

SEQ ID NO: 38368 - DNA, 1068 bp, Homo sapiens
cgcctcctgggttcaagtgattctccttcctcagcctcctgagtagccgggactacaggagcctgccaccatgcccgactaacttttgtatttttaatagagatggggtttcaccatgttggccagactgctctcgaactcctgaccttagatgatccacctgcctcggcctcccaaagtgctgggattacaggcatgagccaccatgcccgacctaatttttgtgtttttagtagagatggggtttcaacatgttggccaggctggtctcaaactcctgacctcaagtgatccacccacctcagcctcccaaaatgttgggattataggcatgagccaccgtgcccatcccacagaatgtcttttggttttgtttttgttttctgttttgttttgttttgttttgtttgaaaaggagtctcattctgtcgcccaggctggagtgcagtggcacaatctcggctcactgcaacctccacctcccaggttcaagagattctcctgcctcagcctcccaagtagctgggactataggcgtagggactgtaggcgtatgccaccacgcctggctaattttttgtatttttagtagacacggggtttcaccatgttagccaggatggtctcgatctcttgaccttgtgatctgctcacctcagcctcccaaagtgttgggattacaggcgtgagccacagcgcctggccaaaatgtttttatgtttatttttcttagtatgaaactccagcgtattaaagagcattgagaacggttgatctggtaaatcgctataaaggcggcatttctttttttttttttttttttttttttttggcgaagtgggggatggagtctcattctgtcgcccaagctggagtgcagtagtgtgatctcggctcactgcaagctccgcttcccaggttcaagccattctcctgcctcagcctcccaagtagctgggattacaggcgcccgccaccacgcccagctaattttttgtatttttagtagagacagggtttcactgtgttggccaggctggtctcgaactcctgacctcatgatccgcc

SEQ ID NO: 38369 - DNA, 1834 bp, Homo sapiens
catttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttgagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtgtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcatttt

SEQ ID NO: 38370 - DNA, 1374 bp, Homo sapiens
cttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggtgctgagggccagtgagttagggccatcaggggagaagaggagggggtcttggtttgtattttggtaatatactcttagaggagt

SEQ ID NO: 38371 - DNA, 1326 bp, Homo sapiens
ccatgaagtgctttaatgggtcttaaatgggaggggcttcaatagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtaaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgag

SEQ ID NO: 38372 - DNA, 1054 bp, Homo sapiens
gagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctcc

SEQ ID NO: 38373 - DNA, 1051 bp, Homo sapiens
ggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaatccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggaccctgctgctgggtgcgtttctgcagggagcaagggtagaagaattgggaggtggagtagag

SEQ ID NO: 38374 - DNA, 1390 bp, Homo sapiens
ggggccaatggtgagaggggtgggtgggactcctcgggactctgccggggttagtccctttccccctaaacgtcgggagcggcctcccagaaaaccagagctgctacaggaggtaagggatgggtttgagattgtgcttcactgcactcttactcgtgaaaattcttctgggttatgttttctctgttttctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcgtacagaccgaggcacagagcctggccccattcggccatcccatcgacctggtcccccagtccagtttggcactagtg

SEQ ID NO: 38375 - DNA, 1032 bp, Homo sapiens
tagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatc

SEQ ID NO: 38376 - DNA, 1031 bp, Homo sapiens
cttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggtagggagcagggagagtcattaagggtcaaaggaaaggcccaagatcccccagagaggggaggacagggcatggccctttcttgaggtctgcttctcccagaatcagggcatctccctgctgagtgactgtgggaaagttatttgatta

SEQ ID NO: 38377 - DNA, 1039 bp, Homo sapiens
actccagcctgggtgacagaccgagactgtctccaaaaaaaaaaaaaaagaaactttctctttaaaccagaaagactcaggaactcagagccacatgccagagttacctgctgctggggccctggactcctgccattccttagttcttttcaaggattctggcatccaggatgccctctcgaggggcccaatttgaggggcaaagtgctgagagcactgatgttgggctgcagtggttggatcttcatgctaatattttaattttgaaatagtgcaaacgtatagaaagcaaggatggatacaacagccttttccatacactggataaacatgctggacataacgctgctctgagtcaggcttggtattgagcagcaggactcccagatgagtatagccaggtgtctgcccttccaagtcttgcagcccagtgcttgggttatgaaacctttttctgaaaagcagtgcagctttgtggctgggaggtccaatcccagcccctctaccacttggatatgtcagtctcttcagccccaccttggtcacctgtcaagtagggatagtgcctcagatgattgagaaaacacatgtaaatgtgcatacacaagtagaagttaaggccttttccccctcaaaaaaatatatttgccctagagtcaaatgcatacacaatgttcagcttttttttctaaggttcttactatgttgcccaagctggccttgaactcctgggctcaagagattcttctgcctcagcctccaagtagctgggactacagatgcacaccaccatgctcacctggctgatttacttattttcaaacctttttggtaaaacattcagaagcttgcacatatcacaagatggatttttgtaaaccacacatctgtgtaaccagccaccaaatcagcgtgaagacctttacctgcagccaagcctgcctctgttcccctctcccaggtgctcttcccagctctggggtagccgctgtcctgactggtagtagcttagatgagttctgtctgtgcttgatggaaa

SEQ ID NO: 38378 - DNA, 1856 bp, Homo sapiens
gagttgatgtgcaccttctttgtgctcacatagtgcttgtttatgtttttctagttgcactgtcacatcatgttagaattagcagtcagtgaatctgcttgcctccatagctatgaactctatctagtagctatacctgttacctcagtgtctgacacatggtcttgtacatagtagcactcaatgtgtgaacacaacgcaaatgtaaacgcactggtgacatcatctctaaacagagtggaaacctttgctagcctcaggtgcacaatccttcccctacctcacctcccgctgcaatatgtatcttgtaggagttaatttaggataatctctgaggtcatctccaggtaatcagcatctccaggaatcggcagggtaatttaattacccacacattcttcagtgcttcaggtgcagatctttaatctcagccacagatgggagggagagaattctcagtggagaagagagctggatttaaggtcggggaggaatgcgtattccccaaatggaatcagacagggcatgagatcatataacttgaagaatcatcatataatctaatgaactaaggacaggtgacatatttattaatatttctgtatacgaatttattttaatttattaggaaatacctctaacgtacaaaaagatgtaaataataatatagggccagatgtggtggctcacgcctataatcccagcatttgggaggctgaggcaggaggattgcttgaggccaggagttcaagaactaaaagctgtacaggcaccaagaatatgactgaatgtcacagtatgctctaaagggcactgtcctaggagtctggagacatgattttgagacttagctgttctcattggcggtatgactttgggcaagttgcttatcttttaacggtttcattttctcagttgttaaatttacagtttggtttaactaaagtctctcccagtacgagcagggcgtgagtcagagatacctaagtgtttagtgcagcgcatgtgctttctaaagtggggatggctatttacagactggcctacactgttctggtgggagccctcagtgaccaaggagcagaggtacctgaaacccacccttgaagccatctggatgctccgcttcattcaaatctggggtgttctaacccaaagtaactggccacagactgcaatgtaagatacaaatcttcaggacctagtgtgtgcacatgttggctcttatataagatggcatccttagtacttgttctatgtagaaaagaatttgtgggctcacaagtccctacagagtctcacactctcatggccaataagtatacagggatacccggaattagacaaacacagatgagacatttatttctgtatatgaatttattttatttatttatttattttttgagacagagtctcactctgtcacccatcctggagtgcagtggcctggctcattgcaagctccacctcccgggtttacaccattctgcctcaccctcccgagtagctgggactataggtgcccgccaacacgcccggctaattttgttgtgtttttagtagagacggggtttcaccgcgttagccaggatggtcttgatctcctgacctcgtgacccgccctccttggcctgccaaagtgctgggattacaggcgtgagccaccgcacctggcctgaatttattttcatttattaggaaatacctccaacacacaaaaagatgtaaataattagccgggcgtggtggctcatgactgtaatcccagcactttgggaggccgaggcaggtggaacaccagaggtccggagtttgagaccaggctggccaacatggtgaaacctcatctctac

SEQ ID NO: 38379 - DNA, 1856 bp, Homo sapiens; identical to SEQ ID NO: 38378

SEQ ID NO: 38380 - DNA, 1856 bp, Homo sapiens; identical to SEQ ID NO: 38378

SEQ ID NO: 38381 - DNA, 1047 bp, Homo sapiens
atatgtagacacaattatgctcacatctagcaattttcagtagatacatgtaaacacacctgaatgggtaggacactgcacttgccactacattcccatagcacatcgtggatacatattgccacaatccccagggactgcaagcacactttttggcaaactgagatcaagatgatagatgtaacttgtagtacccccacccaaaccctcacttccaggctatggttcacacgtccgactcatgacctgggggagctcagttctcgtctggacgtcattcagttttttctgctgccccagaatctggacatggctcagatgctgcatcggctcctgggtcacatcaagaacgtgcctgtgagcccagggtggagggcagggaggtggggaaggaggttgagggctgatactgggcagtgggcttcttgaggggcattagagtgagggaagagaaaacagcggctgtaaccttgtctgactgtagctgattctgaaacgcatgaagttgtcccacaccaaggtcagcgactggcaggttctctacaaggtaaggccttccttcttgaatcccaaaagtccaggtaaaggccctcagcctgtattccagactgtctgtaccctagacatgctgtccaattttattctaccctcttttttttttttttggagacagcctcgctctgtcgcccaggctgaagtgccatggggcgatcttggctcactgcaacctccgcctcctgggttcaagcaattctgcctcagcctcccgagaagttgggattacaagcgcccgccaccatgcctggcaaatttttgtatttttagtagagacaggatttcaccatgttggccaggctggtcttgaactcctgacttcaggtgatccacctgcctcagcctcccaaggtgctgggattacaggtgtgaaccaccaggcccggcctccctctttttttttttaactttgtattcaggaaaatgtaaaaaatatttagaataatataattaacccccatgtacccaccatgcagtttcaacactttaact

SEQ ID NO: 38382 - DNA, 1030 bp, Homo sapiens
ttttagagtttgcacaaccctctatcaaagcacctaccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtgagtagaaggaaaaagggagtgcacccagggaggtcagggagagagaatgcagtgtgcaagatggggaaacatggaagatattgaggtcaattggataaagaatgggatggtgggaggaggcagcagaacttcagggaagtatctggagggtgagagttaaaggaggactgcagggagaattggggcccaaggagagctgaggaacaggacagagggtgccaggtcctaagaaacagtacttatctcctcaggtggactttgagggcagccttgctgaaaatcgct

SEQ ID NO: 38383 - DNA, 1047 bp, Homo sapiens
ggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttgcttggcgaaaacactacaaaggctgggaatgtatgtttttataatttgtttatttaaatatgaaaaataaaatgttaaactttttcttgtctgttaatatgtgaagataatggatatttgcggagggatagtgtctgaataccatctatctttatagtctgaaaagaacagtactgctgaagagttatacgtgtaggagttagagctacacatatttttgtttgggcttaattgtgggccttaagagaaattgcaggtgcccgtcttgattagagtggggcttgtttcagggaaaagtcggatggcagctgcaaaacggtattggaggggtggttgaggtgggttcactggggcggggaggggaggggtggtgctgagatgggattatggtggttttctctccctcttctacttagtgagcggagtccacaaaaaaatgctgactttttttttttttttttttgagacggagtctcactctcactcttgtcgcccaggctggagtgcagtggcgcaatctcagctcacggtaacttccgcctcccgggttcaagcgattctcctgcctcagcctcctgagtaactgggactacaggcgcctgccaccacgcctggctaattttttgtatttttggtagagacagggttttaccgtgttagccaggatggtctcaatctcctgacctcggctcatattcatttatatgtggaatctaaacagtagaactcagaagcagagaagtggtggtcaccaagggctgtgggatgggggaatggggagacgtgcaagggaaacaaagccttagtcaggagaaataaattgtatttttttttttttgaaacgggatattgctctgtcacccaggctggagcacagtagagc

SEQ ID NO: 38384 - DNA, 1064 bp, Homo sapiens
ttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgtgagtggggttgggcgagtgattgcaaaatgggggtggcggtcgcccggggataggaagggagtgatgatgaccccaggtaactcttgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaaggtgagtattaggtgcgagagccttttgaatgcctcttcggaaagctttgttcccaagcaagctttcgttcatgggcattatgcgcctccctgcccttttttttttttttttttttgagacagtctcgccttgtcacccaggctgaagtgcggtggcacgatctcactgcaacctgcgccttctgggatcaagcgattctcctgcctcagcctcccgattagctgggattacaggcgcatgccaccaagcctggctaattttttgtattttttaatagataaggggtttcactgtgttagccaggatggtctcgatctgctgacctcgtgatccgcccctctcggcctcccaaagtgctgggattacaggcgtgag

SEQ ID NO: 38385 - DNA, 1689 bp, Homo sapiens
tcaagtggtctttccacctcagcttcctgggactgcaggcacgtgctaccaccacgcctggctaatttttagtttttttacagaagcgggcttttgccatgttgtccaggctggtctctactcctgggctcaagcagtcctcctgcctcagtctcccaaagtgctggaattacaggggtgagttgctgcgtctggtgttggtgactttctagagattactttttggtttacatcattttccttgtgactatttttacttttttggggggcggggggacagtcttactctttttagtttacatcattttccttgtgactattctatttttacttttttagggggcggggggacatgagtctcactcatgttggtcaggctggtctcaaactcctgacctcagttgatccacgcccttcggcctcccaaagtgccgggattacaggcgtgagccactttgcccggcctgtatttttacgttttaataaatccccgtatttttgttaaaggctgggtaacctgactcctcccctcatttctactgcaaaataggagtacactggggcctcccagtggagctgttctctgctgttttaaattactttctactcctccctttctaacgtccactcctggactcatttgttagatcaatatatactgggactgttgtgttttctttgagtgtactagatctctttccagaagagcttcccttgatccagatctccctaattgggaatgatgatttcacagactagagtctccgatgctggtcatgatgtcaaaactaagttctgactcatttagggaactggatacttgggtctccagaagggccaatgggagggccataattctgtttattttcaaattgtcttgttttcaccttgttagaatgaactctggaagcccagccagggacaatgcaccttcacagagattctgcactaatctgagtgaaggtctaaggtttggaatctccccctcatggagagaagctttgtatggctgtcatgcttagacagtgattcctgcaacttgaccttcaggctgggagaggtggagagccatgcctgttctccttccttgctatggtgagtatcttttgttttggctctcagtgggagtggtaatgatgatctggttggacaagagtctctgagcttttctctgaggatctttgaacccacctgatccaccttcatcctgccggcaatctcctgtaattcatgtttttatggccagttacttacatgatgaggtttaattggctatggttctgcaggatgtacaggaagcatggtgttggcatctgctcagcctctggtgggggcctcaggaaactatattgcataaggtacagagggaagcagggatgtagcatggccagagcagcagcaaaggcagggaggtgccacacatttttaataaattgatctctagagaactgactgtcatgagcacagcatcaaggaggatggtgcttaagccattcatgaggaatccaccccagtgatccattacaattcaatatgagatttggtggggagacagatctaaactgtattacagggtctcactttgtgcacaggctggtcttcaactcctgcctcagtgagccactgtgccccaccccaacatgttttgtgtgttttttgagactgtcttgctctgtcatccaggctgga

SEQ ID NO: 38386 - DNA, 1041 bp, Homo sapiens
cccaccccccaacccttcttatctcgagaaatgtcagaaccttcccctgggcagccttagccaggaataaaacatttttgtcttccctcattctataggacccttttccctccctccacatatacatgcacttctaagagaaggaaatctttctctgggaccccgtattcccctggcctccaagaacccttttcccagctccagattcttgcactctcaagagcaagtctctccaaggaatcatcttccctctctcaggatgtgtgcatctgctcagcctcccactcttacctttctgccccagaccccccaccccccaattctcctgggccaaagagccctttttccacgcagcccaggggccccagcctcctggcctccacgcctgcgcggctagcggatgaggacgttaatctcggccacactggcctccagcacgttctcggccgtggtcttgccgtgttgctccttgaggtgccgcctaatggcaggcttgtgggcgaagcgcacgtcgcagtaggagcagcggtagggccgcgctcccgagtgcaggttgaggtggtcgtgaagggtggacttctgtgtgaagcacttgccgcagatgccgcacgagtgtgacttgacaccacgatgcacgttcatgtggcggttgaggttgctgctgtggttgaactgcttgccacagcgagggcacatgaagatgaagtgctgcgcccgcatgtggaagaccagcttctccacgccctggaacacttccgggcacttggtgcacttgatgttctttaaggggtttccacctgagaagcccccaggcaggggtccccggctgccccccgcccccaggctgccccccgccccccgggcagccatggccaccgctgctgcttccaccaggcccgaggtggcccccacgctggcccggcctccgggaatcaacagcaggccctccccttctgcatcttccgacaggctatagcaggccttcaccacaccctgcggtggggctacagtgctggggggaacgctgctctgggccagctc

SEQ ID NO: 38387 - DNA, 1030 bp, Homo sapiens
ttgagaccgggtcactacgttgccaaggctggtctctaactcctgggctcaagcgatccgcccactgcagtctcccaaagtgctgggattacaggcgttgagccaccgtgcctggccagattctgcatttctacaagttcctgctgatgctgatgctgtctgtctgtggaccacagtctgagtagcaagcatccacatattcgtaagagtggagttgctggatgttgaggtctgcacctgttcagcttccctgctaatgctaaactattttctgaagcagttgtacaccagccatgagactgttgcttcttgggaaaaaagatataaaggcttcaaatttaatggatattattcagtgctcctcttacttgagctttctgcagtctgtgacatacttgaccacactgtttgatccactgcttttccctggtttccatgacacccctgtatccaggctcccttccttctataatttcagtctgttctataaaccctcactcctttcctgtcttgaccttttcctctgttgatgcctttggccttctaggcctttatctcattctctctgggtggtaccatgtgctctttagagattggttaccaggccgggcacggtggctcacacctgtaatccgagcactttgggaggctgaggcaggtggatcacctgaggtcaggagttcgagaccagtctggccaacatggtgaaaccctgtctctactgaaaatacaaaaaattaaccagggtgatggtgtgtgcctgtaatcccagctactcaggaggctgaggcaggagaatcgcttgaacctgggaggcagaggctgcagtgagctgagatcatatcactacactccagcctgagtgacagagcgggactctatctcaaaaaagaaaaaaaaaaaaaaagagattggttaccacattgatgactctgtgatggttaattttatgtgtcaggccaagcgcagtggctcacgcctgtaatcccagcactttaggagggcaaggtgggaggattacttgagccca

SEQ ID NO: 38388 - DNA, 1036 bp, Homo sapiens
cacctgtaatcccagcactttgggaggccaaggcaggcggatcacctgaagtcgggagttcgagaccagcctgaccaacatggagaaaccccgtctctactaaaaatacaaaacaaaattagccgggcgtggtggcaggcgcctgtagtcccagctactcgggaggctgaggcaggagaatggcatgaacccgggaggcggagcttgcagcaagccgagatcgcaccactgcactccagccagggtgacagcgagactccgtctcaaaaaacaacaacaaaaaaaaaaccaaaaaaaaaaaaccctagctatataccctcacaccctacaaaacaaaacaaaacaaaattagccaggcgtggtggcgcatgcctgtaatcccagctatttgggaggctgaggcaggagaatcacttgaacctggggggcggaggtcgtgcggtgaggcaagaacatgccattgcattccagcctgggtagtaagagcgaaactccttctcaaaaacaaaaacaaaaaaaaacccaaaaaaagacaggagggtcataaggggagggttgactgtgtgtccctccaggttgtgcagaggggattagaagtaagtaggttagaggggaggtggagggagtgtgctggggtgtgagcttttatgatgctgaaaggatcatgatatgctaaggacaggatagtgttgggttgtacacacaggtgtaggcaatcctggtggctagtatgtaaaagtgaatgtcctgactcccttagagggtacctgcagagtgcccttggagggactagtgctggagaaattaataggagaggggacgggcatccattaaccttttcttgcctgcagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgg

SEQ ID NO: 38389 - DNA, 1026 bp, Homo sapiens
ttttagccaatgagttgatttggagccatacgctccaaagtccaatagcaatccggacattctctaaaagaggaagcgaaggaaagaaaggggcttatagtgggcgaggtctataggtagtcccgagcaaattgcttatggctttggttatgactgacaactactcagacgaataaagccctccttggccaggcgacagcgtgtagcgagttattaccaatcccttggcattgcacattgacttagaccgtatcagccaatagccattgtgcgaaggcaggactgcactaaccttttcccgcccctaccctttgggccaatcctttcttttgaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactggtgagaatcgaggaggggggcgggaggtggtgggtctcgcttatatactggagaggctaggagcgaataatcatacagtcatacagataatcggagggcacgttcccataggtgaagcccgacaggagacataagactttgctggtatgtgtgggtgggagtataacggtcgagatctgtggaaagaaaggtcttaggaaccaggagctgaggcacgtgatgtgctgagaagagaaggtggggcggggagtggcaggacaatgtgagacccgagccaccttaccccagagaagtgaggggtcttagctgtgcaggtggaaacaagtgagacacaaaggttaagggaggcacgcatcagttgagtcggggagaaccaggaaatatggatcacattcag

SEQ ID NO: 38390 - DNA, 1030 bp, Homo sapiens
gatcacaccactgcactccaggctaggtgacagagcaagaccctgtctcagaacaaaacaaaaccaaaaacaccaaacaaaccaaaaaacacaaaaacccagcaaacaaaaacaaacataaaacattaaaaacatttgtagaaaaaatttgctcaccccagccctacaagaaactaatgtaataaaaatatattaggaacttactagtgtgaacttgaggtattcctgaaaatcaaaacaagaaaataggttaatggcagcatttttggaacagaagtacagttctttcctactcccaattccctagttgttttttctagggtaccataaagacttctagcagaatacaatgaaatatgatgagacaacagatcccttagtgtgttataagaacctgacagtttttaccacctttatgtggtccaacttattgttgtctctctaattgagctctctgctttcacccttgcctcccagtcagttcccagtacagcagttagcgggacccttttaaagtgtcagcaagactcctgcttaagagccaccaatggttccccatcttggtttaacaaaagtcaaaatcacaacagtggctttcaaagatggccctggaagatctgtccctccaaatctctcttatagcttctttttatgtcacttttcattctgttccagctatatggtacttgctatcttgcttttcctcaaatagtctggaaatgttcctaccctagggtggtttacttgttgtcttctctgattgaaatattcccccctcagatattgcctggctaattctctcacctatttcatgttccatctagtagttatagcaattgctgagaatgaggcattaaactttccaactgtagttgtgggtttttctgtttctcttcagttctagtacgtgtttttttttttcccagtgtgttttgaagcactgttgtttggttcatacatatgtagaatttctttgtcttcttgatgcattgatatttttatcatgatataatgtccctcttttgtccct

SEQ ID NO: 38391 - DNA, 1034 bp, Homo sapiens
aatttggagtcagaggaagttggtcattgtaggaaagtaactgctgcaagaaagatttcttagaatgtaactgtctaatatgaggcatttatgcctcttttcctccatgtttctagtttctgccttgggtttggcatttattgtttatcctgcttcaagtataagactagtggtttattcgagggcccacaacttccacttctaccctggcgtcacacagatcattttctcttctcaagtcattgtattttcactggtagtaaaagaggataatatcttcatcttcaaataaattagtgggagggattcaaattatgagggaaaagaaaaattggttcttctgctgtagggaagggttactgaaaattaaaggacaacctactgagctgaagagagctttggggtttggtaatttggggtgtgaggtggatcttcaggaatgccatgggcttcaagactagtgtgtctctcccttagtatgttcctcctcagtttgaaaggacttcctggtaaaggactgaaagaaatgtccactccatcatgtctctgctgacacctagcttctcttctccagttataagtccattttcctactggggtaacacaagaaggaggaagaatagctcaggggtcttcccttcacatctctcctacaaggattgtgaaatgtcatatgcctcctcccatagacttagatagacctaaaattgtcaacatgtgtccagatagttgcaaaaaatatataatttccaacatattctccatattaacactttaaaataaaactgttaatcactcatatgttcaattcaatctaaatatcataatgttttgacacccattatcattaatttaaaaaatatacaaacaacctctttcttaatggttggaaattttacattgctcttttttcccactttgaattcatatttttattctaccccccatgtagaatttttctttttctttttttttttttttttgagttctcaaccctggttacatcctaatgtaatttttttctttgttcttgg

SEQ ID NO: 38392 - DNA, 1051 bp, Homo sapiens
aaatctgcctaggttattgtttagagaaatttttattacaaaaacaaacaaggaaatacaagaaaggcaagttttacgtccatgctttataaaagtaaatacaacaacccaagtaaaatattaactaaataacaccaacagtaaatgagtaactataggatgaacaaatagggtttatcccaggaatgcaaagatgtttcacattttaaaaatctctcaatataattcactatattaggagattaagaaggaaaatacaatgaaatgagtcaattctgataaactattttttaaatgtaaaaaaccatttatgtttaaaaaataaacttttagaaaaccaggaataaaaggaaacctactaatttagtaaaggttgacagcaaagacttctggaaaaattgagtagacatactttttcctattcatctcactaagtacaactaaaaactctggacattatatatatataaaacaaacataagaagactctaaaaggtggaaatgagaaggcagaacagctagaatctcaggatctgaggaatgacatactagtgagttccctgggctttctttttgccacatatatgctgggcttggagctgaagaaagtgacaatttggaaagaccaactggcacaaacaaacaaacaaacagaaaaagccccaacaacacttacaacaaaagccctgatatcactagccaaaagaccaagacagaggcaggcaagcctgtcaagccttagaaagtaactgttcagttctaggcaaataccatagcaataactgtgactctactgccattcacaccagaaagaccaagtgggagacctaaactttcaccctcttgaagctgtaacaaggtgctccaacatcactctgcagtggtatccaagaagaccaattaggaagctaagaatttcatttctgcaagccagtaatggggccccctctctaagatgtcaatggagatgggggcggggggagaacacctgcccagaaataatgaaaatggctaaaagaagttatctaaacagaatggaaatgataaaata

SEQ ID NO: 38393 - DNA, 1029 bp, Homo sapiens
tgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagtacgtttccgcgagccgcgtgtgggaaggggatgttgcaggg

SEQ ID NO: 38394 - DNA, 1054 bp, Homo sapiens
ttaaccacctcactagggccagcacctggattcatcagactattgtgcagatgcactttttcctcatttggacgatattgccctaattttgttcccatctttacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggtgagtagagacattggagccggggaggtgtgggatgagcaagaatgcgtgtgaatgggggtggtctgcctagtgtagatgctgcggcccctagggagttcccatttctcccctgtagggcagttagctaccagatttctgggtatcttggtcctttgtgattgatccgaccgcttgctgtaactatcttggcatctttccttgtgccctccatgtgtccttccttaacttttgtgccctggctccattttacagattcccacctcgggttgggagaggaccacggtggccaaaattcttagcttcttcctttccctcatgcagcccatggatagccagccccagaggtaatgtcacaggatgggaagtttccagagtgggtgggaggtgggtggttagagaaaggcagcaggggcctccctgtggatgtcaagaatcttttttatttatttatttattttgtcccacagtttaattggggccgcagtttaagtaactgttcctttgatgcatagggggggtgtgtgtgtgtgtgtgtgtgtgtgagagtcggggatcggtagtctccctataagcatttatttttctgtggttctgacctaacatttttttatttaggattatcacaaaattataaaacagcc

SEQ ID NO: 38395 - DNA, 1263 bp, Homo sapiens
ctgcagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaaaacaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggtgagtggaaaggttggagtttgaaaaataaatggtatggggagttattttgtcatgtgtgctgcatagcctcaacgtgagggtctcactgttctgtacagttgtaaattggagctatatcacttggtggctgggtatgtagggcactgtttatcagcatagttttgagtttgtgcctctttgtaggatgtatttgagttccgttatgccaagatgccagatgaaccactagaaccagggcctttacc

SEQ ID NO: 38396 - DNA, 1015 bp, Homo sapiens
tgctctgtttcactatacagtgtcccagtagcccacctcttacttggccattgaatggaaaaacagaagctccactctgggcaggaaataggatcactgaattataacagtgggaacatactggaagaggttaatgaagcttcttttgctgacaactctttttgcccttaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacagtacgtatgaaatgaggttcatctcatggttctgaggacagttgaggaaagatggtggggtctgtttgcattcaggattgtcagctcccaggataatgggatgtgttggttggcagctgacgttcaagaagggaacttgggaaccttaggggcccataataagatgcttggggcaatcttaatgtatcctgataaatttctttcattagccattaagaagcctgtgggaaagacaaaggaggaactggctttggagaaaaagcgggaattagaaaagcggttacaagatgtcagcggacagctcaattctactaaaaagccccccaagaaaggtgagtatatactttcatgccactacagattgactccatcctgccttcttgactgtcttttattgacaaatgaagattcagacttgaacgtctttaactttcgaatttgttctgcagcgaatgagaaaacagagtcatcctctgcacagcaagtagcagtgtcacgccttagcgcttccagctccagctcagattccagctcctcct

SEQ ID NO: 38397 - DNA, 1390 bp, Homo sapiens
ggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgagtccttagaagtaatctttaggtctacaatttgctcttgtttaaatgaaaaatagtactgtggctcattcatgctttaaccaagaactcaaaattttgaggtaggctttaggtttttccctgtggcactggatgtgtgaattttctcctgagcagacttaaaatatgagaaaagggtgggaggtagccgaacataagtactttatgcattgagtttattgccttttaaaaggaaattggcctgtaatcccagcactttgggaggccgaggcgggcagatcacgaggtcaggagatcgagaccatggtgaaaccctgtctactaaaaaaaaattagctgggcgaggtggcgggtacctgtagtcccagctactcgggaggctgaggcagcagaatggcgtgaactcgggaggcggggttcagtgagccgagatcgcgccactgcactccagcctgggtggtagacactccgtctcaaaaaaaaaagtaattgggcctactacattgttaaacattgttaaattttgctgccatggtcacacacaaatttacagatagtttattagtagaatactaaagagtattccaacgattaaatcacaaaa

SEQ ID NO: 38398 - DNA, 1025 bp, Homo sapiens
cattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaagaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaat

SEQ ID NO: 38399 - DNA, 1081 bp, Homo sapiens
tgatctcttaagatttttcagaaattgtctattctagactgctccctcttctctttttattttgatgtttagtttccaaatccatgtcccctatacctataccccaccagccacttctaaaccactgataatctttagctattggtgagtgcctttttctcttttctgcccatcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccacatgcagt

SEQ ID NO: 38400 - DNA, 1045 bp, Homo sapiens
tcctccctcccattccaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacggtgagagcttctgagggcagtggtagaagaggggagaggagggagggtggtctgggccacatagaaccatgagcctggtctaactcatcagcactcttcccctatacatcctctatctctttctatgtcccctctcctttcccatcatccatgtccttttttgccttatcgcttttattattccttttttctttcctcctcccttggtcaccttttgcctctcattcatttccttttccatcttctccaactttcctctctcttttcccctctctcccttttaccccctcctcagacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgcagttctgtgtgtctgtttatcaggggtgtacaag

SEQ ID NO: 38401 - DNA, 1061 bp, Homo sapiens
agcggcggccattccccgcagcctcacttccggcaactgtcagtcccggcgagtccgttccccggagtggagctacaagtcccaaagggtcttcctcagcgcgaaatcgttcccagatatttgagttaagttgtttgactccagctgtcccctttcagctctaaccacttcacccaactgcaaatggaaatatggaagtctgaaacacaaactagccccggaaccttcgctgttctcttacctatgaaccttacgaactgtaaagaaaggcgcaccggaagttgtggtacccaagccatactctcataaatccagccaggtcgcgctgaaacagtttccggaagcacttctcctagatcgcaccgcctcttcctcctggaagctatataatgatatcgcgtcacttccgctctctcttccacaggaggcctacacgccgccgcttgtgctgcagccatggtaagactggaatccgtgccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctctagtgatccctgaaaagttccagcatattttgcgagtactcaacaccaacatcgatgggcggcggaaaatagcctttgccatcactgccatta

SEQ ID NO: 38402 - DNA, 1051 bp, Homo sapiens
gccactgcacccagccacatttattttttgagactgtcgcccaggctggagtggcggaatcactcttcactgcagcctcgacctccagggctcaagtcaatcctcctacctcaactttccaagtagttggggctacaggtgtgcaccaccacatctggctaatctggatcttgctgtgttgtccaggctggtcttgaactcctgggctcagtgatcctccagcctcagcctcctaaagtgctgggattacaggcatataggcatgagccacggtgaagccaacccttgatctctttcttgcagataggaactgccatttgttttagtttcctggagcctactgtaacaagttcatataaactaagcagaaaattactcttggcgctggaggcacttaagaatcctaccttgcctcttcctgtcttctggtggttgtcagtaatccttagtgttccttggcttgtagctgcattactccaatctgttgctgtcatctcatggtcctcttcgtgtctctctcatgatttgtcattggatctagagcccaccctaatcaaatataacgtcattttacctaattatttccgtaacgaccttatttccaaatagggccacattctgatgttctagttggacaaaatgaggggcagggctcagtattcagttcctccttcactctccaaatcactttggttcatgagttcagatggcatgggtgctagtgctggtgttgatgtgatgctaccaatgtaagcattagtttctttttataataacttgggcagtcagttctgggcactgacaaaattgagtttgtgatcttggaatactttgattatggggatacagtgatttgcctaaataattgtgacccttagagattctgaggaactgacagcccaataccttaatcaaagcctgtaactcataagaccctggtttactgcatcagcttggagtggcaggccccttgttctcctaaatgcaagaatcagaaggcacttagtgacaactacatatgctgagcaatgggggaaaaaaaagatactgc

SEQ ID NO: 38403 - DNA, 1057 bp, Homo sapiens
aagttacttttttctttttttgagacggggtctcactgtcgcccaggttagagtgtggttgcgtgatcttggcttgctgcaacctccacctcctaggttcaagctattctgctgcagcctcccaagtagctgggattacaggcacctgccaccatgctcagcaacttttcttgtatttttagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactctt

SEQ ID NO: 38404 - DNA, 1063 bp, Homo sapiens
tctctttcttgcgtttagcactctccatagtgagtcctactaatttctccctttctgcttgtctcccttgtctctccttagtaagcgatacgaatcccagcttcgggatcttgagcggcagtcagagcaacagagggagacccttgctcagctgcagcaggagttccagcgggcccaggcagcaaaggcaggggctcctggcaaggcctgaccccatggtggggggaggggaggggaggggagggaatgaggcagctctaggatctatactgtagctaataaaatgtaaaaacacctggctctgtttcctgaccaggcacttctgtcatatccccacagccccttccaccttaacacacaccacctgtattaccccctcaggttcaaactcttgcacttggaatctctttgtggcacagtgttctttcttgaaagtgaaatcctaaatgtcttcaaacctacttcttgcctgtatatacaacccttaactctccctcatcttggttggcatgattcttttggaagggcatttgcaacataccatattgctaggaatgtcggtttaattgaaaaagaatacacagttctctaacctgaggccccaggatgaaatgtggttaccctccttgccaacagccctggcatctctattagtacttttcagcctctgtcttcctagaatttgcttgaatgtagctttaaactgacttaaaatcccagcatgtaatgctttatggtattataagtcctcccaagtttatatgttgtccataaagttgttctgccatttccttgtcctaaaattgttttatacacatttgcagcaagggaccagtggtagagaggttactggagagaaactgttctgaggaaacttttttcaccaatacctcactttttgctctgttcatggggacagaaaacattgtgccccttcctgttccatggcatctaccttcagccaattccccacccccactcatagcagccagttcatatgtactgcaaggacaggggagtagaattcaggtagtgttttggtttattatcttagtgttgtcac

SEQ ID NO: 38405 - DNA, 1090 bp, Homo sapiens
accttccggccacagagagagaatatcccctctcttaaacacacacagccacatccaactcacaaccacttccctccagcctctctgactcttcgatccctccctgccttcctcctcaatctatcatggcctaagcactccacttgaccctttaaattgaatttctcaggtagacaacgagtctgctttgcagatgagaggactggatagtatccaattcgacaggattccttatccagagaggataaggaacttgtccaaggtctcagtatttgtttatttaacaaactctagcaatagagcaggagcccatcacaaaacctagatgtgcttacgtttcaggcacgttctaagcacttgacaaatacaaattcatttaacccttataacagatcaatgtagatgctatttctagtttcccatttacagatcactgaggcgacttggcacagaaacagatctggctctgtcccacactcagctatttgtgccttacagccccttgcaaggggcgggggggtctgtccgaccctgcagcccacttgttacatcattgcaatgacacacacacacaccactgacctccaactcatccttggaggctgcatccagcatcacaaggtccttcaggaaggtgccaaggtatgggaccacaccctgaagtcaggggtcagggtcagaagtgcctgccattgacgtgagggccctccatccctccgcacttgccctcctcattgcctcagagaacagatttcattctcctcacccctctgtgcctcccttacccatccttcaggctgctcccccaaaacatactcctcaccccttcataatcaccacccccacgcccaccaccccgctagtcactcaccccaccccgggagccagacctcggggccttcttggagtgtggctccagaggagactgcagcttcacctcctggtggtgacaaaataaaagagacatgggggagcagtagggaacaaggagaggtgggaatgccacaaaccaggctctcacctgcacgagcagctcccgactctgggaataattatcctcctcggagaaaatctggcagaggctggaaaa

SEQ ID NO: 38406 - DNA, 1392 bp, Homo sapiens
tcctatagaatatactattctggattttggctggttgcttcctctttcccccatactttcacttatttatcatatttgggtgttgtcaacctgacccatccatttacaagctccttattgactttttcacctagtgattttatccagcagtgaccatacctggatctttatttcattaaggggtttctaaatggggatttttctaatcttagttgttctgcattggttagtcacgattcttttatgaagacatttgccttgccatctacttggtttctctgaaattcaattcatacaggaaaaacaagataaatgctgaattatttattgattttcagtattgagttgatatcctagcagcttccaaaggtgaccaatgaatgtttatctgagggttatttttatttttattttttttgagacagggacttgctctgttgcccagactggaattcagtggctcaatcatagctcattgtagccaccaaaagtgttgggattataggcgtgagccacccagcccggccacagtcgttcttctttctgatgctcaaattgccccatctttagccaataggaacctcctggccgggcgcggtggctcatgcctgtaaccccagcactttgggaggctgaggtgggtggatcacgaggtcaggagatcgagaccatcctaacacggtgaaaccccgtctctactaaaaatacaaaaaattcaccgggcgtggtggcgggcgcctgtagtctcagctactttgggagtctgaggcagaatggcttgaacccgggaggtggagcttgcagtgagccgagatcgcgccactgcactccagcctgggcgacagagcaagactccgtctcaacaacaacaacaaaaaaaagagcctccttcagattggtgccagtgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataactggcaccagcctgaaccagcctttggaggccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacgg

SEQ ID NO: 38407 - DNA, 1051 bp, Homo sapiens
cccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagaga

SEQ ID NO: 38408 - DNA, 1031 bp, Homo sapiens
acatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagaggaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgt

SEQ ID NO: 38409 - DNA, 1261 bp, Homo sapiens
ctgaaactcttgggggtagatggatttggtattcagattgtttttcattttagaaaggtaaacttgcattttgtaatcatagacattgagtatttttgtgtaatgcatgtgtttctatgaaatgtgtgcatcttgacattcaatgggataaatagttaaatagcctcatttgtccaaatgaattttggtcccaagtgtacaaacaagctttggttttggaagcgtggacaaggctgcccgtgtcagtgcagtggtcaggacggggcctgggcgcagggctagctctggctgttcttatctggcttcagcctcctcatctggaggggcaccagtggctcctgtcccacagctgttgagggtgtggagtagggtggcagctgtggcagtgttggggaggtaggccggcaggcagcatgacgtgctctgtggtgcactccccgagtcctttccctcccacccacctgcaggaactcgtacgtccggctgcggcacctctgcaccaacacgtggattcagagcaccaatgtgcccattgacatcgaggaggagcggcccatccggctcatggtgcgtgtccctggggtgggggtggggctggggccagggccggagcttgttcccaggtgccctgctgacccctgtctctgcagctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtgggctgcagtggcacaggggttttctgagtgatcttgccctcccagggcctgcatttcatgaagaaaggagtcatgaagcagaagctgggcaaactggggagagagtaggggactggcccctgtggggccctggctgagcctgggaccctggagttgggtgcctcacggcttaggtactcccagaactaaccctatgatggagctggttactgtgttgagcctggtctcaaggccagttatgatgggtctgaggctcagagaggttacgagacttgctcggggtcacagttagtaagtggcagagtcaggatgcaaatgcagcccccttcacaccagactccccgccttgtgccctgtacttcctttccaggttgggatattctgagattctgtgtcttggggccactttggaatccagggtgggtggggctgggcgtgtttggagag

SEQ ID NO: 38410 - DNA, 1074 bp, Homo sapiens
gtccatgattagattacactaaattacagcatacagatatcaggcaattactctttgcttttaactattcaatttcatggcaaatccacatagcgcagtaatgctaaaatcacaccgatgtggttaccaagaaaatacctcatcatctccattttgtgaagctaggttcaagttgcactgtaatgacctgtagtcctgttaagtgtaaagtacattccagatgaacatggggtaatccgtacctctctgtaattgccagatatctggagagattcttgcagatgttgctggataagcctgggtgagatgtgaagaggaatggcatctttgctctcctggttactctggctaccctccctgtctctgatcctggttggtctctggtcctactcattctattgctttaaccaggagcatgtctccttttcttctgttttgtgaaaacatagtcattttctcttcactcagctcacagaatcctccccaacctcctcccaattttaatttcttccaaagctgtggatatcccataagcaatcaagtcggctgtcctggaaactggaggagcttgttggtgaaaaaagaattatttgagccaattgtgagaaatcgaacagtggcaggaggaggaaaacgagagaagaaaggagccgacacatctaaacaagcagccagggcactgtgcatacagatgtaggtggtagctgggtccctgttgcggctcattactgagaagcacatcagaggccgcggggtgagggttggggctgccgggcggcaatgctgagctttgaacggggcttttctgcagaatggacagcaccctctcccttccccagtgctgtagttgctgaacccattcccacctaaacagtgcagacctcctgggcagagtctcctgtgggccccatgtccctccatggtgggtgtctatttcagtgagaggctcttcaacacccagaatctcagggaaaattccccagccagtgctgggctcccccccaacccagaaatgggcaccccctctggtgataggggaaggcggtctccctacagaggcagattccagcagag

SEQ ID NO: 38411 - DNA, 1472 bp, Homo sapiens
gtgccccctctggcaggaagtggggccgggtgcacccgcgtggcggtgcatgcggtcggggtgcgctgctttcccgcgcctgcaggagcggcctgcgcccctccccccgcgcgccctggccccgggtcccgccggccggcctgcaacggccgggcgcagacacttgcagagtcaccctcgggccgggtctggagcctgatgcctcgggggtttagccctagccgctaggcgggtaggcaaagtgtcgggttgaaagggtctccgggaacctacttcttcctgctcgccaacttgctgtgtgaccttaggcaactcaaggcttctctgggctacttttttacgggggacggggaagaaaacaagggaacccccaagataatttcctagggcctttcctgcagagtccttaagtatttgaggagcacagtttgcatgcacagtgtatggaggagacaggcttgaggcccaagcgggcttattacaaagtgagggattggggttaggccctaaatgtagttcctccaagacaggcctctgatgttcagaaacaggtggaaaagacgaacgtttcttggcctcactggaaagggcctcgggccttcatttagttcgtggggggttggctgaggggattaaagggtccccagcagcaagaggtggggggaggcaccagatggtatgagagcttccagggagacccgccaagatctccaggcaggccgggccaggctctctgggattccggactggcttcgcccaactggaaccccctcgatgagggggccccaggcagaccttatatgaggtcagcactcgtttagttgattaattttgatgtttagtttgaagggggacctgtggtgtaatataagattctaatcactgcctgtaattgcagagcaggccaagccactaatgacggagcaggataaatcaccaaccaccttgtttaaaagggtctccaagtctgaaacattataagatagaataattaccaaagtcctgctgtctggagggtctcttgatgcttgaaaatggaggtcctgggccctctagaaatcacaagtttgcaaaaatgtttttttcctctcattggggtaaaaactctttttcttcttttttttttttcttttaaattagacatgggagtcccaccgtattgtccaggctggtctcgaactcctgacctcaagcagtcctcctgctttggcatcccaaagtgctgggattacaggcatgagtcacctcacctggcccataaatcattttcaaatggtctagttcttattttggttagagtgaagatttctttctattattttaagtttttctaaactattacctagtttgatccttgaagcagtcaggaggtagttcaggcaggtaccttataattaccttgatcttacagattgagaggggttcagaagtggagccgcttgtcccaccccttaccatggcaggcagggatt

SEQ ID NO: 38412 - DNA, 1044 bp, Homo sapiens
cttgtcctttttgacttttgaatgtcgttagatgtttatgtagctgaatccactgtatagattaaatgagcttagactctattttacataaaagcacaaaatatcgcacagctttattttatttatttatttatttatttatttatttattttttgagacggagtctcgctctgtctcccaggctggagtgcagtggcgccatctccgctcactgcaagctctggctcactgcaagctccgcctcccggttcacgccattctcctgcctcagtctccggagtagctgggactacaggcgcccgccgccacacctggctagttttttgtatttttagtagagacggagtttcatcgtgttagccaggatggtctcgatctcctgacctcatgatccacccacctcggcctccccaagtgctgggattacaggcgtgagccaccatgcctggcctgcacagctttaaactatagtgaatattttaggaaactgccatgagggaagatcgttttgaactttaccaagaatttgtcaccgttttggaaaatgctgttactcttggtattggaatcaccaatatgataaagttgtatatgcctgcatttttattatttattatttatttatttgtttatttttgagatggagttttgctcttgttgccacggctggagtgcaacggtgcgatcgtagctcactgcaacctctgcctcccggggttcaagcaattctcctgcctcagcctcctgagtagctgggattacaggtgcccaccaccaagcccggctaattttttttttttttgagacggagtcttgccatgttgcccaggctggagtgtaatggtgcgatctcggctcactgaaacctctgcctcccgggttcaagcgattctcccgcctcagcctcccaagtagctgggattacaggcacccaccaccatgctcagcttatttttgtagagatggggtttcaccatgttggccaggctggtcttgaactcctgacctcaggtgatccgcctgcctcggcctcccaaagtact

SEQ ID NO: 38413 - DNA, 1052 bp, Homo sapiens
agcgtacatgttggtcaaagttagggtcagttctgctcagaaactaacgacagccttactgtatgaattttcttatcctcagtttcttccttgggcagttttcaaagatatatgctacacttctctaaatagctctttgaggcagtaacatggataacctattctccccccctccccaagatggagttttgctctgttacccaggctggagtgcagtggcgcaatcttagctcactgcaacctcctcctcctggatcaagcgattcttctgcctcagctttctgagtagctggattacaggctcctgccaccacgcccggctaatttttgtacttttagcagagacagggtttcaccttgttggccaggttggtttcgaactcctgacctcaagtgatccacctgcctcggcctcccaaagtgctgagattacaggcatgacccattgcacccagcagataacctattcttatccaatagtgaataacaagcaatgcctgttagtggaataggccttccttttctgagcattagcaagtacattttcactttaggtaatctagagcctgcatgtaggttttaacactaggaatctaatatttagagtttatcaattattgtcctagatgtaagtttgggaatggtcaagaagcggaagtaaaggaaattaagggaactgtgttaggatgacaagaactgttcctaacaaagtgagacatgccaatacatgagtcatgaggtatagtatcttcaggactagtgtagggaaagaatttgggccctaaccaccgtgggagctgaatggtcaaatgaaagcgggtagagggttgctatccctgagatagagtcactgaggagctctaagttctaattctagaatgattacaggtgtgagccactgcgcctggcctgaagatattcacttctaggaaagaagactggctcaagccaaacagattattagggcttcagctaaacaggctgggttttagcaagtctttgtgcttagaggagggaattagaatgttcagcaaggctactgttgcgaatta

SEQ ID NO: 38414 - DNA, 1011 bp, Homo sapiens
cagaagacattgtggagtactttggttggcttcccttaatcacaggcattccttgggcctcagccctcctgtggtagccctgttgtttgaggcagtgctgttcagtctttagggtacagtagaaccacatgtcatacttaataaaatacagatgttgggcctctccccaaacacctctaaattagagtcttcagtggtagagttcaagcagtgtaaacttttttttcccctcaccaaagttccttaggcaatcctgatgcttatcagaggttgaaaacgactagggtgagattttaggaaagtaaattcaactatagaaaacctcagaatttgtagatttgggtcagtttaaatatttattgtgtgtaaatgttctcttcccaagcaaggttatgttgtaatctcgacatacttagaacaactgccattatatatgtgtttgtatttattcagaatgaaaaaaactaattgactgattgctttcctttatgagccctggggaaaccacttaattttctgcttaacctgtttgagtttccacattcgtgaaattgagttaaatgatgtctcactcattacctcaaaagttgttgtcaggctcaaatgagccaataggctgaatttggaggaccttgattataggctaatattaagttttattaccctgctgcttgtttcttcaaaactatctttgtgtttcctttaaactctccattgccatcagttcttggtttttgatgcttatatatgatattaaatagacttttctcttgctggcttatcttctctaaaggctttgtttaccttataataagatctagattcactggccaggcacagtggctcatgactgtaatctcaatactttgggaggctgaggtgagaggattgcttgagcttaggagtttgagaccagcctgggcaacatggcgaaacccgtctctacaaaaaatttgaaaattagccagagatcagctgcagtgggctcacgcctatagtcctatcactttg

SEQ ID NO: 38415 - DNA, 1052 bp, Homo sapiens
gtttcgccatgttggccaggctggtctcaaactcctggcatcaagtgatccacctgtcttggcctgccaaaggactacaggcatgcaccaccacaactggctaattataggcgtgagccactgtgcccagccagtttttttttttatttgaaattacgatgaggcttacaaataacatcttataccccattattttaaactgatgacaacttaacactgattacaaaaacaaaccaactaacaaacaagcaaagaggaaattaacaaaaactctaatttcatctccctggtttttaactttttgttgtttttctatatattttattataccgtctatgtcttgaaaagttattgtagttatttttgataggctcatcttttagtctttctattcaagatatgagtagttcatacaccataatcacagggttataatattctgtgtttgtctctgtaattattatttccagtgagttttataccatcagatgatttcttattgctcgttaacgtccttttctttcagattgaaagaactccctttagcatttcttataggacacatctggtgttgatgaaatccagtttgtttgcaaaagtatttctccttcatgtttgaagcatattttcatggatatactattctaggataaaagttttctcctggtcctgcgcagtggctcatgcctttaataatcccagcactttgggaggctgaggcaggcggatcacctgagtttgggaatttgagaccagcctgaccaacatggagaaaccctgtctctactaaaagaaatacaaaattagccgggtgtggtggtgcattcctgtaatcccagctactcaggaggctgaggcaggagaatcgcttgaacctgggaggtggaggttgtggtgagccaagatcgtgccactgcactccagcctgggtgacaagagcaaaactcggtctcaaaaaaaaaaaaaaagtttttttccttcatcactttaaatatgtcatgcctctctctgctagcagactgagaagtctgctgccagacatattgaagctc

SEQ ID NO: 38416 - DNA, 1056 bp, Homo sapiens
ctgtgttgtcactggaaaataggagctttttatctgttaataaaatgagaaacttttaggaattacctctgtaagttaaactggttctttcagtttattgaaataatagaaacttaggaaatgatcctttaagagtatctaggctgggcacagtggctgacgcctgtaatcccagcactttgggaggccgaggcgggtggatcacttgaggtcgagagttggagactagcctggccaacatggtaaaaacctgtctctactaaaaatagaaaaattagctgggcttagcggcaggtgcttgtaatctcaactactcgggaggctgaggcaggagaattgtttgaaccggggaggtggaggatgcagtgagctgagattgcgccactgcattccagcctgggcgacagcgagactccatctcaaaaaaaagagagaatgtcctatttatttatttattttatattgacaaattataattgtatctatgtggtattaatactaagcgatcctatgatatatacacacacacatacagtgtgggatttttgagccaaactaattaacatctccgtcacctcaaatacttaccatttatttctcctgtttaactgaaacattacacgttcactaacatttcctcctaacccctcccatttcccttttcagcctctgttaagcaccatcctgctctctgcttttatgagtacagttgttttacattccatgtgtaagtgagcacatgctatttttgtctttcagtgcctggcttatctcatttagcatattgtctgtcctccagattcatctacgttatcacaaatgacaggatttccctctcataaggctgaatagtattccattgtgtgtttgtaccacattttctttatctgttcattggttgatgaacacataagttgatcccataacttggctgttgtgaataatgttgtagtaaacacaggaatggagatagttctttgatatactttttttcatattccttggatatatacccagaagtggatatggtaactctatttttagctttgaggaccc

SEQ ID NO: 38417 - DNA, 1064 bp, Homo sapiens
ggcttgtcagcctgttggtttctctgccttttctcctaaaagtgaataggtgacacctaggaactgtttgggagttggcagcagtttgtcacttagaacctttacttgttttctccagctgctgctcaggacaaaccatcagctgaagtacttaaaagtgagaagagacagcccccaaaagaacaggtgtttttggtgcccacaggagaggtttttgaacagcaggtgaggacctaacagaacagtagctgcccataacccttgggggctatacttgtgaaactggtaaaacccggggttggggggcaaaaaggttgcgtgtgctgcctgcatgtgggtgttttgggttcctgtcacctagcagcggcttctagaagtgctgactagaggataaatgtcaggagctggagacgaatggttgctgaggacatactgcacctgccaatgaactatgaagagggaatcaaggtcttagaaaagatatggttatcttaatcattgacataacttgtggatttttctccttgaactcttcctccctgttccctttactggcggttgttgcaagatggtattaccgtatttaactgttaactacttattgttcctcaggtgaaagaactgcctatcctacaaaaagaacttatagaaactaaacaagccttggccaatgccaaccaggataaagaaaaacttcttcaggagattaggaaatataaccccttctttgagctctgaaaccagtggctcagccatctgtgccaaggagagaggctatcaccagcaatagcaccacctaggacagagggcactgtccagtgctgaataagtcactacggatgccagagggactggggagcactcacttcacttgtgtgggtgtgctttccactagctgttcttacttggactgaggacaagggcaaagcatgattgtatcccaggaaactggggcttgccctgtgtgtggcacaagcatcatgtcttgcctgtataaagccttttggtcctctgtgtactaggtggaatcttctcaacactgtagggccatttcacctcatggt

SEQ ID NO: 38418 - DNA, 1195 bp, Homo sapiens
aaaaagaaacatgtaattgcagtggtgtttacaactaattgatcacaaccaatcatagatttctttgttccttctccactctcaacacttcatttgactagaaaaaaaaaatgtattcaccaaggaacaggacccaatttgttcagacttttgttaagtttctttactaaggcaatttttgaaacaccagttactatgggatggtgggaatttttcatgcttaagaaatagagacttaggaacaaagaaacatctttctggagaagatgctaatgggaagttacctaaggcttgatgcttggttcaaccttatttaaaatttttataaatgacctgaaagtaggattttacagtgaaatcaaatgtcactacttccaggcagtgaaaggtaatctagaagaggtttaaaaaacacaaaaccggtcgggcacagcggctcacgcctgtaatcccagcactttgggaggccgaggcggggagatcacgagttcaggagatcgagaccatcctggccaacatggtgaaactttgtttccactaaaaatacaaaaattagctgggtgtggtggtgggtgcctgtagttccagccactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccgg

SEQ ID NO: 38419 - DNA, 1042 bp, Homo sapiens
gacagaaaaaacagtacgcaggaaacattgtctccaggaacttttctctcttagagtgcatactggctctggggaagggcctgagtgagcagtgcccctcggggatcttctgcctaatcccacctcaaccaccatctagccgtatgatcttgggaatattttttactcttcctgtagctcagttttcttaccattaaaaaatgggtggcagggggcagtgtttttagcgtttcctggcagaggtccaaggaaaggtgcatcagtgtgtcttaaaacatctgcagagttagactggggaaaggagcgactgcttactgtcctcttactgtgtgccaggaactgtgcaaggccttttacatgcctggtgcgaaaggtcaagaagagaaagaggtctgtcttctcccttcatccatgggagtgtgtgagtgggaggttgctctctctgctcgtgaaactttcatcagcaaatactaattagtgcttaattactatatgttgtgcataccactgtagcagataacttaggaacacaaaacttgacaactcccttaagaaattggcttggttatctgtgagttttcactatcaatgactgaataaataagtggggcagaacagacaggtctttcttacagaagaattccaattataaatgtaggaataatgaggggaatagaaaatcaccattagcataccatagtaataattgctgcaggcaagatctaccagtgaagaatgaaattgggtgaaagctgaaggagaaacaatatttatatggcttcaaagtatcttccccagaatatttattaattcctatggcagcttcaaccgatgtccacttgttctttggtagtcctctctctaggagatggaatttaattctcttccctttttgagtgtgggctagacttagaaactggcgtccaaataatagaatatggagagagaacagtggtaactttatagtgggaaaatctggtagccactgcctttaccgagtaatgaaggttaacatcaccagtgataagtcatgctgatgtca

SEQ ID NO: 38420 - DNA, 1045 bp, Homo sapiens
ttacctacatacacatctgttatcatcatgaagataacattccagtgccccagaagtctcctttgtgtcacctgctagccaaaaatgccgtccttgaggttatcactgttctgaccttgatcaccataaatttttgcctggggacatgtttctttttctccaccgtacacccatgttcatgcagaacagtggagtgggagcagggcagggtctgtatgtgccaaatactacactagacacattcccagacttaaataaattctcccgtaaaacacagacctgggcttatataacttgtctaaactcaatcccatgtcattgatgccaaagtcagtgttttttccattgcgccatgctctatgtcttcaactgacatttgccataatcattatcattatcattaatgaaaagtcatctgacacttgccagtagtttatatgatcaaagaacatcagttaacacccagttctcatttctaagtgcgtttaaatggtcaagagcttttaacataactctcttgggaagcagaatgaattaagttaatttagaaccaaaagataatggcaatttcttcatttaatgagtgccttgtttgtgcaagatcacgtgctggccaacggagttatagagagaaaagaagtctcaatcccagctttgtgatcttctgatgggggagatagagaatagtgtgatgagtgctatgaaacagagggatgctggagcatcagagaggaaacaaggggcagggctggggaaatgttcctccccgaagggatgaggtctgggtggagtattagaactaaaaggagttgtacagacaaagaaggggaaaagcgagagttattttaagctggagtgtgtgtacagtgtggtggctcagtgtgtgcgaagaatgggtgtctggaagcattgtgcattgagacgactgcaggtaactgcctggtatgtaggagggagaggggttctgtggagtagaaagagattagctggggtagtaacagaggtgagatgcccatgtaaaggagttggattttacattgacagt

SEQ ID NO: 38421 - DNA, 1020 bp, Homo sapiens
tgattcttacactgggctattttatttttaaaaaatcattaaaaacattagaatttaaacaatattaattaaggactcattgtttgcccaataaaaataatcgtcacttcgtaaatcaccctaatgaacgatttagtcatcataatttgatttagtgttttcaggacgacattgttcagtgtatttttttattggtttggaaggtagtgagtaagatatttctaagggcaaaaaggaaacagttttgaaaattcttagctaatactgagttggccaggatgggtgaaacagagttaaaggaatgtgttggccccttttcttgtgcacctagaaatcctccagggcccagtaaccattttaggtttattttattaaaaaacaggcctttgggcttcctgtgttattgattcttcagtttctgcagaacttagaaggaaaatttaccccaagtaaagtgagaagagcattaacattgtaccatggatgcctaaaatggtatttattagacacaggcctgttcaaaggctctgagtgtgggagcaggggcagcagtaaagttgtctcttcctggtggtcttataagagcttctgggagcagcagtcagagggcagagctgacctgctgtgcttaagagaacgtggactttgaggccttgccaaactgaggtgattgttccaccttgggcaaattatttaatgtatctgatttctttcagctataaaatggggttatattttattctaaaatggaattttgcctatcgtatatatagaagaccattctgtttgaagtaggaagtattagctagctcatcacttatattcatttccagggtcatttgaagtctatctacctgacgagaatataaatcccatcagggctaaggccatgtctgtttgtttttctcactatgtctccttgcccctaggtcagtgccatgggcttggtaggtactcagatatctggcaagtgaaggagtccccgtaattagtactgcagctgtcgggaaaaagtgtaga

SEQ ID NO: 38422 - DNA, 1074 bp, Homo sapiens
gccttggcctcccaaagtgctgggattacaggcatgagtgctgctcccagccttatatacactttaaaagacttgatcctgaaaaagttttagttgtggttggtaaaccacaatgtttgtagttcaaaaagctggaaaacagttccttgtgaaggttcccccaggagattgttgtttctaacagaaaattaaatactgacctggagcaccttttcagtctcctggcttgccttgagtccaaacttactgtgtctttgagacttttgcagtctggctcacttctcttcccacactgctttgcactagatgcttcaatattaatttaacaaatattaagtgccttctctgtactgggaacgatgccatttgcaattcccttgaacctgggccctactctgtcttgcatctagacctctacacatgcctctttgcctacagaacttcccatgcttcaatctttaacagcttttgggctcattttagaaaatgcagttggtggtggtgaagtgcctagactctggaggctgtgtgggttcaaatcccagctctgctacttgctagcagtatgaccttgggcaagtttcttaacctctttggttcatctttaaaatggtggtaatgatagtagctgtctaactgtgttgttctgagaattaaatgaggtaatccacagtgcacttagtatattcttagcacatagtagcttcttggcaactgttagttagctattattatcatttttatgtgtcacatcctgcaggaagtcttcccagttctgcttgagggggcccttccaaagtactcccagagggcctgttctagaactcctgtcattgcctttattatgctatattgtaatttcctgtttgcttatttctacccacttctagatggcaagctccttgaaagtaggtaaggtctgtcagccacagccatatccgcttgaagatgttagggtaggttttttgttgttgttagtttttgttttttaagagttcctaattaaattgctattgatttattgatgagtgggtctgcttgcctgttttgtcataagtaaggaggtttaaaatt

SEQ ID NO: 38423 - DNA, 1050 bp, Homo sapiens
aattctcctgcctcagcctgccgagtaactcggattacaggcacccaccaccgcccctggctatttatatttttaacagagatagggtttcaccgtgttggccaggctggtcttgaactcctcaggcgatccgcctgaggatctggagtgcagtggtgcgatcttgactcactgcaatctccgcctcccaagttcaagagattctcctgcctcagcctcctgagtagctgggattacaagcgtgcatcaccacacctggctaatttttgtatttttagcagagatgaggtttcaccatgttggccaggctggtcttaaactcctgacctcaagtgatctatccgtctcaacctcccaaagtgctgggattacaggcatgagccaccatgcccagcagttcttcttttttattgccaaataatattccattgtatgagtataccatatgttcatccattcatcagttaatggaaatttatgttgtttccatattttggtttttgtgaatgatgctactttgaacatccatatacaaagttttgtgtagacctatgctttcatttctcttggagtgaattgctgagttatatgttaactctgtttaactttttgaggacctgctatattgtttttcaaagtggctgtatcattttacaatcccaccagaaatgtatgagtgttccaatttctccatatactcactgacatttgttattgtccattttattttatcctagtggatataaagtgatttttgatttgtctttccctcatgactattactattgaacatccttctgtgtgcttattagccatttgtgtatcttctttggaaagatgatttttcaaatcatttggacatctttgaattgggttacttgcctttctgttgttgagttgtatgagtagttcctctttggaagttttatttggcagtctggaattcaaatttatgtccgtgatcattctatcactacttttgtggacgaaatgtctttggcgaaatagattttttttgacacttgctattagtaatggaagcatagaaag

SEQ ID NO: 38424 - DNA, 1031 bp, Homo sapiens
gtcatactggggtaatgttggttcagggttggcaagaatctgatctggtaagagggaatgagcagattgctgaaaactgaatgttagaagttgcaccctggtggccctgggccaattccttacatagtgctctgttcttggaaacatgagggatttccctaaaggacttataatatatggtatgaataagcaggataaataattcactgtggctcaggatcagataggataaatattgtggtgaagatgcagtggatgatctggaatatctgagaagggtgaaattaatagcagccagtgcaatcaggaaagatgtggaggatcaggggacatttgagttgggccactttctgtgcttgacagaataaatatcccatttgtcttgcttttgcgattcttatttgatttcacagagactttaagcaattttacctcaagttttcgcttgagttttgctaggtctgaagagtggtaagtaaatttagctatgagtgttgatggatttttgaaatcagataggaggaaccctgattctctgttaagagacttagtttctgatcacctcagtttagcctttagagcctgtgcctccccttgttttgaaagtgctcccctttccttcaagtgtggactttatgtcctcctccgttttctacccctggcagtgaacactactaggtgttcagcggatgcctgtggaactgaactcacctcgatgtcctttgtgatgtcctctggcatctctgtgggcggagctccctgctactcccctctccagccacaggtcaggcacgctccttcccagggctcctgtgtttgatgctactctgcctgtctacctcagaccccctcacggctctttactttattcagatattctcaaagatcaccttcttagagaggtcttttctgatgaccttatctcaaatatcactcatttcctttttatccccttcctttgctgcctctgcttcctttgctcacttttggcccttatcaccacataggcatcataggatctatttgtttgc

SEQ ID NO: 38425 - DNA, 1044 bp, Homo sapiens
ctcgggaggctgaggcaggagaatggcatgaacctgggaggcggagcttgcagtgagccgagatcgcgccactgcacttcagcctgggcgacagagtgagactctgcctcaaaaaaatttttttttcaaatgggtttagatgaaatagagtttcatataatacttattattgaaggaggcaaccaaggataagagaacaggttgagctttttgctaataaatgggagtagaccagtatcagagcgttaacatttcaacaggaattaacatttttgtccttgattactttcctcattacttcctcagtaactttgatttgttagaacaaatttcacaggttgatttcttttgatccagtgtttcttctttctagagtagactgaaaagtgaaccactgattttcctaaggtaaagttttatgtatcagtattatgaaggaaattttctaacaaggcagttatgtgttctcagtactggcatttctcactgtggtctaggatatgaaagaggtgtttatgatctctgctacagacatcaaaaaccatagagcatgctaattgaattgtgtatgtatgcacagagttctccatctgttcagagacgaaaccttgactttagtctctcaggggagttccatacattatttttttcatttctaagggctaagatgagggcaaaccaaaaaattagatacttaaaaaagagatcgcaaaatatttatttttttctcttctgcagagggaacgtccaccacctccagcaaagccaccgcccgatgaagaggaagaagaccacatagataagaagtattttcccttgacagcttctgaggtagagggttgtgggtttattccccattgctgaaatttgagtttgttgaaaagtgcatcgatgtgtgctttaaaagactttgctttctcatcttctcatcagctctttggattataaatttgtattatgtgtactagtaatctggaataagaccttccaaactcacaaagaattttaatatagctctcgcagacaggcccagtattgatctgc

SEQ ID NO: 38426 - DNA, 1048 bp, Homo sapiens
cctccaaaaagtgcaggtgctgtgggtaaagatgatggcttaaagagagcagaagagatgaggaaatcgatcttacatagttttcaagagatgaatgaaaagctcactgagcctggtaatcaagctggcatttgaattattgctctagcacttactggatggtgactattatttagggaatcatttaacttctttaagcctcagtttctacatgtagaagggatactaattcttacctcatggttgttgtgaatattaaaaagaaaatgcttggcatagtgtctggcacagaaggagtagtactcaataagtagtagctgttggaagccagctgagttaggtgaattggtagaggactcaagtcagttgtttcttgagtatttaaaagggctcaacattccagcaactggagaagagaaagcaaatggctatgaatacccactacaagaactggcagaagatcaaggggagcaaagacagcaaatatgctattaaattaggcatggttagaaatcgtggctggttggaagctgatccaggcaaagctggtatattgaaaactagggaagtttgggggccagaggtcagaggtccaatgacaggtagagaacagacgctttaggagttcaagaagaagggggagatgtaatgaggtaatcaagaccaagtcaatgtgaaacagtccgaagtcccaaagctgggctatacctatgggccccaaggtgagtacagatggctcctaatctgaagattctccactgtgctattacatgtaatcccaaaccaaacttataagaatactggccttccctggcatttgagttttattctgcctctttaaaagggctactcagaataaatcagtctcctttgcagagtcaggagaagggaaaccagcctctctgtgcagtgttagcatgatgagctaagagttcagaaatgactgtaaatgaaaaatggtgataatgatagcagctatcatttactgaatgcttcccacgggccagctgccatgctgatttcctttatgttgattatgtcattgtat

SEQ ID NO: 38427 - DNA, 1070 bp, Homo sapiens
ggttctgggcactggtaagagtagtagaagacagaagagaaacttaaatttcttgccagcctgtgcctttcctctaactccaacccgcacccccatcttgtcctactgttgttttccattttctctaggctaagagaactgtcagaagcccatcagtctgggaagaaagggagcttcatgcctggcctccttgtgggtgggtccgctggcacattgtttgcatgccacagtggtgaagatggggaaactggaactttgcattcttactgagatagtcctcaatacagtttcgaccggtccacgatgaaaggagaatgaaaggagagagttaagggcagtgaagagtgctgtgatagtgctgatggtatttgattgccaaccacctttattctgattatgttcattctttccctttttttaattttattttttttagagacagggccccactctgttgcccaggctggagtgcaatggtgtgacaatagctcactatagcctcaaactcctgggctgaagtgatccttctgcctcagcctccccagtaggtaggactataggcgtgcgccaccatgcgcggctgtttttgtttttgtttttttgtagagacagggtctcgctgtattgcccaggctggtcttgaactcctggactcaagaggtcttcctgcctcagcctcccaaagcactgggattacaggcatgagccatggcacctggccacttttcctttttctgtgcttcagttgttctttcttttataaaacaaagggatagttttcatgttgattgttaaatgtttgtctttattaaatttattttgaaataattatagattcacaggaagttgtagaaatagtccagagaggtccttttttttagtacccctcacctagtttctgcccatggtaatatattatttaactctaatacaataccaaaaccaggcgattgaccgtggaagaatccacacatccacacaccttattcacatttcaccagttttgcatgtatgtgtgtgtgtgtgtgggggggggttatatgcatttttatcatgtgtaagttcatgtg

SEQ ID NO: 38428 - DNA, 1180 bp, Homo sapiens
cttacttgcacttagaggaaaaagcatccaagccctggtacaaaaggtcctcttttcattcctttggaaaaagagcagtgaatgagctcattatcactgcaacccaaaaaggaggaggaggggaagaagagaaggtggctgctccccactgcctagttctgcccctggccaggtttcctggggaagggggcctggatctggcccatagtggccaaggccagatggctgggacaggtggtccatactgggggcagcgctggagccattggatgctttgaaactagctttctctgctgtggtccagaagagggacaggtgtctgtgccccgtctcatctcctgaacgcagagctctatccaggactgctggactccaagaagcaaaaggccttccatttgggcctaagtgcctgcctcacctttccttcccagaggtttctgtatgcaggcgctctagaaatcatcctcactccccagagcttgtggtcatacagtatcagttatctgttgaatgcttatgatttgccaggcactaccctaggcactcagggtagcatggaacaaagccggcaaagtcttcactctcatggaattgaaattctagcgtgagcaatgagatggccaggtctggcctgtgattgcagcctctccccagtctctgctggtctgggagaactgctggggagtgacatagagatgccttgaaagggaggctcttcagtatttctagcagctaagcccagactgtcaccatctcactcccttcagagcagtacatcggaccctgtgggctggggccagagaaggcctctcttagacctgagcagcagagtcctgataccttgcaggctggtgctggtcctgggaagcatctgaaagagacctggaggtcagaccccactggcgctgtggtgagctggtaaggtttaccccaagcctgactgcctctcctctttgttctttcttccatttcagattgagaaaatcatgagttctattggagaagggattgacttttctcaggaacggcagaagatctcaggtaccgtactaagtggccattttccccacagaaactggcagtctggctcttttctggctcaggctttcctctaacacagaagacagacattcagtgggtgggagaggtcagcttcagaccacgtcatgctcctataatt

SEQ ID NO: 38429 - DNA, 1095 bp, Homo sapiens
ctgccgtgttctgtgctgcttgtgttgcatgtgctgggtcccggtgaacagccgccgctgctgcttccctcccggagccctcgctgtgtgcctgtgtccctcagctgcatgaagatgtgtgctctctcctgactggtttatgctgcaaggtcgcagaacttgcccctcgccacggccccacaggggctccagaagttgcatggatgagaggagcggcggggcttgtgggcacttaggagctccctcagccccctctagtgcctgtggggacagactttctgaaatatcttcagcacgcacgctgatgaggagttgacctggagactgttgggatttggcttcccccacccccgacctgtgggcagagatcatgcatgtgcagccgtggccctggagcagctcagacctgggggtgtgagtgggcagcagccgcccgaggctgggcagtgtgtggacagcaccaggtggtcctgtccttggctgtacacagaagaggagctgcgtgtctgctgctctctggtctcttgtatatagtttggctgtttgatggtaatgactatgatgtggcaatgccatctatcttcctctgagtgccgctgctaccgccttaatggtttttcccttttcaagcgtctgccgattcctctctcatcaggtttacggacgctggagcagagtgtcggggagtggctggagtcgattgggctgcagcagtatgagagcaagttgcttctgaatggctttgacgatgtccacttcctggtaagtggctgcaggcctcctcaatggcagggtgctgctcagtggaaacaggcctccctggcctcccctctggccccacaggagtctgcaacagtacgtagacccaaatcccagggaaagctcactgaggtcactcagacaccaggaagtcagccaggtggtatgtgccttcttcccaaactgtccctctccctctgccccagaaacggctccagagggagctctctttgcagatctgcttcccaagaaggagggtccctgattcagccctgtgtcccctccctggctgtgtatcccatcaaggctgggtacgaggagttttatttatttctc

SEQ ID NO: 38430 - DNA, 1055 bp, Homo sapiens
ctttcttctctgtggatacagggatgggggcgtggccacctatgtgctttatgtcaccttctagcctgagtcatcttggtttgagttagacccacccgctccgaggggatctctctcacctgtgcccgccttgctccgctgcctcagttgagggctggggtcagagtcagcatgcagctcgcaccacctgcactctgttctctaatgggggcttctgagggtttctcgctgatcgggttgtgtttggtgcctcctgaatagtggcctgcccagggagctggcctgaggcttccaggagggacccacctcacccagagccatctccaactccagggcaaaagatactgtggtgtgcaacaatgcaccctttccaagccagctttgggacagttaattttcagcttttagaaatcttaagttttaaaatagcaattttttttctttttaaaagttaaactgaatgtatttatggttcttatgacctaactcctgactcaccacgttcctcggggaaggatgacaaactcggggtggagagggggctcaggcaatgcgtggggacccaggttggcccctggctcggagtgttgaggggccttccttctctcaactcaccccttcctcaggctggccgtcagatgggcaagtgagggtggtcttagggtgttccctccctgtacttcaagatgctagaggctgagctgttgcttcccacctctccttctgctgattttggaaagaacaggattcctacccctcaaatagcccgagactccgtaggactggagcagagagcagctgagcaggcctttggagaagtgtggccttgggccaaagcttcatgcacagggcagggcctctgtaagatgcgtctgttcctatgctagaaggaccctcattgagggcggcctgcagctcagtccttccaggggctctcagtgctggcaggtggagtctatacaagaaggaacgtcgagcacccctcgggtgagccgggacctcagatacctagagtggcctgctgtgcacagcatcctgggtaaccacgtgtgaat

SEQ ID NO: 38431 - DNA, 1043 bp, Homo sapiens
cttgcatttgaaggactcttcgatgacatccttggcctgagactccttgccatagtccttaactactacacaactgcaaccaaccactttccagggtttcccctctctgtctattttacagaggcctgcccattcccctagtttcttgttgtcatcaaccttacttaggttgatttgccagacacctctttctattgactccaggcctttagataaactctttcaactagttgccaatcagaaaatctttgaatccacttgtgacctgtaaggccaccacccccaaacttcagctttgagttgtccctcctttccagactgaaccagtgcatacctcacatatatcgcttgatgtcttgtgtctccctaaaatgtatgaaatcaaagggaagggaatcctctatagaatgtaaatttcccccacaagaggcagctttgcagggccatttcaaaatatgctaaagaaatatatttgggggtaaaatactttgtttcggggctgctgtctgtcatgcgatgccatactggagtcaggttggcactcggtgtcttgttgctacagagtccgctgggtcagtcttaggatctctgctttaatgataatgtgggactgttgtgcctgaattccacagggaggagggtgtaatgaggcaggtccaatgcccctacccatcatggcctgaacctgtttttcaggtttctgtgggatccccttggcctagagggggggtccattcagtttcctggggggctgatggttttatttttggttcataccgctgaggtaccagatgctgtctggcagagccacaccccctgagctggccacacgctcccagtcagaacttctctgcggtttggatgtgtcagggtcctgtttccagaagatccgttaaagtcaaagcaaactcctacctaccccggcctcgtggagccttcctgcggtcctgccatttgccccatcctgtagacagggctgcaggaagcagcccagccagcaaccagtgtggagggagagggagtccaaggcccaggccggcccc

SEQ ID NO: 38432 - DNA, 1029 bp, Homo sapiens
gagcctaggaaatgtctactctcaggaaataaaagaacaccatcacctggcaagagacagcggagtatgggaagaacactggtggtcaggtgttaggccctgctctgccaccaggtagctatgtgatcctttgggactcctctggcaacgcaggcctctgtctcttcatctgcaaaatgactgctttattttattttattgtctatttcttttttttttttttttttttttgagacggagtctcgctcgtcacccaggctgaagtgcagtggcgccatctcggctcactgcaagctctgcctcccgggttcacgccattctcctgcctcagcctcctgagtagctgggactacaggtgcccaccaccgcgcccggctaatttttgtatttttagtagagacggggtttcaccgtgttaaccaggatggtctctatctcctgactttgtgatccgcccgccttggcctcccaaagtgctgggattacaggcttgagccactgcatccggccccttatctgtttctttgacaaggtcttgttctgtcacccaggctggagtgcagtggcgcaatcatggaggctcactgcagcagtgacctctccagctcaatcagtcctcccatgtcagcctcctgagtagctgggactacagagatgggcaccaccacgcctagctaatttttgtatttttggtagagagggtttcaccatgctgcccaggctggtcctgaactcctgggctcaagcctccacctgcctcggtctcccaaggtgctgggattacaggcatgagtcaccacacccagccaaaatgaccactttagactaggaatgagttgtgttctcagcccctcctattgtgggagttgatgaattaagtgcttagaataaacatgataatatatgtgtatctgagagcattttggaaactgctgagttctacaccaggtagtggtattggcaataagatttcttccttcattcgctgaagtaatacccagtgagtgcctgccatgtggtgggcactat

SEQ ID NO: 38433 - DNA, 1592 bp, Homo sapiens
tgtccaatttgtaggccattcttcttatctcagctttaatacttcccctttatggggctgttgacttccaggaacccttgggggagacggcgctgagctggatgtgtgccacgggtagccggaggctttgtccaattcttttccccttccaggaaccggggttttgtgtctttccactctggatgtgtggaatacacttataccatgataccccagcctctctctgccctcactcccaccctccaccctgtgctccatccgaaaggactaagagaattctccagaagctgtgctccagaaaatacttgtggtcctcaaccttttttctgtgtactggctccagaacttttttttttcccgtttgagttttgaaatagattgctggcctgatagccctggggctggcgggcatctgtccccttttattattggtggcttgaaacagctgctgattttctctcatatctctttgacaatctttggccaactgaatgtgcctctgatgttggtcactgaacatgttctcttggagtctcttctccctcttttttctttgttcttttctgaatctagggaatccaaattgtccctctttttccctgggagcttaatttcctctgtatccaggaggaacggcaatcccagagctctgttccctttgcccaggcatagtatgaggtatcagattgataactaccctggtgggctgtggggctgcagtagttagaccttgtcaggaacttgagcagacacatctgcttccagtcacatagatcatcttctctggggcttgagagcccaccaccttccatgtgtgtctggatgtttaaccttaccaagcagaagattctcgtcatatccttcagtttgagctcctttatttggcgttggttctctaaagaagtattcaagaaataacatatcctttgtttctacccagtctgatcttggaggattctgaaagcgtgacccactctcatgtttagaaatgaaggctcattgtttcacctggccccaggtttctaggggctcctcttttgatgattgtgctgtctttgagccagattggacatgggagttggcaacctttaggagctgcggtggagagccaaaggaaccagcttgaccagactttaaagttttgtaatcctcttgtacactgttttctgtgaaagcaataggattgtggatggcctgttgttgagccagtcccttctccactgacccccagaccccctttgcagcacttgcaaagatttgggtagactggaccagagggttttccttgttcctgtgaatagcatctctccagggttttagtggatcattctaaagaggtagaggtcaagtgttggacagatttttagtctagtctctggctttcaaggactcctccttactcttttgagcagtttgttacttctggccgtgcttaccccttagtagtgctctctgctgtggtggcaggtgagagatttgagaacaggtcaaggccagtccttgtggagcagcttgggcaccagcagccctagatggatagcttcttgcagtttgtccactctcattttctgagaaggtagtcatgattgtca

SEQ ID NO: 38434 - DNA, 1042 bp, Homo sapiens
ctgcagtgcagtggtgtgatctcggctcacagcaacctctgcctcccgggttaaagtgattctcctgcctcagcctcctgagtagctgggattataggcgactgccaccaggcctggctaatttttgaatttttagtagagataggatttcacaatgttggccaggctggtttctaactcctgaccaggtgacctgcccacctcggcctcccaaagtgctggaattacaggcatgagccaccgtgccccggttctcatacgaccattctgttttttcactttcagtacagtattcaattacatgagatattcaaaattgtaacataagctctgtgttagatgatgttgcccgtaggctcatggaaatgttctggcacatttgcagtaggctatgctaagtaagttatggtgttcggcaggttacatatattacatgcgtttttgacttgtgacgttttcaacatatgatgggtttgtccttataagttgaggaacatttgtagccatttcatcgtctgtgaagaggcctgagtggattttgtgctggagaccggtgtgactcagctccagtgttgactgaccttctaaccatgggcttgtgactgaatgtcctgagccttcattttcttccctgtgaggattaaaatgaacctcaggaaatgctggcttgtcctctttctgtcaagctgggttctgagggggtgagcccaggtaggagtgacttctgaaccagcccagatttacaggcttgggcatagggagcccagcctcagcctgggagcctcatcttccattaaatagctcctggcattcaggggagtgcgttgcagcaccccatttttttttcattgaagtcctgtcttccagccaggcacagtgaatcacttgaggccacgagtttgagaccagcctagccatcatggggaaaccccatctatactaaaaatacaaaaattatctgggcacggtggcgcacacctgtagtcccagcacaccagagttcaagaccagcctgggcaacatggcgaaaccccgtctctac

SEQ ID NO: 38435 - DNA, 1054 bp, Homo sapiens
gctagtctcgaactcctgaccttgtggtctgcccaccttagcctcccaaagtgctggtattacaggcatgagccaccgcgcctggcttgcagtaggcatctttgcccaacccacgtgaatcccattagttctttcttgacagctctcagtctgtggtcatatattaagcaactatgtgttcagtactgtgctgggtgctattgctgaagatacggaaatagtaatgccacaagtccctcttcttagagaggagagcttgcactctagttggagagaattcctagcacacagaaagctgcaaccagtggtgcccaacagtaatgctgtctgatgccactgcatgcaagtgtgtccctttgacaacttggtgcttttgcccaaaaggagctgttctctttctgaggcttggactattcgtttgttttttctcagatgacttgctggcactgttacagactggtctgaattaactaggactaccttttatctgtttctgaggaatagccccaaatgtgctctctcttggtctttatgaacttttcctttcttccatttctccaaattatgatagattaactttgcagtgtcatctgctaatctccaaggtcttctaggggcacgtcatcagcagttgctgcttttgaggtatcaaggtttgtcctgtggagtctcagatagtttctttacctgttcaatgaatctgattttccatttttctaggagagtgtatctcaaagtgattgctgaatcagaatgtctgggagtgtgacttggaatctattactgaagattagaggaaaatgtagcaaattgtgatctgaagcatttatggatggattgatggattgatggatagggattctgactgagttaggtagtctatagtctcagacagttgtggaagctccattaggtcatgagcaacccagactccttccaattctgtgccctgccattcttagggtgtggctgctgtcctcatggtccaaaatggttgccgtggttccacatctcacagtgagatagaagaagacagaagaatgatgtctcacct

SEQ ID NO: 38436 - DNA, 1049 bp, Homo sapiens
atatttgtcaggaggtgggggaaacctgctttcccccacctcctgacaaatatataaactggaaattgatccagtcctggatcagtttgggtcacacaacagggtcggcagtgttggcccacagagggccctgggccccttatttcccctttggccctaggctctgagctctcaggttttggctaccaagcaaaaggtggagttgcatcagttgttgctctttaccaggcccccaggggttgctgtcggtgagctcacaggatgttttcttctctctgctttgacttgtgctgaatttctgactgaccccatgcagcatctgcgtggcttctggggcccgagcccaggtttcagcaagctgcccatggtttaccctcaggatgaactctaggaagctggggagcactgtggtggtggtataagttcagcccctcattttagtttatttttatgttaaaatgtttattaatacaaaataacacatagatcagaatgttgtatgacagaaagggactgactggactcaggatctcccaccccagccccaggggtgaaggtgaaggtgattggtttcctgggtatcgttccttccacggtttttccatgcacgctctcatgtgcgtgtgtttttatcctcatcctgctcttcaccgtggcagtggggagcacactaaattgctctgacacctagttagttttttttttgattgagtgtatcttgggaatctttccatatcagcatatacagatacactgcattctttttttttttttttttttttttgagatggagtcttgtgctgtctcccaggctagagtggaatggcacgatctctgctcactgcaacctccacctctcaggctcaagcgattctcctgcctcagcctcccaagtagctgggattacaggcacccaccaccacgcctggctcatttttgtattttgggtagagatggggtttcaccatgttggccaggctggtttcaaactcctgacctcaaatgatctgcccacctcggcctcccaaagtgctgagattacaggtgcg

SEQ ID NO: 38437 - DNA, 1053 bp, Homo sapiens
atagatcagaaaattgagactcacacaggttaaagtaacttgcccaaggtcacactgccaggactagtagcattttttctgtacgtcatggtgaggagctgtatatatgtatgtatgtatgtatgttttgagagacagagtcttggtctgttgcccaggctggagtgcagtggcgcgatcttggctcactgcaacctccgcctcctgggttcaagtgattcccctgcctcagcttcccaagtagctgggaatacaggtgtgcgccaccacgcccagctagtttttgtattttttagtagagatggggtttcacaatatgttggccaggctggtctccaatgcctgacctcacatgatccacctgcctcggcctcccaaagtgctgggattacaggcatgaaccatggtgcccagccaggagctttatttttaactttatcttgaaagtcaggtattctgggctattgcctttgtacccttatgtcgggggtgttacaggcccatttgatgatttgatgtagaccctcccagaaagatggaagtatgaacatgcttctgttgcacagtttcaggggagctcctgaatcctctggagatctaggcagaaggacctccaatgtgaggcatcaggagtcattcaagggccttcaacctgggagtaacttcatcagatctgtactattaagaagcatctggcttctgtgaggagtgggattggagggtgaagatacagggcctgagacctgtcaggaggttgtagcaacagggcagaaagagaaagtgtgatccaaaaggaaggtagctgtcacagtagagtgtctgtgaacctcagttttctcctctgtaaaatgggagggtcttgaggattatatacagcaatgcatatatatgatgtatatgtatgtttgtatatggattgatgcatataaagtgctgccacatagtaaacacacaatgattgtcaactgttactaatgtggccggcttagtaaattgtgcagctagtatttggctccaggtctacctcgttaaccatggtgaaataatgagatt

SEQ ID NO: 38438 - DNA, 1350 bp, Homo sapiens
aaatctttacgctgcgttgtttaggcagtggcattagactgcttttacaggtaggaagcagacattcccagttgtcacgtgtccagggtccacagctaagaaataggcagaattcgagcccaggcagtcttgaccagagcatccgttgtacagcggttatgccatggatcatgggtcagcctggttttctgagagcatgttttgggaccagtgaaggtccagaggactttctggaaaccgtttgggctagggaaaagactgaggcggggtcttagagagggtgctgcttggaggtcacttacatgattgattcaagtgcgtttctggcctgccacatttgaggtgtgccttggtgaccaggttctaagcaatgccaatggcttcctctctctatcagccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggacaggccatctgctattcgtccaccaacctgacttgatcctctcttccctcctcccaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttccctctgtctgcctgtgattgagggtggggggtggtttgtcagctgacaagtgagggccttggcactgctgatggctagttgtgtagtttgtcactttgatgatggatagttgggtactatagggaagaggatgtttttctgccatcaaaatcaggcagtcttgcatatgtgatagggttgctaacggcattgaagctttttgacaggattggtccatgtaaatttaaaataaggattttagtcagcatttctgtgttaagaagaccacatgtggagtatcctatgctttgggttagtaatgagtaaatgttaaggaaaacaaggcacagcaaaccagtacaaaagtataa

SEQ ID NO: 38439 - DNA, 1068 bp, Homo sapiens
attagttgtgtgtgtaggtatataaagagaggtcacacacacacacgtttattcttataatatattaataatagatctaaattactgacctgctttcttccctccaaaattcataaaaaaatgaaaatagaaatgaaatcagcattctttatagctcagctgatatatattattacccaatctcaggaataggaatgattcttagacagtaaataaaacttacacttatttttaaaaattcagcctcttagccaggcacggtagctcactcctgtaatcccagcactttgggaggccatggtgggtggatcacttgagatcaggagttcgagaccagcctggccaacatgatgaaaccccgcctctactaaaaatacaaaaattagccaggcatggtggcgagtacctgtaatcccagctactcgggaggctgaggcacgagaatcgcttaatcccaggaggtggaggttgcagtgagccgagcttgtgccactgcactccagcctgggcgacagagcaaggctctgtctcaagaaaaaaaaaaaaaatcagcctttttagaaccgatctactttctatgtttccatagctgtgtaatacagtaatgagtgggttaaggcattgtgtctagaatatgtgtggtgaacctgttggacttgaatgtaatcattccctaatcttaccacataaagatgggattaataaccagcaccacacctgtgaggagaaattctggaatgcctcatcttgcctccagataaaacatgttcctccttcctttaaggtaaatgcaggaatattgtcaatgaacaaaatcctttcactagtcattcctgaaaaagaattacagttggaaaataaaaaaaatactcctattttagaacctgtaatgtggaagacttataatgaggtgaaaatgtagcggtggatttaaaactacaagatacttaattatagccatgcagtaagttatactatatatttgtcatgcaagaataacatttgtaagaaaactgatactgacacatgtatctttctaatccctacctttgctgtttttgttttctt

SEQ ID NO: 38440 - DNA, 1034 bp, Homo sapiens
tgctagattacaggcgcgagccactgcacccggccccattttaaccattttaagtttacaattcagcggcattaattacattcatgatgtacaatcactactactacctatttccagaattttttcatcaccgcagatggaaacactcagcccgtgaaacagtaacttcccattctcccctctggtaacctctgttctttctgtctctgtggatttgcttattctagaaatttcatagaagtagaatcatattatactgtatttgtccttttgtttctggattatttcacttagtataatgttttcatggttcttccatgatgtagcatgtatcagaatactattccattgtaagtatttaatatatcccacattttgttgacctgttcatctgttagtagacagttgagttgtttttacctttggctattgtgaataatgctgcagtgaacattgtcatacaagcatctgtttgagtccctgcttttgattcttttggttatgtacctaggagtggaattgttgcatcatatggtaactctatgtttaactttctgaagagccaccaaactcttttccatagtgtctgcaccattttacatgcccaccagcaatgcatgaggattcctgtatctccaaacttgttctttttttttttttaatagtcacccaagtagttacaaagtggtatctcactgtggttttgatttgcatttctctcatgactaatgattttgagcatcttttcatctgcttattggccatttgtatgtcttctttggagaaatgtctattcaagtcttgcctattcttaattaggttgtttgtgtttttgttgttcagtggtggttctttatatatcttagacccttatcagatacatgatttgcaagtattttcacctattttgtgggttgtcttttcactttcttgataatgtcctttgatacataaaacatttttaattttgattaagttccaatttattttttttctgtccttgctcatgcttttttgatgtcatattttagact

SEQ ID NO: 38441 - DNA, 1029 bp, Homo sapiens
aattcacacataaaaaatattaaccttaaatgtaagtgggctaaatgccccaattaaaaaacacagaacggcaagctggataaagaatcacgacccatcagtatgctgttgtattcaagagacccatctaacatgcaaagacatacaaaggctcagaataaagggatggaggaaaatttaccaagcaaatggaaagcagaaaaaagcaggggttgcaatcctattttctgacaaaacagactttgaaccagcaaatatcaaaaaagacaagggcattacatagtggtaaagggctcaattcaacaagaaaagctaactatcctaaatatatatgcacctaatacaggagcacccagatttataaaccaagttcttagagacctacacagagacttagactcccatacaataatagtgtgagactttaataccccactgtcaatattagacagatcatcaagcagaaaattaacaaggatattcaggacttgaactcagctctggacctgatagatagctacagaactctctatacagaaacaacagaatatacattcttcttagcagcacatcgcacttaggctaaaattgatcacataattggaagtaaaacactcctcagtaactgcaaaagaactgaaaatataacacacagcctctcacaccacagcacaatcaaattagaactaagattaagaaactcactcaaaaccacacaattacgtggaaattggacaacctgctcctgaatgactcctggataaataatgaaattaaggcggaaatcagaagttctttgaaaccaatgagaacaaagagaacataccagaatctctgggacacagctaaagcagtgttaagagggaagtttatagcactaaatgcccacatcaaaaagctagaaagatctcaaattgacaccctaacatcacaactaaaagaactagggaaccaagaccaaacaaaccctaaagctagcagaggacaagaaataaccaagatcagagtggaactgaaggagatagagac

SEQ ID NO: 38442 - DNA, 1064 bp, Homo sapiens
aagtcaagaaacaacagatgctggtgaggctatggagaaatatgaacacttttacaccgttggtaggaatgtaaattagttcaaccattgtggaagactggtgaaatcctcaaagacctagaaccagaaataacatttgacccagcaatcccattactgggtatatacccaaaggaatataaatcattctgttacaaagatacatgcatgtgtatgttgattgcagcagtattcagaatagcaaagacatggaatcaacccaaatgcccatcagtgatggactggataaaaaaacatggtacatatacaccatggaatactatacacccataaaaatgaatgagattgtgccctttgcggggacactgatggagcttgaagccattttcctcagaaagccaaacaccacatgttctcacaagtgggagctgaacaatgagaacacatggacacatggaggagaacaacacacgctggggcctgttggtggggtgggggtcaggcggagggaacgcatcaggataaatagctaaggcatgcggggcttaacacctaggtgatggattgataggtggagcaaaccacgatggcacatatttacctatgtaacaaacctgcacatcctgcacttgtatctcagaactttaatttaattttaaaaaaatataagaaatactcatttttgtcttaaagccaataatgtgttatcagattagaaattattcttgtttgtgactttgcagaacccttccatctggcctaatgatagcattattattttttaaagaatgaagccctttcttaaaagcctagttgactagggatatcaagtggacacagctgacagaactttgtactagaaaggagggaggatacagaatgtctcttcaggtacagtactaacttatttcaaataccatagatcttgaaatgaataagccactttgaaaattctgttaccaacgcttaacactctgcagcttaaggaagagagaaagttttatagccctgttatgcatcaaataccgtttttctaccagagatcacagccttggcttgctgtt

SEQ ID NO: 38443 - DNA, 1032 bp, Homo sapiens
cgatgtgtgtggtacagtttgacaaacctgggtccatatagaccactggagaacattcagcagcgtcccctttgtagccagtttcttcctcaagctcccaaagagcagctgctcctggggtttcaccatcttctatgagttccctgcagggaactctatgcagtagccacccattggtggtcaggactgtttcaccagaacgatacactcgtagtgaagcgttctctgcagcacagggatgaccgctacatcatcaccagtctgttctttcctggttgtatgtttcactgagtcccaagttccagttttaccaataggagccatgtatgttgttttttcaagtttgacccattttccttctgaaattaactcctctgaaataatatagtgtttccattctgagacaattcagttggttcttggctctcccttttcaaactagtctttacagccctcaggagagaagttcacctccaaagtgtaggggtgacaaagggaagaggacaaaagaactactggaggcagcagtgtcagcatacgccggtgtcacgactcaagacatcggcacctcccgaggtgatgaaaggatgtgccatggctcatcttttcaagtcaactagtatttatcaagctgctctgtggaaggtgctggggacaggatggtacctgtccttaaaaccagaatgatcagactcagtggaaagagagttacaagagttacttgaacaactgtctctgattataaaataagatggagtgataaatacactagaatagagttatagataagctattgaaaaaaatccaagaagacttcatggcagagttcttgtttgaataggacttcaaagtgtaaataggaatagaaaaggcttggaaggacgggagaagggggaggtattctggtttatgagtacataaataagtacttggaagcttagaagtgcctggaatatctgatgtgagttgaagcattgagtgcattaaagaataataatttgagccagagtcaaactaggcttgattcttcag

SEQ ID NO: 38444 - DNA, 1025 bp, Homo sapiens
cagacagggtggctgctgtgctcgtggggcaagatagggtctgggtggccaggataggggacatgacagtctcatagttatgtggggcttttgtctcgatctctaagaaaccagtcaccaattcccacaccatgtctctgcctccagaggctcacaggctagctaggaagacaatgcaacaacagcagccacttctcaggcacttgctgggcaccaggaattctagttgacagttaaatgtgcagacttaggagccagatgccaggtatgaagatcatgttcaccactttcttagttatgtgcgaccttgggcaaattacataacctctccgggcctcagtctctccatctgtaccaggggaataattatattggaatagactagaccaaagcagccctgacatctgggagctgcctggtcctatcagccaggacttggttgctcagagctgtccagcctggtgcaattcggtcttgctgtgctgaacatagacgatttcacagacatcagcatagaacaaggccatccgcgaccagggcagactaagacaaaaatgaaactactccttaatcatatctgaacacagacaaaacatgaatattgtcaaatcacagaaatgacccaaatccccctgtagagctaagctgagtggaggctgctggtttaccagctgtagcttcagccttgctctagtctgctttccttctaggcaagatgtattaagactcccaatcatagtgttagctccacttcctgacagcatcaacccagaacaaagcctcacttccttaacctctccccaatcacctaacacaactccaaacattagactaagtcctttctaacgcccccttcctgggacgccccatgatccccatggtgcatgctctcccttgttgcaacgagtcatcagctcagcttgttcacccacacgtgtgtttctggtgatctctggttggaggcattgaaagttcctacctcattgggttgtcgtgaggaatatgtacttgaaatgatacaatcc

SEQ ID NO: 38445 - DNA, 1057 bp, Homo sapiens
ttatgcagcggcttcacaattattggctgttgaagcggcaggcacggaatggtgtccctcttatccggcgcttgcactcccatctgcagtcccaaagaaacgctgagcaggtaggtgcagtggtgatttgaggctggtagagggaggtggagagtgaaggaaaaggaatgatggttggggtggggctggcaccccttcttgatccctccatggagcctttgcctacctgtctgggtggcctatcccaggaacaacccccagcactacagagatcttcaagcagctccttctggatggatgaggcttgactttgtagagaattctaggggagagtggagagcatgcgtagctttccatatatgtggggaaaatcctctagatgtagcagaaagccagaagtaggctgaatgagagccagggtggccacattgtgttaattaggaaaaggtgccctttcctcaagacattatactgccatctgccaaaaaatgtttcatagtaaatacacaaatttacgatctaagttgtagcacacagcctgtccaattgtggtggctgttagccattagcaactggagttgctgcatgtttaatgttttctgctcctaatttctcttattttaactctttagttctttctccccctttacctgttctattctttctgtctttaagtgttcccacactgctgctccagagatgaagcaaagctttatgtgagtctggtgccttctgcattctgtctgatctcacttttgccttttataactaaactcctgaagtataagcctgtatctggcccgccttgaaccttttggtccacctgctccactgaagcctcccctaaaacatcagctaccttctcccaggaagtctttccttatattctcacctgattgatcattgggctgcatttgacaccacaaatgactttgtctaagagcttctctgtgataccacttccggctgcttctacctctctgactgtaccctatgctgatcccacttcttgctctttaatggtaacattcccagtggctctgctatctgctcgttt

SEQ ID NO: 38446 - DNA, 1056 bp, Homo sapiens
ataggatcctttgccatacaaatgtttttaaatgttttgtggtcagatttgtctttctcatttcgcttttgggttttgggtcttgattaaaaaggcctcccaacccctagattgtaatctcctgtaacattcttggaaaagaatattgttgtgattcagcttctcatctatgaaatgaaaagactatactgaaacagtagttcccaaacatcgccagtcagtgggagatcacttgaggagcgtgttacaagttcagattctccagacccaactaaagacttattgaataagaatctctggggaatggggcccaagaagatgttttaacaagttcctctaagtgattctgattatcagctggatttgagaaccattggacaatatgatcactgaggtctcttctgattctaaaatatcatttctgtattatgtaactcttaaataatacattatctcaacaactagattgtaagctctttgaaggtaagcaagactgtgtcttaggtaatacccttttcttcgctgtcagcccactaagatacttactacctcactcctagacaattttagtaaccttctcttatagcccctccagtctgtctgtggtcttatttatcttaaagcaacattttgaacatgacaccttcctgcagaagctttggctacaagacagaatcctattttaccttataatctaagtgcctctgtaaactagccccaactttttgtctttagctttacccaagggagtgtgtacaattatctaagctgtgctttatacagctccttagatgatgatgtgcatggtcttccctggaattgtatgatatggtggtaaccttgacttttcccacccttttgcattaatccttcactctagcctgattggtttactttctttctctttcatatggtaataaagccttgtttattcttattttcctgccagttatttgtcattcatcttgcctggaatgccctttttcccttttctgtatctaatctctccatattaatagctacacagtggagtattatgcagacataataaagaat

SEQ ID NO: 38447 - DNA, 1060 bp, Homo sapiens
tgaaggaacctagctagcccttctccttccatcatgtgaggacgcctggatgccatcatctttgaggaacagccctcaccagatacccaatttgccagcaccctaatcttgcttggatttctcagcctccagaactgtgagaaaagaaatttctgttctttatgaattacccagtctcaggcattttgtttatagcagcacaaatggactaagacaactggttatctgtagggaataaataggaacagattgagagggaaaaaggggaaggacagagacttctctgaacattccttttttatgagtcttcaacttcggaaccatgtaaatgttttacatattcaggaaatacattttaaaaataatgggaaaatgctatgattgaataaaaagagaaacaaaagaacctaccttacagaacatatagagaaaaaatacacagtaacttttgaatatagcatgctgactgtacatccttagtgggatatgctttaaggacaaaaagaactgctcccttgaccaaaacacctaaacttagtaggtttattgttactagtaatttgacattataattctgaaactagtctatgaaccaagaatttcaatgtgaaggaaaagatacactaatataaaatgagttaggaaaaaccagtattaaatttgaactgaaaacatcagtataaactctatttatgaatgaatgagagagactgggtcttgctctgtcatgggttggagtgcaatggcatgataatgggttactacagccttgacctcccaggctcaagtgatcctccttccacagcctcctgagcagctgggacaacaagtgtacaccatcacacaccagctaatttcttatcttttgtagagactcagtactttcggaatatgatagcctcttactgtgagttcataatagtcctagaaggaggtcttgtagacattttagattttccccatccccctctgtttcccctcccccaaacttcatcccattttaacctattcccagaaattctgggtgtcaccagagagcattatgtgcagcaaaacagaa

SEQ ID NO: 38448 - DNA, 1046 bp, Homo sapiens
caccatgttagtcaggctggtctccaactcccaacctcaactgatctgcctgcctcggcctcccaaagtgctgggttacaggtgtgagccaccacacccagccaaaacctttttagttttcaagagccattgtaatttccttttttgttaatagtgtttgtgccttttgcccattacaaaatcagattgttagttttttacttagtgatttgtgaaagctctatttgtggcagctctttctaattaaggaaattaaccttttatgagttgcaaatattttcttattcagtgtctttttagctttggtaaacggtttaggctatgcagagatgttgtatttctaaaatcatcagtttttcttttatggcttctaggtttaatgttgtacccagaaagtccccaccctgagactataaaaatttctcttacggtttatgtattatttaacatttaatctttgatccatctggattatttgggattaggagtcaagtatatccttcattagtttgattttgttagcttctctctttcctcttaggtctttactccatggctaaccctatattttttctttttcagttctttatagctccaagctctacagattcttcaaatatattgagaatagggatgttgcaaaaacagtgttaaaggaacggggcctaaaaaacattcgcattggaattgaaggtaaaaaaaaaaaaaaaatcccagtcaacattcaggttgggtctattgccacagcttacatcctcaaaatttagcctccagaggcctagaaaataggcatacatgaaaaccacattcttactcaagtttgaatgttcctgttttttcctcatttttcttttcattttatctccagttgaaaatggttcaaagcagccacagaaacaagttcgagtttactacttcaggataaagagcagcaagggcaaaggacagtggtagggagatacagcagggcttgtgggctcaccagatgagagcgtcgttctgccaccagtcttggtgaagatgtttctggtatctggaagggtcct

SEQ ID NO: 38449 - DNA, 1057 bp, Homo sapiens
gcggcgccagattgagacaaagaggcgccgccgccattttgtgacgttcagcacggggcggtggcgggggctcccggcccatcggagggtttcctagtcttggagtggaagtctttatattcctcattggggcatgagccaggatgggggttacctgggagttgggaaccacaaaggggagccgatagccgagttgtattccaggtcacggcctttttatttttatggcgccttttttttttttggcccctcatttaattgggaagcttctcagaatgtttttgtaaagtcactaaccaagaccggacctttcagttcatattaaatggcccccgtagtcaccttactttcatgtagtttcagattttgcagcctgaatctaatcacctttttctaagaccgaaagatcttccttgaacttaagattcgttctttcatcgcttcccattaaaatggaggcttaagacaggtgccagcagtgtttttaaaaattttcaccagtggtttggtcttagaacttactcctgggcacagggtgtggtcacggcaaataggatgtgtctggactggatattttaattagacaagcccagagtaagaagaacgtggtgtttatggaaagcacttcagctgaattattgagtagatggtttttatgtaattgaaactggtctacaagtttatcagattcatcgtcgaagtgactcagtaataaagctttatcaaatacaagtccgccaaggaagaacaaaaaaataagtccccaaagtgcagtaaattttttagtagcaaatatctctttgtaattttttattaaagtgaaattatctttaagtggtatttagtatattcagtgttgtgtaatcatcacttacacgtagttccaaaacatttccgtcacctccccccgcaggagactactacccattgagcacttactcccagattccctgtcccccttcctctagtccctagcaaccactaatcttcctgtctctctgaacttagctattttagatatttagtatttatggaatcgtgtacttttatgtctggc

SEQ ID NO: 38450 - DNA, 1854 bp, Homo sapiens
gggcattttgtctttagtattctcacatagcctacaacctgttcctgttaggaacaagccaagatagctaagaagttacggaagccatgcaatatgtcaattacattgctttttataaatggacaacttatgtgggcatttttgggcagtatatgacttccttgcaggctcttaagttggaagggtttctgtaaaaaggacagttacgggtataatatggctaagagaaataatacagaacctgaaataaaagtaacttcaccagggagttatcctgacttaggtgacatacagtcccagttggcagttactttaaccaggagccctagcataacctcaagactcttagaaactttagaacatggaaattgttaaaagctttgaattgcacatttagattgtggctattaggaatttttaaagttgtaattcctaaaataacaggtcacactaaccggtcttgtccatattcagggttgagtgtaaaaatgaaaggaatcacaaaactgaacttagacctgtggtttaaggatcaaggtgttcactagaagtcactgttactaatacttgatgacaatgtaaagaaacattaaggattatatttgattgttttcaaagacactggctggatgtggtggctcacacttgtaattcctagcactttgggaggctagggcgggtgggaggatctcttgaagccaggagttggagaccagtctgcccaacatggcaagattcacatttctattaaaaggaatatttagtttgatctctggttcacagttcattgtgggttgcttctgacctccatgtcttaagcagaaagtagggaagttgtagttttaccaagcacaggtaccctgtgtctaccatttgagtatcttagagatccttacaaacgtgatcccgtcagcgtccatgacactcccaccctgttagactgctgtcagtggctttcacacaaacccatatgtggatggaaaatccaggttattactacattcattttagtacagtgctgcctaattagaaattttgttgaagaggtatttcagaatagatacagccagactccaggctcattgacttagtttttcagggtgacctaaccctgtgtaattttgaggagttctacatgataaatacccttggtgatgtgagaaccactagtttagtattttgtccaagtatgctttttttcagagttctgaatgagatttagttgtcatacctagttggtggtaatttcttagttgtatatttttgtactaccagattgttgccttctggttttccatcttttcgagaaagatttctagttaaagttactgaagaaaaactgggttggaagtacatttttctctaaataatccagtagtgttgaatttgattttatgtccactctaatttttttcatcctgttttattagggggattcatcgggtacctgaagataattcagctgtagaccccttaaggttctgagacaaggtcattgaaatttgttttggctgggtgtgatggctcatgcctgtaatcccggtgcattgggaggttgaggcaggtggatcacttgtggtcaggagttggagaccagcttggtcaacatggtgaaaccccgtctctactaacagtacaaaaattagctgggtgtggtggcaggcgcctataatgccagccacttgggaggctgaggcaggagaagtgcttaaacctggtgggtggaggttgccatgagccgagatgtagccacttcactccagcctgagtgaaagcaaaacttcgtctccaaaaaaaaaaaaaaagtttgttttggtaagcctagtataattgattagttttgtccatgcaact

SEQ ID NO: 38451 - DNA, 1049 bp, Homo sapiens
atctttagttttcctcatttctgatgtaaggcattgtatagttgttctactataaaagatgtagaatatggccatgtagtgcctcactgtaagttagtacatgtgtcttgagcaagtggaaatatcaaaacattgatactttgcttctccctaatcatttggaatgtcctgagatggatactatttccagggcaaaattaaaccttccagaaaagtagtctataggttgaaggagtcctcctcttttgaaagccttgttcatttgtggttgtgcacctttatttcagtatatacttcattcagatttcatctggggcaagttagcattcctgtttttgttttgttttttgagaccagtggtgacatagcttactgcagccttggcttcttgggctcaagcgttcctcccacctcagtctcccaagtagctaggactacagtcacacaccaccatgcccagctaattaaaaactttttttaagagacgtggttatgtttctcaggctggtctggaactcctcaagcgatccttctgcctcagcctcccaaagcgctgggattacaggcctgagtcacctttccctggccaagttagcgttgttcactgtttttttatttgctcacaaagccccaaaatgtagagctaaggggaatgttgttgaagttgttgcctaatgctgcctggagctgggcagtggcaatggggggtcggggagggggtggggtggagatgtgaagtttatattggtcatttggagaaggaaatatttgaatattttaaaaaaatgttatgtaagtcttgagatacagaagtttattttttatttaatgttatttatgtatttttttttttttttgagatggagtctctctttgtcacccaggctggagtgctgtggctcgatctcggctcactgccaccttcgcctcccgggttcaagcaattctcctgcctcagcctcccgagtagctgggactacaggcgcgtgtcaccacgcccagctgctttttgtatttttagtagagccagggtttcaccatgttagcca

SEQ ID NO: 38452 - DNA, 1050 bp, Homo sapiens
gaggccgaggtgggcggatcatctgaggtcagtagtttgagatcagcctagccaacatggcaaaacaccgtctctactaaaaatacaaaaattagccggacatgatggtggacacctgtaatcccagctacttgggaggccaaggcaggagagaattgcttgaagccaggaggcacaggttgcagtgaaccaagatcacaccattacactccagtctgggtgacagagcaggactctgtctcaaaaacaaaaacaaaaacaaagaccaacagcaacaacaaaaaaacaaaaagtgcaaggtgaagcagcaagtgctgatgtagaagctgcaagttatccagaagatctacctaagataatggatgaaggtgactacactaaacattttcattgtagaaaaaagccttccattggaacaagatgccatctgggactttcatagctagagaggggaagccaacgcctggtttcaaagcttcaaaggacagtcttactcttgattttttgttttgcttttggtacaggctcttgctctgtggcccaggctggagtgtagtggcacaaacacggctcaacctcctgggctcaagcgattctcctgcctcagcttcccaagtagctgggaccacaggcacgcgccaccatgctcagctgatttgtaaaaatttttttgtagagattgggtctcaccatgttgcccaggagaccagtctggtgagaccccatctttacaaactcctgaactccgctgggattgcaggcgtggagcttctatgccccgcccaggctaactcgttgaggactgaggcagctggtggaagccaatgctcatttattgttctgaaattcccaagacccttaattgtgctgaatttactctgcctgtgccctataaatggaacgaagcctgggtgacagcccatctgtttataggatggtttactgtttttttttctttttttctttttttttcagacaggagtcttgctctgtcgcccaggctggagtgcggtggtgctatctcggctcactgcaacctctgcctcccag

SEQ ID NO: 38453 - DNA, 1034 bp, Homo sapiens
atatttttatgtatatatattatatatatttatatatttttatgtatatattatatatatttatatatattttatgtatatatattatatatatttatatattatgtatatatattatatatattttatatattttatgtatatatattatatatatttatatatattttatgtatatatattatatatttatatattttatatatgtatattttatatatatttatatattatatatatttatatattttatatatatacacacacatagagatatatgtacatatgcatagagataatacacatatattttgtaatgtgtatatatacaccatatatattatctattcaaaagtaaataaagttgaacattttaaaataatgctttgcggcgctgcggcagtccagatcaaaaatggcggcagttggtgtgttctcggtttctcggctgctgggtcggtcccgcccacagctggggcggcctatgtcgagtggcgcccatggagaagagggctcagctcgcatgtggaagaccctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccattactctgcacatggaccagaaaaagtatatgggaccttaagctcaccttctttacttgtatcaaatgatgactggtatactggtctcccatccctttgcttgtggcgggagatggcttaaataaataacttaaacttaaaaaaataaaataaaataatgctttgtctttaactcagaagtttcgcttctacgaatttatccttagtaaatgatcatggcaaagatttagcttaa

SEQ ID NO: 38454 - DNA, 1003 bp, Homo sapiens
cgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaactcgtggcttctaatcgtctgtgcggaggcattgctaacctgcatttattgagcatttggtaagtgccaaagaattgtaggagaaaggaattctcagcctaaatctggcttccttcaacattgggatttctaggatagtcatcttcctgaaacgaatgtatggtcaaggggtaggaccagtattgtcaaaatttgggcaatatctggcatgggaggcctaataaaataaccttttccagattacaattttaaagctatgcaaataggatagatgtgacaattttcaagtgttcaatagccatttatggctagtggccacctcatataaaacatcattgcagaaagttctattggatggggctgatctagagataacaaatacatacctattaccaaactaacccttgaagcttttatcagttgtctgccactgatagtaaaacattttgagcatgtccccttggtacacgtgaagtttattgaaaaactattgcctctattactctcggttcctgattcaagtttccttcacctttagtgtgaggtttagtttcttttcgagactgagtctctgtcaaccaggctggaccagctggcgtgccactgccagtggcacgatctcggctcactgcaactttcacttcccgggttcaagcagttctacctcagcctcctgagta

SEQ ID NO: 38455 - DNA, 1088 bp, Homo sapiens
atatgtatacacacacacatacacacacgtgcacacacatatatatatattataattttttggttttttttttgagacagtctcactctgtcgcccagactggagtgcagtggcacgatctcagctcactgcaagctccatctcccgggctcaagcaatcctcccacttcagcctcccaagtagttgggactatagccttgcaccaccatgcctggctaatttttgtattttttgtagagacagggttttgccatgttgcccaggctggtcctgaactcctggactcaagccatttacctgcttcagcctcctaaagtgctgggattacaggcgtgagccactgcacctggccaaagacattttttaaaacacacagccataatgcaattatcacatctaaaaaatagtaatagctcctttatgtaatctaatatacagtcgtattcataaatctattcaacagtttgaatcagggtccaaatcagagctgcgtattatagttggttgtctttcttaatcctccagctcccatccatctctctttcccttaggagtttgtagctgtagcccttgtttttctggccaagcagtaacattacactggtttttaaagtactttactatttgcaaagaacttggacatactgatttcctttagtagggcccaatatctctttaaggtagatgtatcaagccattttataaggtgaaatatccaagattcaggggtctaatgagcttcttgaactcaaatacctgtgcttggctttaatacctgtgctctctatatgacttggtggtgtctcaacttcaatccttgtccttggacttctaatggcttcacctattatatttaatgctctaaagcaggcagtgcctttcttattgcttatctttctaaaaaaaattgtagtagaagtatgtttattaaaaaatcaaaacaacattctactgtaaagatatatgcacatgtatgtttattgcaacactgttcacaatagtaaagacttggaaccaacccaaatgcccatcaatgatagactggataaagaaaatgtgacacatttacaccatggaatactatgca

SEQ ID NO: 38456 - DNA, 1051 bp, Homo sapiens
ccatttcagcttcaattatgtgttgaatttcctcaagtggacgcttaatgatccttctgaacagattgtttatgctgaatgaagcccttcagagagcatttgctcctccctttctccactgctttttgctggtgcactcagctcacagtttttgactaaatgtttgaattttatccacccagcaggcagaaaaatagaactaaaccctccctcccactctctgaagtgctggggaactatctcactggctgtgaaaacaaagggctaatgggcaaacaacagcccccatttcagtgccccaaaatagggttcagcaccttgtctgttgttccctttgctccctagatggctaacagtttggagtgggtacagttaccgagcatggcaccttaccaacttatgacctcatgttgttagtcaggttttcctccttaagacgaaagacagaagtagagaacttttaaaattgacttatttttaaggtatattttgggatggcaggtatatcagttaggattaagtttggctgtgaataatagagatccagaatttcagtgctggctgggcatggaggctcacacctgtaatctcagcactttgggaggccaaggtgggagttcacttaagcccaggagttcaagaccagcctaggcaatatagtaagatcctgtctcttaaaaaaaaaaaaaaaaagacagtgccagtggcttaaataaggtagaagtgtatttattcctttggtaacaataataattatgccagctaacttttatgtaatgcttactttatgccaggcactgttgttagcacttttcatatattaactaacttatttaatccataaaatatcctatgacactagtactgatattaccactttaacagatgaggaattgagacacagaaagtaaagccatttgtgcaaagtcacatagctactgaatgacagagccaggacttgagctctgcagcctggcttcagagtctgctcttagccatgtgcttgctattctgtctgacaaaaaagccacaggtcactagggctggtgtg

SEQ ID NO: 38457 - DNA, 1045 bp, Homo sapiens
gatttacttaatgcagaatttctgttaacttctcaaacccttttgtgtgctgtgatctttgctaatctccaagatggggatatctaatgcaacatttctcaaccatatttgtctgtggaacccccccttttttttgagtgttctgtaggattgatgttttgcagaacccatcttgagaaataccatcttgttggaattaagtcctagaagcactcacaggcttgactcatcttcctttacatgcataccttctcttttgagtggcaagactgtgggtctgccttatcagaacttgggaattccatctttaaaataaactgtgggggctttctgatcctagctgttctccctatatatgagtgtgagtgtgctagacagctcactgagctgaaatcaaagaaattttccaggccatcttcagggatctgagtataattcattgaacatgagacctgaagtatcattttctaaaactgaacgaacaaatgccaaggaagagaaagatatgttggacctgatgggactagcatgagaaatggcctgtccagtgttgtagtgagatcttcaagaacaaatatgttcttgaagggacatatttgcccacctgacacagacagtagaggggcaggcccttgtttcttaacatcaggttagcctggtcctcacttggccttaaagaccccattgaagacactcgaatctatctttctctctccatttttagataagacctctggactttcttcaccttttgttttacagaagaggatgtggagaactttgacgtgaccaacttgtctcaagacatgctgcgaagcattgaggctgacagcttttggtgcatgagcaagctgctggatggaatccaggtgagctgcttctgcccttgtgggaacaaacgtctaggtccagaggctcccagcagggctttggtttctttcttgctcttctgtatcaggcaggaccacccacccacccactatggctcctcctccttttcatccatctctatccttcttcattggctttacagctttcaaacagc

SEQ ID NO: 38458 - DNA, 1085 bp, Homo sapiens
catgaccctttccagcgcactgagtgctgctggcagcaccgggatccttccacatctcagcaggaaggtgaagtgagaactgtgctgttatatcaagttcttctttccccttggtttcctatcaccaggctctatcggttctccttcagcagctctcttcagtacgcccgttccccacttccccagccacagctctggtccagcttcctcctcagagggcttgccttctccatactcttctcttccaaactatctgtcacgcaattgcatctttctgcagctctgttctggccacgtccctcttctgctctgaagcctcccatagctctccattgccttcagcatccagcctgtcgtccggccttgtccttcacgttatgatgtaactcataactcctgggcttgatatggggtcctcaggcctggctgataccccagcaggactttatacagcttcccaggacttgtgtggggtggggaaattgagatgtggctcttcctaaggcacatgtctttgaggaacagccttacaggaattcctcagctttggcctagagtcatagaatgttagaacgaaaggacaactcaggaagctctgctgttgactgatgtttaagtgaggcatggggagagaagtcggtgggatctctaacactagtgaagttgtagtagctcccataggactctgcctgtcctgacaccagctaacaaatgttattcccaggctttcctactcattggattttctgcttcacccaagcaaagcctttctcccttacctgctgcccacccccacccccaacattgtatatctttctctcttctttcccaggttctcttttcatgaaaaccttcattgagttgttccactcactctattttatgacttagcatttcaatcttctgaacccatttgtttattcacagttacttcccgtatgtcacatgtggaattttttttccgctgtgtcttatcaccctggcccagctgttagccctcacgtttgggccccttgtgcaggtctcttgacatccctcaaccggagcctagcacagagtgtatgctgccctcttctgggggataa

SEQ ID NO: 38459 - DNA, 1075 bp, Homo sapiens
gagtgctagagagaatattgagcattcagcctggaaaagttggcaggactgggtcatgcagggtgttacagacatgttgcagagttagtctaggggcagggggaaacagaagatatgaagtggagatctgactgttgatgtttgtgtttttctggataggttagtctggctgtagtgaagagacgacatggtgctgggaacaagaataaaggcagtaatcatggccagtgatgatggtggctaggttagagaagtagcagcagggatggccagagtggatagattcaagaggtagttaaggaggtagaatccacaggtctgtgggactgatgtgctgtggggactgcaagggagctcagatcatgtctaggtttctttctattggggcacctgagttgatgatgatgcatttactaaaataggagtagttggagcagacaaatttagttttcaactggaaagtttaaggcacctgaggacatcaatggagctgttcagtggttatttgaatgtgtggatctggagcctgaaggacaggccaagttgagattctaggtttggggatcatgagccatggaagtggatgaaccactgttaccgtctctgtggtattaagagccaaagggcaagttcttagccatgagaaacaccaacattaggggatgagtagtagaagaggggcctgcagggcagactgatgaatggccaaagagagagatggaaaaagagggatgtggggcagggatgtggggcaggcagagctggcacatgcctgtcctcacagctacttaggaggctgaggtgagaggatcacttgaagccaggagttcaagaccagcctgggcaacatagtgagacccccatctcaaaaaaaaaaaaaattaggcatgatggcatatgcctgtgatcccacctactcaggaggctgaggctggagcatcccttgaacccaggagtttaagtctccagtaagctgtgactgtgccactgtactccagcctgggcaaaagagccagaccctatctctttaaaaaaaaaaaaagacattacatggtgtcctttgagccttcctggc

SEQ ID NO: 38460 - DNA, 1034 bp, Homo sapiens
ctgtttgtcagagttttgtttttttgttttgttttgtttttttgagatggagtctcactctgtcacccagactggagtgcagtggtgtgatctctgcttactccaacctccacctcccggattcaagcgattctcctgcctcagcctcctgagtagctgggattacagatgtgtgccactgcgcctggctaatttttgtatttttagtagagacggcgtttcaccatgttggccaggcatgtcttgagctcccaacctcaggtaatccacctgccttggcctcccaaagtgctgggattacaggcatgagccactgtgcctggcctgtcagagttttaaacatgagtgactccattttgattttgacaactttctctggctgtttttaacatagtttatttggctttagtttccagcagtttggttatgatgcatttggaagtggatttctttgggcatttactgtttgggaaattctgagctttttgagtctgtaaattcatgccttttgccattgtttggaagtgtttaaccattatttcttcaaatattttttagcgccaaatatttttttctacctccttttctttgtagggactctgatgacataagtattggatcgtctggtattgttccctgggtccctgaggctgtattcacttttttttcccatttgtttttcacgtttgatacttttcattgatctatcttcaagtttagtggcttcctccacccccatcatcatcattctgctattgaacctatctagtgaaatttttgtttttgttactgtactttttaattctaaaatttccattcggttctttctgcagagactcactatctttctattcattttttaagagtcttactcctgtgttttaggttatggttataatggctattctttaaattatggtaaaaaacacaacataaaatttaccatcttaaccatttttaagtgttgttgaaagaaaaactttacataaataaagtttagcagagattatttgagaaaagaatcaattcatgaa

SEQ ID NO: 38461 - DNA, 1782 bp, Homo sapiens
gggaaggcccagaggaagatcagtgccatccacatcctcgatgtccttgtgctgaatggcaccgacgttcgggagcagcactttaaccagcggtctgacctgggccccagggtagggagggtgggggtaggccagggcagcttgggaggacagcggcctcccgaggtgtggccccttatctaggccttctctgcttgttgacatcctgagagtttccccctcccacccactgactggtcccaaagtcagggtgagaattggagttgccacttcagagtttgctagggcttgggccctggttatcagagataccagcacactccattttgccacagctgctcaggttgaggtatttatgttaaggttgagcaagagggtgaccttgcgggtagagggggtactccttggaagaaatatcctgtgcttgagtggtcccatttaagttgctcatctgagtgggtgcactgtagtttccatgctttggggtgacagggcagacacatacaataaagatgatacttgaagttctagtggaggtgactgagcacagctgaaggcacacttcaggaaaaccaaccgacatagtgaaattagaggtcagaatccacaggggcggggcatgaataaagacgtcggtggagaagggcagggcgggcttcctgggggacatgggtgctgcctcttagagcagtcttgccgcagattcagaaggttctcctactggagctgtgaaaatgccctgggggtaggggtgctggtggaggcatccttggcttgcctctcagagagactgtttggattgtagaattcagcttgccgagaaatttgtgaaagccgtttccaagcctagtcggcccgacatgaatcccatcaggtgagcatgtggtccctaccctccatgcttctttctggccagtacctgctgctcccgtccagtgagggacaggagggctcagtggagggcactaggcaagtgggtgttagagacaagaccattcttgccatgaagtttgtttgggggtgctaggtaggtgacttgccccagagcatctccccatcctgcctggcagtgggtgaacttcattctgaggggttaaggcatccttgtttaggatgcacgtgcttctgagagtgccagcccacctcatgaatacccgttcccacttgagcattgttagcacattacctggccttttaattttttttcaggtaagaaatgggtgctgagggaataggaattttgaacatgaaaaagagaaggattgtttgagggaatgggacccccagtgctgagggagaaggaggccagggttgtaatgttagatagtgggaaagttccaggaccctgagagagaaaggaggaagagaacagagtcaggaggagacagatggaggacacacttttccagggtaggctgaggtctgaggttattgccaaagggcactgcttagccctgctctcgggagcttcatgcggctggagactgaggtatctatttacactttatccacattgtttttgttctttttaacataaatttacttagttaaaattaaatccagtattgagaatgcactttatagatggcatgtgaaagtttcaaaggaatttctttctgcactttaaaatgtcctgtctgctaggtcctgaaagacagctcccagggggaaccctgccttcattgcttgtggtttggttgctcgatttctgggaacgttccccactagcagttccaaagacatgttcagggcccccaagagctgagcatgggcatcaaacaa

SEQ ID NO: 38462 - DNA, 1026 bp, Homo sapiens
agatccagtttcctcagttggctctcaaattctcctctttctcaatttaagtaaaaatgataaaaatgttgacagtgggtagcatatattgtttggccatcatgtgttaaggcgaaaaaaatgtgaggtgggaaatcagctcctcttcctccccccattactgtttaaattctcctggtaacactttaagcttcatggattgccacctaacaggtgcctccatcataccacatgactgtagttctgcagtaagaaagctggagactttgaaggctggcttttgtgatttgagtcccttttctcttttatcgttttgttttagttttattttttgagagattccgtatatttggagacatagaggcaggaaggaagattgtttctggtgaggacatcttgggaagaagtatggaagtagttttccctttgctatctcccatattgtaggaatggttaacagaaattaagagtaattttgggagtgcagagaaagattagaaagtggatcttaatgtagacttctgtggaagttgtcgtatctcaaggttatgacaaagaagtggattttcattttctcatttttctgcctttctcaaaaatttccctgtggaaggacattagtcaaaaataagttgtggcatataaaaagtcctaaaaatgtgaaaatatttctagtcttcccttcattttgatttgaaaataattggtttgcctgtgaagtgctttcatggactgtctaattcccacaagaatcttgcgaggtaggaaccattatctcattattagctggggaaactgaggctttgggtggataatttgccgcttcacacagggagtgtagggtggagctggtgagctctttagagtgcgtagtaccatcatgtttatggtatcagtctgctgccctggaaaaatcttgtgtcacaagcctcagattgtaactcattgtaagacatatgtcctaaagaaagtcgctgccagtggcagctaatgctcaggatgtatcaggtctctttcctggcaaca

SEQ ID NO: 38463 - DNA, 1014 bp, Homo sapiens
ctagacataaatgttcagtctggtatttagagaataatggaatagttaaatatggggcttattaggtaaattattcattgttttgattttaaaaaagaagctcttctaacaagtcatgacaaagcaaatatcatatgggttcattttctttagggaaatagattttgttagtatttcatttttataatcattgctgttgaagcattttgcctacaaactaaattggctggataaaagatgtactttaagatagggatgggtagagataaggataggggtaatctcctaaaataaatttcatttctgaaatcggtaataatagaaagttgattgaaaacataacatgatttgttttattccactttatttttggcaatcataagatactgactagtttagaatcaatgtatatattttttccctctgagcccaggcttagtgaattgctgtcaaacatcacctttgttactgtcactgtgtagatcatctagctagtgtgcttggctcctcatagtgtgtggacttcacactcattttgcctcttcagtctcagtctcccaattgtaacatgttgccacactttaaccagcttaacttgggctttcaagatcatgtgaacacagtatgaattactaatcagtagaatgttcgttccattgatgtcactacttatcccttgattataaaacccccttaaacattctattaaaaaacaaaatgcttgcttgtggagttttactttgcatctttgagtattgtgtgcatctgaagataaaacatgatttaaattaagtattcactgtcggttcatttatctgcttgccctattttcctcattacatttgggggattcagaaaataggaaactcgtccctttgatgtgatggaacacagggaaataatttttttttttaatttaaagaaacatagtcttctttctattggtttgaggcaatagctttttagagttaggtccagttagcatatggctcttttggttttatcatcttctct

SEQ ID NO: 38464 - DNA, 1054 bp, Homo sapiens
tccagtctgggcaacacagtgagactccatctcaaaaaaaaaaaaaaagtgtctaataatcagaatctaaaactgtatcctagaatggcactgcccagtatggtggccattagctgtaagtaataatttaaattcagattaaagttaaaaatgtggtttctcagtcacagtagctacttttaagtactcactagctcagtaactagtgattaccctattgaggaacacagatatacaacattttcatccttcaagaaagttatgttggacagtgctgttctagaatgttgactgatgggcagccagaattttcaagcctgttttcttgtgggctctctagatccctttttttcttacattctgaacatgagggacttagctaatttagctctaaatttctttccggccctaacatagtttatttccactgggagaagcaatgctattgttaatccagattactgggatgtgttcctttggtcaggaatgggaattaacatttcagtaatgggaattataatgtagtctgtaatttgaaccttttttgaagtgttacttttgagtcagacattttagctcttttagcactgttaaactggcaacctcagcggcttgtacagggaggtattggtctaacaatcagtttctttttggttcaaagaatttttgaagctactcacctttttgaaagttgataggttgtagataggctctagttagcttttatgacttttgtggaggaaaaatatttgttttcacaaatgtaaatctcatggcagctttttatatgtgattagggataagtgcattggattttctggtaaattcaggttaccatatatagagaaaggtggggtatattggaatttccagcagtagtggacaaaaccaaactgatctgtgatgcacccaggctaatagaaataagtgaatgaaaatgcatgtcatccatgaggctgagggacagagctgcaacagtgccaggcacctgaagttttggctacagctattaactcgagggatgatgtactagctaactacatctgttcattta

SEQ ID NO: 38465 - DNA, 2819 bp, Homo sapiens
tcgctgtgtcgcccaggctggagtgcagtggcgccatcttggctcactgcaacctctgcctcccggattcaagccgatttcttctgcctcagcctcccgagtagctgggactacaggtgcctgccaccacacccggctaattttttgtatttttagtagagacggggtttcaccgtgttagccaggatggtctcaatctccttacctcgtgatccgcccgcctcggcctcccaaagtgctgggattacaggcatgagccactatgcccggcctggatggtattattctttttcttcagttgctgctgaaatctaaaaaaaccaggtttttcaagtccttatgtgttcgtgtgtgaaactttgcttgtacatacaaaatttttacattgtttaactttactgcatgcagtttagtttgccttttccttttaatataacttaaaggtattctcttacgaagtggagaactgttctgtggactgatcagcagtgggtttgagcctgtaaatcgccactgcactccagcctgggtaacataatgaggctttgttgctttaaaaaaaaaaaaagtggaggatgccagacttggtggctcatgcctgtaatcccagcactttgggtggctgaggtgggcagatcacctgaggtcaggagttcgagaccagcctggacaacatggtaaaaccccatctctactgaaaatacagaaattagctgggcttaatggcctgcgcctgtaatcccagctactcgggaagctgaagcaggcgaatcacttgaatcaggaggtggaggttgcagtgagccaagattgcactactgcactccagcctgggcaatagagtgagactccggctcgaaaaatgaaatgaaataaaataaaataaatggagaagtgtttttgtatattgacccacaaaaatacttgcatgtagaaacttttaattttttttattgatttgggaggacatgttcatgtagtctctgaggcctgagttccctgtttctgtggatcagtcactgttaactagctcaccctgttcccccaacctcacccatgctgtagcacttccaatatgtgcttaaaaccgtgcattttatttgtaaggctgatgatcttcttcagggaatattgagcaggatctattaaggaacagttgctttgacttaaatgaaaaagtctttgcaactgacagataaaatcttgagtgaaaatgtgtggagtactgcactcttgtatagtaggatctctttaggggatctcaaaaatcctgatctgtggaagtgtatgtccctacaaactgcattttcttacccttggttttaaactttctaggattatatattctaatatgatagttgaaagccaccaaatttacctaaatagttttcattctaaataaattagatttttacattgtgtgtgtttttggttggagttagggacaggaagagtagactgttggttttgtgtttaaagttgcggtgcagaaaagtcattggacagagatctgtgtaatttggaggtgagttggaagggaaaggacacagaaggtggtcaaaggggaagactggggcaagggggatgaggatggggacacacagaggaaagtagaatggtgggattataattgggaatgaagttgctttgtggccaccatcgtttagtcaaactgtgagaggtggtctcatctgtaaggctagagtaattaatgtgaaaaggtggtggttagggtgaatgagatgttctgtcttttcttgaagtgtggtatgtgagtcccctgggaccttacaggaaagtgctaatgatcacaggatgacagctgagatacagattccaaactaaagtttagtggaaatagcagcagctttcagcaaaattggtgttccatcattttagaaacccacgggctcttctgctaagaccatagataccttcttagccagttaaagaaaaatgcttcatggtttctctttgcagcaggccatggagactcaacctacctttcttttattgatattgccacaacctattaattccattccttgggattgatttttcttctctcctctttcccccatgcctggtggggaattcaacagtcttgcccatcgtctgtttaacttgctcttcttagaaaaacaactcacacaagcccttcttttttaaaagattttacagtgaatacatatggggaagttacattagatcttaaagaatttaacagtagtatttcctggggaatgggaccttttcttatttgctgagaggctgatgaagggccccctttctcgtctatcccaaactcctccaaaactccgaagatgaagggcatactgatctcttatctccagaaaaccagctgaaccaagtggctaggcatgggttttggaatcaaagatctggattggaatcaaagacgtgagtttacctctgtgtctctttatctttaaaaaaatagtatcttagagttggctttgagatttaatgagctctgatgcctctcaagcccttgccacagagcctggtcatggtaattacatttattaaaggccagcttcccaacttgaaagaaggagcactgatggcagattagtaaatacagaactatcttacctcatatgggaaatttgcatttatagtgatctccagactgatgccaccttattaattggtgaagtttctgaccagcttttggcccctttggccattttccagagccagtcctttttccagcaagtgttaagcactctattgtgtgtcttgagctatgctaggcaagagataccttggtctggcttctgccctgagaaagctca

SEQ ID NO: 38466 - DNA, 1046 bp, Homo sapiens
attagtcaccaaattgattttcttggttttatctgtcttgtctctccctccttgccatcactgtcaccctaattcagtgagcctctgcttcctgcttggcctcttgcctcttttttttttttttcttttttgagacagtgtctcgcactgtcacccaggctggagtgcagcggtgtgacaggcacatgccaccatgcctgactaattttatcgttttcttttttttttttcaggtagagatggggtttcaccttgttgtccaggctggtctcgaactcctgacctcaggtgatccacctgccttggcctccttacgtgctgggattacaggtgtgagtcaccacgcccagccattgatctgttgcctcttactagagcttcttgttggattccagttttttcccactctattttattcatttgtggcctttggaaaatagatctgttcatttcatttacccaccaaaaaaggataagttcttactctttgaaataaaaatcaaactccttagtctgcctcctgaaataaaaatcaaattccttagtctgcctccaaactatcttgtttagcccagtctcccaccctttcccacatatactgtatttgagctacgtaaaactaattgttgttccctacttacagtattctctgaagatctcaaagtgttgttgcacagttatgaatggatttcataatgaccctgaatcctaaaatagaattatttttaaaatttttgttcaagaatgaaaggcagtatatgtatagaagtaaagatttctgtccaagagagttaaaattggaaaaaaataccttatatctaaggggacagattttcagccattaggaaaaattggctacttagagaagatactcaggtgcacagaaatttgaccagctattatagtgtaagttgcacattgcctgtttgagctccctcagtagctcaatttctgttgttgtttttgttaattaaagattgattctttaaaggcacagaaacaatagctgatacattgcagtaaagtgttcatcttaggcatataaa

SEQ ID NO: 38467 - DNA, 1808 bp, Homo sapiens
cgctaagggagtcattttggattttgtggcaatttaatttttttttttttttttgagacagagtctcactctgttgcccaggctggagtacagtagtgccgtctcgtctcacggcagcctccacctcccaggttcaggcaattctcctgccttagcctcccgagtagctgggatgacaagagtgtgccaccatgcctggctaactcttttttttttttttttaagtagagatagcgtttcaccatgttggccaggctagtctcgaactcctgacctcaggtgatccacttgccttggcctcccaaagtgctgggattacaagcatgagccactgcgcctggcagcaattgaaatttgtgtccataatttagttcagggcaacacctccccgccccatattctttggcagaggtttgaaccccatattctttgacagaggtttgaacctaatgaaagagggaaggaatttagttttgatgttagagacttttttcttaccagggacacttgaatcaatatgttaaaatttgaagagaggagtgagtactctctctagtatcttttctttttggggggcaggtggtgggactgcattgatttaaccattgtgaaatctaggttccattttgaaaaagaagagcatatgtagaccttcatgtactttgcatatacacagtgtacttcgttggtgcctcagtctttaaggattaactaggaagaattttctttctgcatagaaactttataaaataacgacattgttaataattcaggcataatattacattatacctttcttgaatgctgacgttgcatacaagggtgatctgtaaacctccatcatttccttgctctcacttttagacctatttcctgacataaaaccttggtggtagttctggttttttttttttcttcttctttttttatttttgagacagggtctcactgtgtcgcccaggctggctggcatgcagtggtgctcaagtgatcctccagcctgtgcctcctgagtagctgggacaacaagcacaagccaccaggtctggctaatttttatatttttggtagagacccagtttcgccatgttgcccggccggtctcaaactcctgagctcaaagtgatctgccccactcggcctcccagattgctgggattacaggcatgagccactgtgcctggctggttctgtttcttctctagtcttacttctgtcaggctcacttacctgacttcatgtagaagcattcttcctggatccatgttattctcttttctgctaacctgatattctctttctagcagtgctagttacttgtttctttcagtattcagcatatatagcttttcgtgactgcttcagattacactcaaaattccacctgcacaatgaagcagataccacctacggacttccaccttcccttatttccccttccatttagtcaggggcaccctccactccacctgtgtatggtttgtatttactttaggttgtctttaagttctaaactcctcaaggcacaatttgattttgttctcttgatactgtgcctaatacctttgtatttcataaataataaaatatacatatttcttattttttatatacaataattttgtgaggatgtatttaataatgctaattaacaaagcaaatactgtacctaaaacaaaatgcatggttataattgtccgtttggttttttatttttattttttttgagagtgaaagtttattacaaatgaaagatttgacaaattattaaaaaagctgacaacccacataaacatcgcaaaatctag

SEQ ID NO: 38468 - DNA, 1123 bp, Homo sapiens
tgttccatccatcttcagggtacttctcatgacatttcatttgagcaactaggctttgtattttgttactgcttgcatttagcactcaattcttacttttagataataagaaaaaacaggtattttaaaaaaggacatgtagctgctaataatagcatgagtcctatggttccttctctgttcatatcctagctgacaacacatacaagcattgctttgctggaatattctgaaattaacaattttgaataagtttatacatgtatgtttataaatcctttcccagttaacattttttaattttgtgtttttaagtaaatagcacttcagtttgagtccctataggttgactattatcaaatttgagatgcttacatgagtgatccccgattgctgatatttggacatttgggtctcaatagagagattgcaggttgaatggaaagaccatgaacctgagagccagaagccctcagctctcttgttctgacactgttactatctgaatggctgcgaagaagccctttatttctttgagatgtggttgccttttctgtaacatgtgatctgtattgttctacctcattgggttgtgtagatagagttaatactctaaacaatttcacaaatatatagtggatattattattaatagtaagttttatggagtaaacatattaaaaggtactcaaagtgtcggaagtatggccagactaacactatcacattagttataattgttgctaattcacaaaaccagattgctttatcagtttatttcaagataagcacacagttctggtattgtagagttcttgataatctgagatttgaatatcaacatatagaacagcagtagttattctaaattcaatttttattttgaaacaatttaaactatcttgacaattcatcctagttttcagtatgttaaaagtgactctagccaaatggcagagcaggcagctccaaacacactaatctctttacagaaacatcggaagatgagcagaaactgtcagaaacaactttatcgaaactctcaaaatagtcaaagcgttatagtaactaaatgttttcatcaccacacacacacaacaaccctgtatgttttagctatcac

SEQ ID NO: 38469 - DNA, 1050 bp, Homo sapiens
gatgcataaaaagaattgtatcccatgactaagtgagataatctcaggagtataaggttggtttaacatctgaaaatcaattaatgtaatacatcaacagaatgaaaaacaaattatatcatcatctcaatagaggcagaaaaagcattttatgaaacaacacttttgataaaaacattcaacaaactatgaatcgagtggaacttcctcaatctgataaaaggcttctagctattactttttaactgtgttattttagtggttacttttatctttaacgtatgacagtctgccttcaagtgatactatacaatttcaggatcttctgtttttgtttgtttgtttgtttttttgaaggtggagtcttgctctgttgcccaggctggagtgcagtggcacaatctcggctcactgcaacctctgcctcccaggtgctagcgattctcctgcctcagcctcctgagtagctgggattacaggcgcatgccacaatgcccagctgatttttgtatttttagtagagacgtggttttaccatgttggccaggctggtctcgaactcctgaactcaggtgatccacctgccttggcttcccaaagtgctgggattacaggggtgagccaccgcgcccggcccaggacctttgtttctatctcttcaactttgtgttattgttgtcatgcactttcacttctccatatgttataaaacccgtactacactgttactaattttgctttacacatttgtcttaggctgggtgccgtggctgacacctgtaatcccagcactttgggaggccgaggtgagtggatcccttgagtccaggagttcaagagcagcctgggcaacatggtgaaacctcatttctacaaaaatacagaaaattagctgggcgtggtggctggtgcctgtagttccagctactcaggaggctgaagtgggaggactgcttgagcccaggaggtggaggttgcagtgagctgagatagtaccactgcattccagcctgggcaacagactgtgcctcagaaaaataaagcagttgt

SEQ ID NO: 38470 - DNA, 1050 bp, Homo sapiens
attatgtctgtaaggttcatctttgttgttgcttatggtagtaattctcatcccattgtgtgaatacagaacagtttatggatttattcacttgtgggtagacattggcttatcttccgtctttgttaggtgtaatgctgctgtgaatgttgctttatatgtctcttggaagaaattcagcttcgtatttcaagagtatatagatgagagggaatcggtgagtcataggttatcaatgctaagcttttgcggtagtggctataccagtttactctcccagcatcagcggattagtatttcagtgttccacacctttgccagaatttggatattttcagtcttctagcctctggtggagttatattggtgtggcattttaattttaatttgcattgtctgatgtctactgatgttgaactgttttccatttttttattgaccgcatagatgtctgcatttttgaagtgcctgttcaagtcttttgtccaatttaaattgggaatcaacagtcagcaagtagtcagaaaagaatagcaaaaacacacaaaataaataaattgggagtcagtcttcttattgatttatagttctttttatagtttacgcacatacccacacacacaccccatgtatgtgtattgcagctatcttctcccaatctgtggttgacttttttattcccttagtgttatcttttgatgaacagaagttctcaattttaatgcagtgttatctatcattgttttatgtggtcaggactctttgtgttttaagatatcttttcctattacagagttaaaaaagacattcgagttcattcttctagttttattgttttatatttcgcatttgggtctactgtacacatttacatgtgatgtaaagtaatggtgaaagttcatttttttttcacactgatatcaagttgacccagctccgtttattgaaaagaccattttccctagtgcttgctgtggtagtgttaagccacatgcaggtctgtttctggacttttaattctgttccattggtctgtttgtctgtttctac

SEQ ID NO: 38471 - DNA, 1060 bp, Homo sapiens
agcagtcaacatagattttatagaaataatgcatcctttttgcacttactggtttgggttgtaactgattatattatctacagtaacagaacaggcataattataaggcagatttggaaacagaaaccactgattcttgttagacattcagttcaacaggtgggagtggagatgagcttgtatattgaaaaatagctttgctgcctgagatggcatctggcaagctgtggttatgtcatcctattttatggggggcctcactagcataggttactacagtcagttgagtagagtgttgccaagaaaacttaatgctgctttctttgaagatgagtatgatgcagattcaccatcttagggtgcctaatgtaggttggttgctatggatctgtcttctgccagtcttttatctgtgtgtgtgtgtgtgtgtgtgtgtgtgtgtgtgtgtgtgtgatggtgtaggtagcatatgtttgtgagaggtggcaagttttgtggctaagaagatagactgacctaggactatcaagatcctctgagaacaattacctgtggctcatcaccagtccccagcactgaggagggggaccatgcactctgagttgaattctgtcagtcggatcctgatcccagtgctttttaatacttccgccagagtcttagatggtagcacacagagtatgctcattaagattgtgaaatggcatcaaattgaataggtggctcaatagaaaacttgattaaatttcagaatacctgatggttcaggaaagttggcgaatatacatatggcatttagctggatcagggcaagataattttcttaaggaaagtaaatagttgttgaaatttggtatgggagtagagtttttgtactacacatgatagtacaaagtatcccaaagtgctgagaaaaaccagttaaataagggtcattgataatgcttttgtagttggtccaagtgttgtgggttattgttaagctgataatgcctttgcattcaaaatcattgataagaagtcatataattggaatggtgcttatggaaattacagggct

SEQ ID NO: 38472 - DNA, 1037 bp, Homo sapiens
tgcagtctgttaaatgtataatagcattatgtctaaaaaatgtacatactttaattaagatatatttttgcttaaaaatctgctaacaatcatccaaaccttcagtgaagcacaactttttgctggtggaggattttcccttgatcaaggtggtggttgctgaaggctgggtgggggctctggcagtttcctaaaataagacaacaatgaagtttgctgcatcaattgcctcttttttatgaaatatttctctatagaatgtaatgctgtttgatagcattttacccacagtagaacttctttcagaattggaatcaatcctctcgaaccctgctgctgctttatcagctgagtttatgtaatattctaaatcctttgttatttcaacagtgtttacaacatcttcaggagtagatttaactcaagaaaccattttcattcattactcattcatttcaattttattatgacattgcagtgattcatatcttcaggctctacctctgattctagttctcttgctgtttccaccacatctacagttatttccttcactgaaatctggaacccctcaaagccatccatgagagttggaatcaacttccaaactcctgtgaatgttgcttttttgacctcttcccatgaagaggtatcacagatgttcttaagggcaactagaatggtcagtccttcccagaaaatagtctattatttactttgcccagctgtctatggcagctatattctttttttttttttttttttgagacagagttttgctcttgttgcccaggctggagtgcaatggtgtgatcttgactcactgcaacctccgcctcccgggtttaagcgattctcctgcctcagcctcccgaatagctgggactataggcacaggccaccatgcctggctaattttttttattttattttttcatttttagtagagatggggtttcgccatgttggccaggctggtcttgaactcctgacctcaggtgttctgctcacctcagcctcccgaagtgctgggatta

SEQ ID NO: 38473 - DNA, 1056 bp, Homo sapiens
tgaatgaaatgggaaaaacatctttaaagtcttaccgagagaatacgttgtaggttaggaactaggggtgtgtgtgtttacttggagaactgttttgctgctggtgaaatattctgctaagtggtgagcacacacctgacccaatagccatcattacttaagctgtttctcctttataaaatattcttgggatgtttgaatttagaggaaaggaataagaaaggagaaatgagtatatgcagagtgacagttgctaaaagccattgaaatgttagttgctggtaaactatataccaaattataatgcttctgtgtattgttagaatgagaaatgtttgtatcagacctttgcatgtatgtggaagagggcccaacctggctgggctggatttgctaaagactcgaagctcaaccaaaattcctctctttgaaatgagagaggtttttttgtttgtttgtttgtttgttttttaaactttttgacaactatcttatcattaaccctggtttggcctctgttacctttaaaggctaaaatcatttaagactgtttaaaggatctctctctctcatttttttttttttttttttttgagacggagtttcgcccttgttgcccaggctggagtgcagtggcgcgatctctgcttaccgcaacctccgcctcccgggttcaagtgattgtcccgcctcagcctcccaagtagctgggattacaggcgtgcgccaccacgcctggctaatttttgtgtttttagtagagacagagtttctccatgttggtcacagtggccttgaactcctgagctcaggtgatccgcccaccttggcctcccaaagtgctgggattacaggtgtaagccactgcgcccggcccttttttttttttgagacggaatctggctctgtagccctggctggagtgcagtggtgccatctcagctcactgcagcctctgcctcccgggttcaagcgattccaaaggacttttcttcacaaagacatttaagtatacttctttctcagtcttaagagaaaggccttgacctagaaacc

SEQ ID NO: 38474 - DNA, 1048 bp, Homo sapiens
tgtaattgcacaaattacaaatgtttaaaaagtgaagtgaatttatacaatctagaagtggtttgtttctttctggaatgagcaaaataaaattagctatcgcctgcagcattgggaatctaagtgttgacatctaaggtgagtgatataacaatgctgggcgcagggtgaaatggtagataagccaaaatgctaacatttttcttgaaagtgacttgagtttcatgatagttccagaagaggataacaaattcccatttcataccaagtaaattaaaatatttccttatgaacttgcaacttagtggttgcagttacatactaatctctttcctgctttcatttcctgttagaataccagagtaaaagtggtctgattctagtcacttttgaaaagcaaagagttgtaggttacagctgaattttgaggctttacagtaagagaaacagagtgagtctgacaaattttaagctcatatattttccttttagaaatgtaggaactctgcacaaataatgtagaaacaaattaccaatttcaatacaaaaaattttgcaggatagtggaatttgtaagcttgtcataccttgattttttgaattcaccttttcccaaaagaaagcaactgttggccaggcacagtggctcatgcctgtaatcctaacactttggaaggctgaggtgggcggatcatgaggtcaggagatcgagaccaacctggccaacatggtgaaaccccgtctctactaaaaatacaaaaattagctgggcctggtggcacatgcctgtaattccagctacttgggaggctgaggcagaagaatcgcttgaaccagggagtcggaggttgcagtgagccgagatcacgctgctgtactccagcctagcgacagagcgagactccgtctcaaaaaaaaaaaaaaaaaaaaggcaaaaaaagtaactgctgctcttaagacgaagtgtttgaatagagtatttctgtttttgtaatctttttgacttgattgcttttgtatactctttgatttcttctaagccagacgc

SEQ ID NO: 38475 - DNA, 1031 bp, Homo sapiens
atcctgtgttttctctctctctttttttcagcacttgcttgactatgttaaaagaatgtttctgtaggaaactctgttctttatggtgtagcctcccttactctgaaatgcaagcaagactcgggcaacagttccttaacggattagcagtgctggactgtggcagccttttctaatctcttagtctatagcagtttgatgtcttactaataagcattcttaaattgtgtggttaattattatgctagtcaagatacatgaagcagtgtgttaaagatgatgatgatgatgatgttatggaaattatgtcaaaaataattgttgcatttctaacgggaaacagtgctcagtgctgtgaaatagctgagaggtggcttctttcaggcctcaagtgggaaaattgtgaccatgtgttagagtatgatagggaaaatggaagaaatttagtagttactaggtcttttaagatagtttagtctgtcacttggctttatttcttccctcttgttggtctaaagctgtagtctctttgtggtagacaggattatccattgtggcatagagagaaaatgttagaattcctacttgtgtttatttttgtcctgtatacataatctcattggtatctgtattagtttcctagggttgccacaacaaattgccatacacttggtggtttaaaacaacagaagtttattctctcacagttctggaggccagaagtctaaaaccaaggtaatggcagggttggtttcctctagaacctttgagggagaattcattccatgctgctgcttgtttctggcttgtcaatagttcttggcattcctttgctcatagacatatcattctagtctctgcttcatccacatggccttctcccctgtgagtctctatctttccctcttctgtctcctctaaggacagttgtcattggctcagtcttatcccggattatctcatctggaaatccttaacttaattacatctgcagaagctttttttcccaaaattatcacattcacagattc

SEQ ID NO: 38476 - DNA, 1023 bp, Homo sapiens
cgtggagaaaggtgcttcatataacttgggtagcaatttgagaacttaagtaatgacaatactaagtatttaatattttttcttttgggctgataccagtgggctgggggaggtccctaaatgccagtgggacatcaactctgatcaatggtcaggctcttgacagtgtcttcagtaggaattcaaggatgagttggaaaatagtgaaatgtactaagatttattgcaaaatgaaaagtacatgctcaagaaaggggagtgcgagcatactccagacagggtttggcttctatctgtatgggtttctttaatcaaggggtggagtattcatgaagatttctggaaaaaggtgaaaatttctcaactttagtgccacccatttttacaccagtatgggtgctcccggaactgtcttggcattggtgggtgtgatttagtatgttaatgagcatataatgaggtcctaggtgaaacctaggtcaaatccagtgccatgttgggtccacttcgtcttagctagcttaacccacactctgcttttcagggtcttcttggctcctagcttatgtatgtatttcaacagtttcctttttgctagtcatgtgaaactgctgcctggaattttcttttccccttcaaccaccctgtattattcctgtctcagggcttgggggaaactatatggtattctggaaaaataccacgtggaggcagataattttggacaatgggaaattttgcattggaagatcattgacatagtctttttttcaagacagagtctcgctctgtctcccagggtggattgcagtggtgcagtcttggctcactgcaacctctgcctctccggttcaaacagttctcctgcttcagcctccctgcaccaccatgcccagctaatttttgtatttttagtagagatgaggttttgccatgttggctagtctagtctcgaactcctgaactccagtgatccacctgccttggcctcccaaagtgttaggattataggtgtgagccatg

SEQ ID NO: 38477 - DNA, 1696 bp, Homo sapiens
ggtttgtaaatgcagcaatcagcactctgtaaaaacgcaccaatcagcgctctgtgtctagctaaaggtttgtaaatgcaccaatcagaactctgtaaaatggaccaatcagcaggatgtgggcggggccaaataagggaataaaagctggccacctgagccagcaagggcaaccctctcgggtccccttccacgctgtggaagctttgttcttttgctcttcacaataaatcttgcagctgctcactctttgggtccgcactgcctttaagagctgtaacacttactgtgaatgtctgcggcttcactcctgaagtcagcgagaccacgaacccactgggaggaacaaacaactccggacgcaccacctttaagatctacatgtaacgctcactgcaaaggtctgcggcttcactcctgaagtcatgcgagaccacaaacccaccagaaggaagaaactccgagtacatctgaacacctgaaggaacaaactctggacacaccatctttatgaactgtaacactcgctgcgagggtccgcagcttcattctttaagtcagcgagaccaagaacccactggaaggaaccaattccggacacatgtagcctatggaacaccaagtagatttaacccaaagaagactacttaaaggcatttaataatgaagctccaaaggtcaagaaatggaaaaattccttgaaacaaatgataatggaaacacaacatacccaaacctgtgggatatagcgaaagcagtactaggagggaagttcatagctattagtgcctacatagaaaagaataaaaacttcagataaataacaatgcatcttaactaaaaaagcaagagcaaaccaaacccaaaattagtagaagaaaaagtaaagatacgagcagaaatacatgaatttgagatgagaaataatacaagaaatcaatgaaacaaacagttggctgtttaaaagttaaacaaaagagacaaacctttagccagactaagaaaaaaaaaaagatccaaataaataaaattcgtttctagttcttcagcttccatcctgcttcaccagcaacagtaataccttctctttatgatagtttccagtctgcttctgaatgtagaagccttctttcctccttttctttctttgactttctgctgtttttcctctcaatctagaatttaaagatgttctattgatctaggtgtcaagccctcttaagatctctctattggatatagtactctctcatacagcaacagagtaagtaaataatgcaaggtacattatagataaatagctgtgcgttttcctgtactattcccaacatctcaattatgagtctgttattttacaaatcctacttttctggaagaattgtcaactgtttttggcttgggctagtgttccatatattataatcctttccatattttgttctgttgtaattctatttctccttctgtttcattcttttttcccccctcaggttttccttgtcctcccttctcctaactcctgcaaaataaaacaaatctttgagtgcaaatctttcctcaagacttctggactattgctgtcttttcaaagatcaggtaataaagtaaaagagatatgaactttgatgtcctgctctgatgcctagctgttacaggtgcatttacctaggttctgtatcacatgactaccctacca

SEQ ID NO: 38478 - DNA, 1024 bp, Homo sapiens
tatgtcctgatttttattattatattcagcaaacttattctgtcaagttattataaaattttctaaattctacccttaatttctctacttactttgtttagaccagtaactacttattgaccagttactggtctatttttttagaccagtaacaatttccagaccggcactgatctgtggactgtgagtagcactgtcctggtgtatacagacacagtctcatggatgtcagaatatatatgcgcacacatgtaattggggaaaataccccaaccatttctataaggttaatagcgagtagccgggagttcatatatccatttcttgacccggacagtatacaagggacatctgagacctctggaattccttccttatatgattgttattccactgcttcccaggtgagggttgtcattcttttttttttttcctttgagttgtgctgttcttcccttcttgtccttcacttcatgaggaaactatactccctgaaggccaggtaaatatatgttgtcttagacaaatcagctgtgctaagtagttgagaataggatactgaatactgctgccttatggactgaagtgaagcaatcactggcagtgtggccagaagaataactttttaaatttgagacaggatctctgtaacacgggctggagtgcaatggcatgatcatggctcacttcagcctcggcctccctgggttcaggtaaccttcccacctcagcctcctgagtagctgggactataggcatgtgctaccatgcctggttaatgtttatattttttgtagagatggggttttgccatgttacccaggctggtcttgaactcctgggctcaaggaatcctcctgccttgacctccctaagtgctgggattgcaggtatgagccacatttcctggcccagaagaataactttaatgatcctttacacaaccgcaaaccagactgcatggtttgtagacaaagggggaatgaatcatagaagaggttggcatttgcattttccttctatg

SEQ ID NO: 38479 - DNA, 1025 bp, Homo sapiens
tgttaccatctaatcctcaggtttaataatatcttttatagcacacgtccccataatgcccctttatttccttctggaacagttccctagtcttttcatgattttcatgaacttggcacttttggagatgacaaaccagttataagttgtattttccttgatttgattttatctgttatttcctcatgtgatgcaagctatgtacctttgcaggaatatcatgtaaattatgttgttctcattgtactctgttgttacagggcatacattttcagtttgactgatgactaatgatgacctctctaactgcttcattagggtgatatctgctgggctttagtactgtaaagttactcttcttgtttttgtaattaataaatgttttgtgggaaagtattttaaaactaggtaagtatccatctttgtgacactgtttactcatttaatttgtatctacttatactcatggtttcctattttattcagtggattatgatcttctgtactgttattggttttgatgctcaaattgtcctagatttggcctgtaagagcctcttcaggcattctatgtctattttgagtagtttcagtagtttcttgctttctggcacaaaaaagatattctaagctcaccttgtactttctgcatcccagccctagataatcagtcatttctccaaggagccttggttctttttaagggaaagaagtatttagaagccaggatctgggtaaccagtgtgctcattaccattggggtgttgctacttccagatcctctcagtggatacttttacatttacctatattttctatgtttatttctatgtttaaatatattgaaaattgtgaattaatactgataactccagttccaactcaatacctcaggattcattctagttttctcactttcttttatagtgttctcttacagcaagaaacttggtttccattatccttgatacacatgctaaatgattggtcttctcttgtatgttgccaacctcccatctttgaca

SEQ ID NO: 38480 - DNA, 1047 bp, Homo sapiens
tcagtgtcaaaatttacatttcctgaatatagggcaatgatttatctctgagaattaatagccttgaaaatatttaagaatatttaggctggagtgggactttactttgaatcagattgtgttacctgctgtaaagtgtgaaatttaatcccagttctagaaaacattataaactcagaacaaaggagtggagttagaagtgagtggccagtggaactctcagcatgagagaaattcatttttgtgatctgatgagtcagaggttgcgggtggtgatgttcagaggaatacatttctagattttggaaaaaatgattcagttttgaatttgctcaagaagtcctcctagtaacaatatctagcatttctttcaattggtgagtattaaccaaaaatgtttacaatcaaataagaagttagtagtaggcatagaattcattttatagaaactttagaccctggagtgaattattctgataaagatgatgatacctataattgtgtgtgttagtgggactataaatctgaatctataaatctaaaaatgtagtaggcatctcagtgaagtgattgtaccctttcaaatggttgttccaactcacctgcagaacctttgtaaactttaaataccctggccctgccccagacttagtgactctaaatcttaacccctgtgtaagcactgctgttctgccacagaatttctgagatcatttgctagcactttgttgaatcaggatggagagaggggagaggagcaggagccagatactcaggttggggtgacatgccaattctcctcactggaaagtggcacagatgtagtgaccctcggtcatggtttgtttggtctcagctgccctttctttagaaagttgcattattactgttggacatgccttcaaaatgaaatatcctctttaaaataagctcttttgaatagatttagtattttccgggaataaattctgagtttctcaggcaagtccagaactaaactaattacttgcatattcttactcttacagaagcatgctttaaaaactg

SEQ ID NO: 38481 - DNA, 1028 bp, Homo sapiens
agtttgtatcccagaacatggatatattcaggttgagatcttgtgattgtcaaaaactcttgtgtattttgaaggtgatttctgatagtacatatttggtagaatcttaccaaggaggcatttgatttccaacacgtttgctcatagcattatattgcttgccttggtgataccgtcagtgttcctcctctgcaggatttttatttcttttaaatttttcttttcttttttctttctttccttttccctctcccttcccctctcccccttcccctctccccctctccatccctctttaggacagcagtgtcctgatagagttaacacacttggaagtgctaaagctgtctacacacacacacacacacacacacacacgaatgaataagtaggtcttcagattgaacggtattaaatgtaacaatattttcatttatactttgatcctatattttctaaattttcaataatagaatatgcagaatataagtttataatcttcagacttgaatttttagcccaatacatgatgttattgtagagtaggaatggtatggaaaaatgaaatcgagagataattctcaacctttattcttaatcatttaaagtcagaatttttgtctcttccattaaatgtctggctataacacagatcatcatcatgtggcaaaggtatgtcagactgagaaagagagtggcagttcttttggggggctcagtaattagagcttacctaaaacccaaaatgttgaactagaaaatcactgtggtctcttctgattctaaaagttggtgattttcttgacatcacaaattcatgcagttgcgtgtgtgaatagtgagatgttaaacctgtaacaagaagagatagatcttcttcagtgagataatcagcttctgggtggctgagaagtttttatatgagtaagatcaaaaatgagagtctgctcagcagatttgcagagagtctctgataaatttctttagtgccatttcaaaccccaggagctccacatatgatggtttta

SEQ ID NO: 38482 - DNA, 1055 bp, Homo sapiens
tttaattgattgaaaagcatcagctaacaggtaaaaggtatacatgctttaatgtaggtaaagcaaacaacttattcatgcccagagtaggagacataagcagcacttccattgggatggggccacacaaagggtgcacatccacgactaactccttgattgggctgaagacttcttgggccctttaaaaaggctcacctttatcattctaatgaaaggcgggcgtgtaggttatgcgctgttctggagaccagccaagtggatgcctgttcaccaagtagaaataactgataacaatcccatcatattcctgaatgtttactgcaaagttgtatgaatcaaagattaattttccatgctgcacatttttaatcctttcttgcagtgagtgacttttccttcacatgatcttggtatgtattatatatgagggggttatgtggaagaagaacgtgagctaattagccaaagaacagagagattggagggtaaaagcattaaggagccacactcagctccttcatggcagtctgcgtgtagggcctccagggctgctgtgcggcccagcaagtcagtcttcaaggattaatcagctggcccgaggcctctagtctttcacatcttctcctgtccttctcttagccattgagatattgaataccctaaaagtagaagtagctctgttagagagctttgttaccctctagcatgttgacgatacattttgcttcctcctctgtggtaaaggcagagatgatggatgcagtgcagccttttgattgcaattaaaaaggagattctgcttagcatggtggtcaattagctctttatgaaaaggattctgaccttttatttcatacagatatttaaaaatatgtgagccttaaatgaatcttagcaactaaaactgaaacaaatgtaccattttaattgggtttggaaatactgtacaagataaattgtttataaaatgagatatttttaaatggcagggttcaccttaggcccccaggaggatattctgaggcagggtctctaaagacattcatatagga

SEQ ID NO: 38483 - DNA, 1034 bp, Homo sapiens
tgtatactaagaacaaggacattctcttaatttaaccacagtacaattatcaaaattaggaaatctaatattgataaacttctgttatctgatccacagtctatattcaaatttcatcacttgtctcagtaatatcctttttaaagataactattccctgctgccgcctgtgcccctccccctgccatcaagttctaattcatttctggcatttagttatgtctccttagtcacctttagtgtgtgacagtcccttagcctgtttttgtttttcttgacctttgatattagtaaggggtatgggccagttattttgtagaatgtccctcagtttgtgtttgatgtttcctcatgattagattgaaattacgcattttagggagcaatatcacaaaagtaatgtgtgtctgtagtgcatagtatcaggaagcatgtgattaaggtagtgtgctcatgtctctccactataaaattcctgcattcccttactaattagtaagaaattgtggaagatactttgagactatataaatgtccttttcttcatggaaatttcacttactagttttttttagcatctattgatgacttttgttaactgcataatttcttctgtgtttattagtttgctttccactgtaagagctttttcttctccctcattcttaaattatatcattataaacccatggatttctattttatttagtaagctatccattactaatttctattgttattactattattgatgctcagattgtcccagatttggctcctgggcatcccttcaaactgatttctgttttgtgatgtcaccactgtttttttatctactttttcttcttcttcttcttcttcttcttcttcttcttcttcttcttcttcttcttctccttctccttctcctcctcctcctcctcctcctcctcctcctcctcctcctcctcctcctcctcctcctcctcctcctcctcctcctcctcctcctcttctttcttcttcttctcctcttctttcttcttcttctcctc

SEQ ID NO: 38484 - DNA, 1052 bp, Homo sapiens
tttaatttaacggtgtttttttccccagtgcatttattcattcatcccaaagctggttctgcaaagcatgctgcttttattagggctgtgttctgaaaagattgatactttgcagtacagtataataatgtacagttatatgctatattgaagtgaagagccataatttatcaaaaatcaatgtgtgagatcattaagttaatctctgtcaaaatacaggagttgagcagttcagcagtgttttcttatagaaattctttctgttccataatgtcagttggataggaacttgtttaagtactggtagtatcatctgaccttccatttgtagtcaaaataagaaccagattaaagcaaaaccatgatttttaagttattcattttctggcttgcttttctttttcaaaacttttaatcctatttttaagtatgcaagtaaaacatgactacattctcaatttttgaattacaaagacacaggtttagatagaatagaacatgaaaatattctaacgtcaccaccatcaatcaccaccacccaattcctactttttacagaaataaccgctgtttattcattatgggttgtattttttctatgcagctgtgtacatgtttacatacaagattttatcttggctgggtgctgtggcttgcgcctgtaatcccagcactttgggaggctgaggtgggcagatcaccaggtcaggagttcaagactaacctggtcaacatggtgaaacccccacctctactaaaaatacaaaaattagcctggcatggtgtcaggcccctgtaattccagctactcggggggctgaggcaggagaatcgcttgaacccgagaggcgaaggttgcagtgagccgagatcactctagcctgggcaacaagaatgaaacttagtctaaaaaaaaaaaaaaaagattttatttttatataaatgacagcatactgtatatattgttttataactgctttttaacttaatatattttagagctctttccaagtctacacatggagatctgccttactcctgcataatattct

SEQ ID NO: 38485 - DNA, 1027 bp, Homo sapiens
aggtagcagtcaaggagttgaaccttgaacacactgggtcatcctgagaggtttgggaaggagactcatgtactcagatgctgaaacaagcaggaaactctggtgaatatcatttacttgtgtccatcttctaggtagatctgtttcctcctctctgatcctatactattttgtgtatctaaaactaataatgatatttattgtatgcttactacattgccaggtattattctgtatattttatatacatggtaatttaattttcagaacagttcttcaagatagttattatttttcctcttttacagatgaaaaaaatgtaggcactcataaacttaagtatattttctgagataatattgctagtaagtgatggagccaagacttggacacggatctttaagacactaaagcctgcgctgttttcccctatatcatgctactgcttttcacattttattgtaattgtttcttctcctaaccagactgtggaaaagcagactgttgaatgaaatatggaaaaaatgaaacatatatttggaaatatagcatacactaaagtagtttgaaaatgtgagttctaaaatcacatctggtttcagatctaagcttagccacttaccagttgtgattttaagtaaataagttaacatctcaaaattttgttcttcatctgtaaaatgggatgataaatctctcaggtttggtgtaagaaaaaaataatatgctcacctaatagaccttcaattactggtagtttccatcatcttaatgaggattatatctttatagtgagcacccattagatggtgttgataaatacatcaatgagtattttaggcagaaagaagagtaaagtagaagtactggcattctttgctgtactcagttttattaactgattttatattgatcacgttctttgttacatgtcagtattatagtggcagttgaaggtggtaatatttttagatctccgttagtgaaatgacaggcattgagctctcagtcatacctttgtaggcct

SEQ ID NO: 38486 - DNA, 1091 bp, Homo sapiens
tactccagaagctgaggggaggatcgcttgagcccaggagtttgaggctgccgtgacctgtgatcatgccactgcactccagctcgggtaacagagcaagacccagtctattaaaaaaaatttttttaatgagtttggacacatgggttgtgtacacactgtatggttccatgtatatgttcacatatgtgacattcttgaaatgacaaaattctggaaatgaagaagaaattagtttgtcccaggttgccagggatcagtggggaacagagggaagtggacatggctataaaagggcaataagaagaatccttgtggcgatgggaatgttgtatgtcttgatggtatccatatcagtatcttggttgtgatgttgtactagagttctgtgagatgttacccttggggaaaactggatgaagggggcatgggatctctctgtattatttcttgtaactacatgggaacctacagttacctcaaaataaaacatttaataataaaaagaaaatgggctcggaacattcctaatagagaaaaattggcagtgaaagccatgtgtatatctgaacagacagaccaatattaggtaaataaggcaaataaatatcacagaaggaaaactgagctgaccattgacattttagtgagatgttcatgggcccccaagaaaaaaattgagccccgtgggttcagagggagggagaagacagacaacagcttcatttccctgaaaactcatcaaactggcattctccaagggcctttgcttcccagactgtgaaatgttctatttagtggatggtttttggtaaagagaagaaggtagatgagtagcaacttacatacaaatgacattctttttttttttttggagacagaattttgctctcactgcccagtctggagtgcaatggtgcaatctcgggctcactgcaacttccacctcccaggttcaagcgattctcctgcctcagcctcccaagtagctgggattataggcatgcaccaccacgcccggttaactttgtatttttagtagagatagggtctccatgttggccaggctggtctcaaactcccaatctcag

SEQ ID NO: 38487 - DNA, 1033 bp, Homo sapiens
tcctttgactagatctgatgtgatatctttctcattctattaaacattggcagagaaagcaggggtctggtgagtaccaagagttgtgaacgtggaatgggggagcggcagctctgtgtgggtatatctactacactagattatgttctcaagtaaaagcatactggaaaaaaagaatctgctttgttggccctttatgaaggaccttaattagaagtcactgttaactcctggggtgggaatggtttccagcttggcacgggagttcctcctgctactaatgagcatgctccttgcaaggactcgctgcttctgacagttaaagctgcattgtaagagttatttcttgtcacctctctctccacatttaactgttactgcccaagttcagagtatgtaagtagactgttaggtgttttcaggaaattggcaatgcttcacggtaacagggaatgatatttgtgagtaaaagtaaatcattacaggttaatttattcaaatatgggtagtagatggttgctttaatgtcaaccatgtttggatttttttttcctggtagtctttttctaattgacataaaacttacaaatgaatagttgaattatttaattcattatcatgtcgttagaacccctgccctggacatctgtttctcttatttaagcaactcgccctgtggcacaaaggtttcattaactaattagcagaggaaatgtaaatttcttatgcaagtgaggatgattctatagattactatttatttcattagcttctcattaaaacactaagttgacttgtgagaaaatgccggagaatggtttgcttctcgaagaaattacacatacacagtcaccttcttgggcaatagcttgtggaggatagtgagcagttttggaagcttatttaccctcgctcttggtggcagggagcattagagagcatctaacagatcttcatctagggaagggtaagtgggcatattccagagcttcaaaggtgtggatctcttgctatctggaatagttctttgatt

SEQ ID NO: 38488 - DNA, 1044 bp, Homo sapiens
ctagattcatcatccattgatgattcttgcctaagccagtctctgctaggagggttgcaaaatgatgatttactaactctagcactccctcagcatttactatttggcactcagcattcttctataagtgaagccacctcctctcccccatttatttatctgttactggcatggactcatgggctcttatcttttttaatggtttatgatttgttatggtacagttgtcccctggtatctgcggggaatcggctccagagcctcccatggataccaaattcaaggatgcctaagtccctgatataaaatggtgtagcattgcacataacctacgtacatcctctcatatactttgtcatctctagattacctagaatacctaatacaatgtaaatgctatgtaaattgttacatgctgtgttgtttagggaataatgacaaaaagaaaaaacctgtgtcagtgcagacacaaccatcataggcctaactacatttttgatctgtggtcgttgagtgcggaacccatggatatggacaaccgactgaacttaattattttggtgctcaaattgtcctggatttagccagtggaagttattttctgctggctcctgtgctcttgtggcatacttcccatctttcttcagtggtggggggaggatttgggagcattcccttattctttggcgtaacagcatgtgtccctaaatttccccaatcctggaatcagccacttctccaaggacccccaaagtgattttaatatgcactcaagtaggtatttgctgggcccaagaggaaggcagacatacataaaataactggaacagcctaccataagcatttatcaaggtataggtataaggtataagcctatgttatagtgatatggagagggagagattaattgcaactcaagattctggacaggctttcacaattggggctttaaaggaagattgggactcagatatgggaaatgaggggatgcttgggcaaagctggtatttaggagatgaactctgttcagctggatgaagtctt

SEQ ID NO: 38489 - DNA, 1049 bp, Homo sapiens
caaatgtatggggtacatgagaaattctgttacatgtatataatgcatgtgatcaggtcagggttagggtgtctgtcacccgagtgcagtacatttttgctaagtatagtcatcctactccactatctaacattgaatttattccttctatcttactatgtgtttataccctttaatccacttctcttcatcctcctccctctccacattcaccctcccagtctctctcttttcactctctacctccatgtgtttaaattatttagctcctgaatataagtgagaacatgggatatttgcctttgtgtgcctggtgtatttcacttaagataatgacttccagctccatccatgttgctgcaactgacatgatttcattctttttgactgaagagtattcctttgtgtatatatactacattttatttatccattcatcccttgatggacactgaggttgatttcatatctttgcttttgtgaatagtgccacaataaacatgcgaatgcaggcatccctttgatatattgactttttttcctttgggtagataccctgtggtgggattgctggatcaaatgataattcttagttttttgagaaatttccatagcggtttctatagtggctttcctagttgacattcccaccaacagtgggagtccttttctctgcatcctcgccaggatctgttatttttttgtctttttaacaatagccatactgactggggtaagatatctcattgtggttttgatttgtatttctctgatgattaatgatgttgagtattttttattcacctattgactgtacatcttcttttgataattgtctattcatgtcctttgccagtttttaataggattttttttttcctgttaagtaccttatgtactctggatatagtcccctgtcagatgagtgatttgcagatattttttcccatttggcaggttttctctttacctgtttgattatttcctttgctgtgcagaagcttttaatttagttaagtctcatttgtctatttttgtttttgttgcct

SEQ ID NO: 38490 - DNA, 1051 bp, Homo sapiens
aggctttgctacaaaaagatgaatttacttgttagatggaggatgcatattgaggccatccatgcctctgctgcaaaatcctttaggagaaagacaactggtatccaatatcttcgagtaatgaacttatcagtaaatgtaacacatgagctcattaatcttaactttgcttttggaccaagtgggagctcggcttctcgggagacagaaattgcatctctgttcttttccttaaacccaatcccaatttagagtcaaacatactgccctgctctccctgggaagcagttaataatgtttcctcacacaatggatggcccaagctcagctgggtcactccagccccctaggctgtgtacatgtcccttgcacacagcctgggctcaagacttcctagtagggtgtgagtgccagctacatccttgagactggttagtccccagccattgagtacatcacacacttttcttccctcaggctgaggaatataggtgaagttaatcttagaagttaaggctattgaatcttaaccttaaatcttaaggctgttgaaactcttcatcctgtggccacttcgtccttgcttgggctcttgctgttcttctaaaagcacagcctctacatctctgaaaagaagttgaggatgtgaggagggatgagtcagtttgcaaggggtggctgcctgttctttatggcctggatgagggcttaaaagaaagaagtctgaaaagagatgctgttggttggaaaacaagtaaggagagtgtttgcttgggcaggctgctgtgggatgcctgctccagacagggagaacaggtttaggaatggatctagatttacctggaagcttgctcctgtggacctgatccaggcccacggggcctggaggtgtggtgagataatgctgatgggatgagaaggtgatgaggagccagccagcactggcaggtgtcttcctagccctgatcttgttctccccagcgttttgaaagaggcggccagcagactctggggacctcagacgtctgtgctccacatgcgtatcggccgc

SEQ ID NO: 38491 - DNA, 1029 bp, Homo sapiens
catgcctgtaatcccagcactttgggagaccaaggcgggaggactgctggagcccaggagttcaagagatcagcctggggcatatagtgagaccctgtctctacaaaaagtaaaaaattaggtaggtgtggtggcacatgcttgtagtctcagctacttggaaggctgaggtgggaggatcacctgagcctgggggatcagggctgcagtgagccgtgactgcactgctgcattccagcctgggcgacagagcgagccctgtctcaaaaataaacaaacaaacaaacattaaacatcaaataaaattacactgagaccttgaaggaaaaaaaaaagtaaatggggagaatatatatacttgtttatgcataaactatctctgaaggaaaaggtaggagggaaacatttcagtctacagttttagatttttaaataacattaaatatattttttggaatatatagtttttttcaaaattactttttaaaagaggaaaaagaaaagcagttgctttccgagaatgggacttggggtagggaaggatgaagcagaggactgctgctttttgttaaaagtcttgtggttttacttcactctcaaaactgtccatgtataactttgataattttttttaattacaattaaaaaaagcagagcctaagaaagggagcagagcctatggtgacaaggagtggaaaaggtacatgggaagcatatgtatttacagcctttgggagcagggctggaaggcaggcatgaacctttggaacagattctcgaaaagggaagaaataataaaagctgtcccctgtcaactgagcttacggcagtgacggcggtgccctctccaagttgcgtggcactgagacgtgacgggtattaaaggccttgagtgagcatggagacttgcctgaagatccctctgacagttctttatgagtgagcctcttgagctgaccccacagctgcccactgtccctccaagcatgctgctcttattgtctggcgcattgtagtgatgggccaagg

SEQ ID NO: 38492 - DNA, 1003 bp, Homo sapiens
ttccctggccctaaacttactaatgtcctcctgtggaaccattcctttagtaactattaataaaaaactgttaatatgtgccaggcattttataggtgctaagaatgtagatatgaacaaagcagacatggtctccacttttaaggaacttaatgcctaatggaaaaacttaagttataaataacttaaaattataaattgtgacaggtgctatgaaggaataacaggggaggccaactctagcttggctggaaagggtcacttaaccagccaggcaagggcaggggtacgagggactacctatgagaggaaaaagaagcatcaggggcaacccaggacttcaaggtgcttacaatctagtcagaacgacctaatgacatctgatgtttgtatagagttttaccacttacagattactttcattgcatcaatttatttaaggcagatatgacacacacatagagaagactaacaatactggtacttgatgactgagcacgtttcattggcaaggcttaactatgaggccaaaggccaaaggtggattagcttctctactttccagggttcccaaatcctaaggcacactagtcttttttgctccaaagtacttagctcttcctgtgccttgcttattttcttataataacacttgctctcacctgccctctctgtttctttgctccatccataggaatgttagttaggcttgttcaggttactaggataggtcaccttaggtttcaaaggggggtgggagtgtgaaaccacctcttttgtggagaactgataagatactgatccccgcgcctgcacagttcaaagcatggcaacatatgtataagcaactgtctgtggccacccttctcaagacagaacagggaaccaggcaggactcagcagctcttacagtaactgaacagagcactacagtgatgacagagtgggggcaggggttccttgctgctgctccaactctgcaaaaggagtcaggaaatggggc

SEQ ID NO: 38493 - DNA, 1056 bp, Homo sapiens
tgtgcttgcaatcaataattctatttactatttaatgagttaaagactttaaacaaaaaagagctcagaagtgtttggaaaattatcctatgaaaattgacaaaatttggagtgttacaattggcactgacaccattactttttctcctaaacacaacacattcagttggaaactaaatggaaactaaaactctgagaaagtcccatttatgttgaataaatggctgaaggcaactctgattctgatttccatagcagtacagagcaagcacttcatttccagtggtttctcacttgatgtttgggctgatagaggctgtgggtcacaccgggagcactcagtgagatttaggacaagtatgtatgtctcccttttcctcccatgaactcaatttctaaggccaagatgtaccctgttattgtggcttaaaatgtttttgaggaaactttttggaaaaagtactgcatatacaaggagaactccaaaaccaaccatactctggcaaaaagaaagttatttacttgtgaacacaataaagtccattcaactcagagaggttgcaccctttgagcaggtgtgaggtctcacagttatggccaaaagagtaattataatgctgcatggaatttgtggaaccaatgtaggctaattaaggtaaagcaagttaccaaatggtttcccattccatctctgtcttatatattgaaaccgagagaggggatagggatataattgattaccaacactcacatggatttctattataggttttaaattactatattgctaagtatttatttgtatgctttgctgttctgctggctaacatgatagtcctgcctacttctcagtcattcatttatcctcattgtctaacgtaactcacagcacccagtaaacattcaatcacaatttgttgaatgaatgaatgaatgaagctaattaaactaaattgtgttacacttccagtctcattagtgccataataaagtactacataaagagaaattgattaacaaaagtccttgaattttgttattcattaaacatcttcc

SEQ ID NO: 38494 - DNA, 1025 bp, Homo sapiens
gagcgtagctatgaaagagacaggggcatgggttggcgaagatgccgagaggactctgtggttgagtggttggaagaaggctgttggtgcccctcttggtgcctaccctaatgagatggccaggctgatgctgacttggaagggccctgtcttgggagaagggagggtggggaactgagggaagtcatacaaagacacaggcccagagagggcttcccccttatattctgcttcctttcctccagaacttggagacattactaagattccttgaatccctagggcagggttgggggtggggtggtagtgggggcagttctaacaaatgagtctggacagaggcatgtggagtgtggcccagagaaaaggggaggaggggaaacatatattgcaagcttggagagaaggaagttctattttgggtgactttaaatcccagcccctctgccggccagattcacagcagacctcccccctgtgcagaagattccctcattctcagttctgtgcactggctttggctccattttggctcacatcgctgcatcctttaagacttagttcattcatactttggtgttctatctcttggtatgcttgcctgcatctaaaacctccccccagccttccagccttcttaaagaaggcatccctaaataacagcagcaaaaatgacatctacagtttatccacatttctgctatggccctgcaccaccctgggtgccttatgtgtccttcaactcacaagaaaaacgcgaggtcattattactgtgatctctagttgacaaatgaagacactgagcccatgacaggtcaagtaaaccaggcaaggtcatattgttagttggtggcaaagctgtacctagaacccaggtatgcctaactccaaagctccattgtcatctcttctcacagctacagagccttctctctaaatcagaaactctggggtggggcccagcaatctgcattttaacaagccctccaggaaattctgatgcaggataaagcttgagaacggc

SEQ ID NO: 38495 - DNA, 1027 bp, Homo sapiens
aggctgtgagtgccctgttcttatccacccagggccctaggctgctgtcaattcagctgaactcaggaatgcagaataactcgagaagcacatcattcagagagctgtttgcagggtggctaggaaagggggaaatgagagaggttggccctggtctcagcacgggatcacgtggggctggtttggagcctggtatttgggaataaaacaaatgcatccaaggcgttttagaaaaaggtgctgagaatcattcacaggatggggcattagggattgaagacaaaggacaaaagggactctgagcttgggagactatagctctgtaagggcaggagctgtgtctgatgagtttacctgcacgtacccagccccaagagcagtgccgggcatacagtaggtgctaaaaatcaatggtggttggatgaataaatgagcaaatgagtgaatgatgaactaaagggagttcatgggataggattcaattcaaacagcatcatttaacgcctcatatactgtctgacacagattctagtgatggggtagaagaaactactagacaatatgtagtttgactggctcatttacagacagggcccaaagtacttatgttctcttgcccaaggtgttttcaatctcctatggcatcaataaccctatgttggacttctgttcttgatctttggtagcatctctgagtattcccagctctcattctactctacgacgcctcctctaaaccatgtttatgagcagaaggtttagggtggactagaacccccgctgggctacagttctgcagacattccgcagattcaaacctttgtacttcccttatcataaccacatccacgctttttttttttttttgagacggggtctcgctctgttgccccacatccacactttattatatttatttgtctctcttcccaaccaaactgaactcatgcttattttacatttttacagctcttagcatggtacttaggggcccaacaaatatttgtttgaaagaacgaatgaagtg

SEQ ID NO: 38496 - DNA, 1066 bp, Homo sapiens
aacagtaaatatgaagtgtcttagcacagtgcctggcacagagtaagtccatagagacatgaactgatgttacaaaccccatggtttattgccaaaaactgggtcctgactctgcagaagacggaaaagggataaaagcagtgtccataccataaatgagctaggcagggaatacatatgagctgtaaacagctggagcacgatgataaagcagcactgaagcactgctcaaccatgtagaccaagccccaaaggctgagtggagaggaagtgaggcagcactgccactgaggtgagaggcaagggaattttccaggcagaggtgaggtttggggcagcccagagtaaattggacagacctgattgggtggagagagcagatggggcattctaggtagtggaggcgacaggagtaaagatgcaaaggccacacctgttgggaactcagccctctcctcctgctctgtcctgcatttccacctagaccctgctgaacgagctagaccgaagtctgggccggtaccgggatgaagtgaatctgaaaacagccatcatgtccttcatcaatgctgtcctcaatgctggagctggagaggtggggtgccttctccttgcccttgctgttccctgactttctggacctggggtagagtgtgtgagtgtgttgcttccccaataattgtttttgctattaaacctgggagggctcctggggagttgcctacataggtagcatcatgcacggtggacagacccagagctgagctggctgatgatggctcagggtggcagagaatcattggtgggaggagggcgagtttgggcccttgtttatggagagctgtttctggactgttttctcgttggctggtcatgttcttctagtgccttctgttaggtgtgccttctggtttcccttcctttggggtcagaatgggattcttgaagtataaaaatagcaacaggctgggcgtggtggctcatgcctgtaatcccagcactttgagaggcctaggtgggtggattacctgaggtcaggagtttgagaccagtctggtcaacaggg

SEQ ID NO: 38497 - DNA, 1050 bp, Homo sapiens
ctcaaatcatttatcatgtgcacgaatagcacatcaattggggaggaaattaagatgatgaatagatagaaaattattaatagctgtatcttaaaacttgtgtttcctacttacatagattttatttaaaagaagtggaaacactttatggaaataatagaaacctttcctctagggatctgattattttgggagaattttaaatagttattttggttattcttgctatatgtattctgagaaatctttcttgatacagaatatgcaagcatttggtgtagcaaaggggatttgatttggaatggggaaataagggaaagagatagcatgagagagtcaggctgtaaagtccttaaaaaagtaaagtaaaggttctcaatggacagtttaacaaaacttaggatttcaatgttcctggtgattctaatacattagtggtggtggcagtggcggcggtggtggtggtgattgtaggaggaccttactatctaacctactcatctaggacagaatgatctgttaactaattgctgttacttgcacatactttcattaagtgtgaatatttcagtcatgaatattctgttctaagtaatttctgtcaaagatagagtctgaaaatgaaaattttggactattccatggatcattacagtttacttctaaagcacttttaaagtgcttccagaaagcattctattaggtatttttgtattgggacttaagatgtgacagagcacttgtagtgacctggctcctacagtagtctgtttactcataggagcttgaaatttgtacacttgactgctctgtgtaatttcaatatttgttgttgcttctgataaagctaaaataaccatgtggatattatagaggccagtgaggaattccaccatggagactgcaaactgaccagaaagtgcttttaagaaatctttagtagtgagtttaaacaacaaacatatctagaattcacagagtaaaatgagcaggataaaggtatacatttgacatttcattttagcttgagagactgtagggaaaaaaggg

SEQ ID NO: 38498 - DNA, 1094 bp, Homo sapiens
acatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagacagcatttatccctctggtgggggaatctcacactgactaactgaatggacgctttgtattcagagatggcttccaggcaaggaagttctatcttgtgatacggaaacaataaattcctgagatacattcttccaatctgtggtaataataagaattcctctctgcccagatggtaggttgatatttctggactctagccaagaaaaagctaattctggggatagaatgataaaagactcaagcactaaaaatatacattgccgaatctctttttctagctttgaaaagttgtggcctgcttgtccctctgttgactggtcatctggaccatcgtacttgctgtggctacttctaagacaatgtagagggttattaaaccttgaaactgcctttcctaagtagagaacaagactattcaacaacttctttgctgaagcactgaggagatttgtaatactcctaaaggaagggccaaactagagattttcaatcatagactttgtgacagcatttggggaactaaaagattcatgtgtttcagcctagtgggagagagtgggggagaggaagagagagagagagcatgtatacccgtatgttatcatagagcacgattctccagtggatggatacctggaatggatcattaagatgaagagagtaattcacatttactctagaacctttaacaagcactgaaaggaagaagcctgagatttgatccttgacaatttctggaaagcactggtcagtcacactgtcctggacagagtccaagttacccactaaagcttgaggtggatgttggcttcactcctgcagcacaatgctggccctagaaagcgagcattttcattcttcccatggcagctgattctttggtgccagttttcatgttttctccataggccttgtgcagaaag

SEQ ID NO: 38499 - DNA, 1020 bp, Homo sapiens
acacaataattgtagcttatatattctatcaaggaaataaacatagtatagtggtaaaaaaaaaacacaaaaaataattttagggtaggggagtatatgagacagggtggtcataggctcctctgaggaggtattatttaagctgacacttgaaggatgaggggaacagcttgtgaagaactaggggtaaagcatttcagacagaataccaagtgcaaaggtcctgagacaggagaaagctcggcatgctctaggagctaaaagaaggccagtgcaggccaaaacgtagctcgcagggtgaagagtggtttgaggcaaggttgggggatggtagctatgagaccaccacgctctgtagtccatagtgaagagttggaattatatatttctgtataaaggaaaactgtggaaaggtctagcaggggagtaatatgatctgattaacactttaaagctgattttggctaccttgtggagattgaatgctggtggaaagtgaatttaagaatagaagctggaagaggcaattgtcctggaaagatgttggagatttggtctagagcagtggttctcaacctcagctgtggttgcctgaggagctttttaattgttttttcttttttctttttttttttttgtaagagactggggtctcagtatgttgccaagtttgtcttgaactctagagcttaaaagattcttctgcctcaacctctcaaatagctaggactgcaggtaccataccaccttgtctaacaaaaaatcttaatgcctaagcttcaccccaggccatttaaatcggactttcttaaggttggcccaggaataagaccttttaaagtttcataggcaattccaatgtgcggtcaagactgaagattgttggtgtagaggtatggcaggggagctgtgtggggtagattaacctgaaatatattttgcaggttcaacagacaggagttgctaatacgttgaatttcagtgggaagtggtgagaaaaaggactcagttttttggctt

SEQ ID NO: 38500 - DNA, 1064 bp, Homo sapiens
aagggctgttccctttttctcaggtctgaacaaagagtccctgtgggggtatctgtgttcagaaaggccatcaatatcatatatcaaggggttctctcattcgtttgtttaaagatggagttttgttatgttgcccaggctgtaactcctgggctcagtgggcgcataccaccacacccagtttgagggtctctctctcaaagcctatggctaagaaacagagagaaaattatcatttaaaccatgaaagagccatggatagtgaaaaaatatcctgtattttcagacttgtcttcatttcaggaattctagcgcctttttaacccaggtgttggtatttgtgttttgatttttggttctgaaaatattgacataatcttttattggcttctaggtgcaaagaatgagataaaaggataaaccatccccaattttagaaactcacaaggaagacaaacacatgtggcattgaaacagacatgaacaaagcaagatataaatagcttgcaatctcgaattatccacatgaaagaataagatggtagcatggactacccaaagcacatagaattcacaaatactttccctttgagtttgaaatatgtttgggccctatatttgaacagagaatttcctatgatttgacatttgtaataatttgaagtaaaacctcaatttaggagaaacaattaagaaatcagtggtaatcccagcactttgggaggccgaggcgggcggatcacgaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaagaaatcagtggtatagaagtacaggatttttttgtaccactgatcatttcttctctgttgtactttatacaagatatggtcagtatcac

SEQ ID NO: 38501 - DNA, 1034 bp, Homo sapiens
tttcacattggcaataacaatagcaggtgcaataacatctgctctgcccaccacaatgcttagttcaagagcaaatgagaaaatggacatgaacgacttttgaaacggataatggaatgtacaaatgtagagagtatggttgttacgtatttattgagggtctacatgtgtccagcctaaaggcttacaattcaattggggaggcaagacaggagtatatgaaataatttgaggaaatgcaagaatgggaagtgatactgagctcttagctcattgggaacaaggacctaatggtgacagggctaagtgctgtgggcctgtcaggacctgattgatgacattcctagtggggcagggtgagactgaggtggctttcttgagctcctttccttttccatttcctcttctatgccattatctctggcatctccctgaggttctacaacctttctctgacccagcagccaagccctttttcctccaaccaatgctcaatgttttctgctggagctctcccagtaattgtagaggactgtttctgcaggagcgctactgcctggcccttggggaggaggagcgggccgagctgcagctcttctgtgccaggcggaagcaggaagccctgggacagggggtagcccgcctggtacttcccaagcttgaaggacacacctgtgagaaggtatgtagcacccctccccccaaattccccttcctctattctttgccctctcatttctgcagaaggggctgggctagcttctgggattctggttgggaaacaggaaaaacagaaaccaagtttgcaagctcttggtataggttgcagtggatgtgggcttgctagggtatggcgagaacaggttgggatcggattgcaagagcaaggagggaagttaggatggtagtgcttactccgaccacctcagcacctcccctctgacagtgtagggagctgctgaagccaggggagtacggagtgtttgcagcccgggcaggggaacagcgctgctggcaccagccttgctttgcct

SEQ ID NO: 38502 - DNA, 1099 bp, Homo sapiens
ggcgggcgcctgtaattacagctactcgggaggctgaggcaggagaatcgcttgaacccaggtggcagagattgcattgagccaagatcacaccattgtactccagcctgggcaacaagagcgaaactccgtctcaaaaaaaaaaaaagaaaaaaaaagaagaagaaattttgaaaataagaatgtacaatcacatattctgttattcatcagacccatgttgtcatcaaaagtcacatagactcaggaaaactacctgagagaatgagagtgaaaaagtcaaataacaacttaattttattatgaaaatagttttgacctgtggactttagaaaagattttggggcctaccacagattcccaggctactactttttgaactttgtcctaaaggaatgaattaatagttcccaagagataagaatgcagttcttggaacaatcttggaatttagagtttaaaagtcatgtctagaggctggtattagtgacttgctcagtatagcaggggggttggtggtaggtggtaggtctcttgttagacacccttccctgtcaagtaccacttgcttttatcttctgagccactgggcccctaaagtaggagttctttaccttttgagacccctttgtacatttgataaaatctgtggacccattccccaaaaaatgctttttttgtgtttaaaattcagcacagcttcagagtattcatgaaacctcctgtccaccttggaagctcattcacagagccgagcttcaaaaactccatcttagaaacctttcccctttccccaaaagactttaacgtgactcttaaatagaggttcagcttcaggcagaagaaagaaaaattgcccatcagagaataagacctttttgtgtgtgtggtagtgagatattcataaaaaaatttatcattttaaccatttttaagtgtacaattcagtggtattaagtacattcacaatgttgtgcagccatttacattatttccagaactttttcatcattctaaacagaaactctgtacccataaacaataactccccattctccctccccctccatcccctggtaacttctaatctactttccat

SEQ ID NO: 38503 - DNA, 1018 bp, Homo sapiens
tctcagagtgctgggattacaggcgtgagccaccgcacccggcctggatttcttctttaaagtcacttttttcttgttggcatttttttaaaaactccctctcaacatagcagtggaaggtgccattttcaatcccctcttgttatgattaagctcacacttaatgtccccagctcattgttcctttttgttatccaaggtctctgaaaagagaaccagcagcccatgtaacctgcgtagctcctcagcatgctgttttacgtagttactgtggccacagccacccacctctacctaagaggcttgtgggcagattgttgtcaaagggaacgtcaaccaagattagccagcagggctgggcattgtaagccatcaaagaccttttatcgattgaaatacaaaatgcaacttgtttagaaaattgaggtctggcatttttttgagaaaaggaggctttggggagagaccataatctgtagaaatcagggtcttgggtggaggggtaatcagttgtgactctgttgcagctccggtgaccaatcagccagtgacccccaaggccctcactgcagggcagaaccgaccccacccgccgcacatccccagccattttcctgagttccctgatccccacacctacatcaaaactccggtgagtgatgaagcactgggactgcgcgtggtgtaaagcacggagtcagttcctactgactgtcacgtggcagagtccagtccaaaagcttgttgatgaaagagtggttcaaaactcagaatgtggccgggcacattggctcacacctgtaatcccagcattttaggaggccgaggcaggaggatcacttgagcctgggagttcaagaccagcctgggcagcagagcaagaccctgtctcatttgaaaaataaataaataaagaaaaaaaaaagaattcagattatctttcataattgagaaacaatttggcaaatgagaattatgttctcaagtttgccagctaaagtataattaacaaagaaat

SEQ ID NO: 38504 - DNA, 2077 bp, Homo sapiens
acccgatctctactaaaaatacaaaaaaaaaattagccaggcgtggtggcaggcgcctgtagtcccagctatttgggagcccggggcaggagaatggcgtgaacctgggagatggagcttggcgtgagccaagatcgcgccactgcactccagcctgggcgacacagcaagactctgtctcaaaagaaaagaactgaaaatcagttccttaacctcactagccacattcatttcaagtgtctgatagccacatacggccagtggctgctctactaggcagtgcaaatattgaacatttccattggcacagaaagtcgtgtggtgttcctgcagtacagggagggagagtgatgcagtggtaactaaaagggggaaaatgaaggaattaagagaggtgtttcgtgtttttattttttaagataaaagaaataacgtgtttgtatgctgttgggaatgatctagtcaaaagggaaaatggatacaggagagaaagaaaagtctgggaatgatgtcatttggtagacgagaggggatgggcccgtgaccaaatggagggactagccttcttctggacatttcatacccaggataggagacaacatgtgggttcagagacaaaggtgggcaaggaggtgttctagtcctagtttgttttagggtatactttcttttctgctcaccggtgtgtcatactcagcgagtgaaaggataagagccccctcttgttcctgcacccttggagaaagtgccaagtacaatcgcagaaccgccagaagctggaatgcccttaaggctaatagggttatatagtcaggttgccatattcaaccatcctttaaaatcagcactagtttggatgccttagtggctgtagttggactgagcatcccttatgttctctaagatgtgataccccaaatggcagccagccaccctgggttgctagtggaatatgcctgtgtcatctctatttgctgaaggtcttatttgcctggacatactttttttttttttttttttttttttttttttttagatagagtctcgctccgtcacccaggctggagtgcagtggcaagatcttggctcactgcaacctccgcctcctgggttcaagcgattctccagcctcagcctcctgagtagctggaattacaggtacgcaccaccacgcccggctaatttttgtatttttagtagagacggggtttcaccgtgttggtcacgctggtcttgaactcctgacctcatgatccaccctccttggcctcccaaagtgctgggattacaggcgtgagccaccacacccggcctggatatactttttttttttttaaatattgaattattcctttcagaattagggctgggagaccatggctttaaataaagcagaggaaattgttattgtacgcttctgttaatttgggctgagatatggtgattgggtcatggactaagttgaggttcaccttatgagaaagaggaatcatgtaaacaaacgtcatcatacctttgtaagtacaatatagttaaagggcttggacatgcattcactgacggtcccgtagtgatgtgaggtcatggtggtaattgaacctaaagagtgtcagcaaccgcctgaggactcttgaataccatgaggccaagccagggttgcagacagcaggagtgtaggaaggcctgagtcttagagtcagacttgcctagcttcaaatccaggctgtgctgcttgccacatgtgtgaccgtgattgtgttactttacgccttagtctattttcttgtaagtagaaacagaaacacctacctcaagggacagggggagcgtgagacagagctggtatctatcaggtgcctggcatgtggcagctcctagcacacactgctccctcccctgctgttttaggctatctaaccatatgcccttctgtgaaaaataaaatcaaatgactccaagacaaagattctagtgacaatttactacagtcagttggacctaatgttattttgttagactaggaaatacaatcatatgtttcaaaatgcagagtgtgcaaaaagatgtatggtgacaa

SEQ ID NO: 38505 - DNA, 1051 bp, Homo sapiens
tcaggctcaagcagtcctcccacctcagcttcccaagcatgcaccactactctctgctaatttttaaatttttcttgtagagatgaggtctcactgtattgcccaggctggtctcaaactcctgggctcaagcagtcctcccacctcggccttgcaaagtgctgggattataggcatgagccaccatgttcggcctagaatatattttggaactgacattttaattcaaataggacatctctaccatgccctgggatttttgtaaaatagagtttggaaactgttggttaggattctcaagaattggtggttgtctctgttccaggaccattaaagttttataaaccctgtttatcaaactcttcaatccttaaatgtttttgtcttatgggctataactgtaagaaatggaatgactgtttggtgagataatagtaccaggaaagctgaattttgattccactttctattttggtgtagtatgaggttcatattattattaatacctactcttgtttgaatccccaggagggaccagctctgattctttctgtatacaagtgatttcaccatgtcagttatttctaaagcctccataacaaatagtaataaaccttgctagcagaaacaataaataaaaaacttcgctgggcgcggctgctcacacctgtaatcccagcattttgggaggccaaggcaggtggatcacctgaagtcaggggtttgagaccagcctgaccaatatggagaaaccctgtctctactaaaaatacaaaattagccaggcatggtggcacatgcctggaatcccagctactcaggaggctgaggcaggagaatcgcttgaacccgggaggcggacgttacagtgagccgagattgtgccattgcactccagcctgggcgacaagagcgaaactctagctcaaaaaaaaaaaaaaaaacctcaatgggacatataaagcagcctgtatgagaagagttataggtaaaaggtgctataaacatttgaaaaatctgcttcttactgagaaaaggaaatttaccttct

SEQ ID NO: 38506 - DNA, 1387 bp, Homo sapiens
aattgtaaaggacattaatatgctaatgcaatgcaatgtacatttcacaaacaatttttttttaaactttttttagtggagcattttgcagaactcttctactgagtaagctggaaaaatgctgctgtaaataaaaacctaagtgattagctgtttaaacgataaaacactaatgttgatttatgtgatttgactccaacaactttggttaccaataatttgcaacactgaaaatttgtaaattggaagttaccaatttgcgtttttaaaaaatttttggccaggtgccatggctcatgcctgtaatcctagcactttgggaggccaaggtgggtggataacctgaggtcaggagttcaagaccagcctgaccaacatggcaaaacctcatctctactaaaaatacaaaaattagccaggcgtggtggcatgttcctgtaatcccagctactcaggaggctgaggcaggagaatcacttgaacccaggaagcagaggttgcagtgagccaacatcacgccactttgctccagcctgggcaaaagagtgaaactctgtttcaaaaaaaaaaaaattccagagtctagaaattcggtcatttttctctttatgtaatggtaagaattaagaatcctcacatctgcaaccaaaaatacaagcctggtgtgtaacactaaagggtaaaacagggatagatataagctgttatgctattcttcaggcaacactgtggataagtgacattcagatgtttactgtaaagaaaaatttgaatacatttgtattgaagggcttttagaaaagagcattactacacagaactgagagttgaaaatatgaaggtgtggaagattaagagaacgcgtttactttaaaagataatttaaaagttatctttccaggctgacacggtggcccactcctctagtcataacactctgggaggctgtggtgggacgatccctcgagcccaggagttcatagaccagcctgggtaatatagggagaccccatctctatctaaaattttttttaaaagaaaataaatatctttacagttatttttcttagtcctatgttctttattttggtgttttccattggatacctgcatgccaagtgttgtgctacagtattactgaagagtataatggaagtaatgtcctgctgaaaattttctttgagatattaatcattaataatttatatattgctatttaatacttacataggtctttagccttttaaaggatttctgtttgacagcttttataattgaaagttattccattttttttttaattttgcatgcttgaaaaagatgaaaacagtgatttaaattatgaagtatggggccaggtgcagtggctcatgctggtaatcccagc

SEQ ID NO: 38507 - DNA, 1061 bp, Homo sapiens
acctctgcctcccaggttcaagcaattctcctgtcttagcctcccgagtagctgggattacagacacctgctgccaccacgcctggctaatttttgtatttttagtagagacagggtttcaccatattggtcaggctggtgtcgaactcctgacctcaggtgatccacccatctcagcgtcccaaagtgctgggattacaggcgtgagccactgcgcctggcccccattcttcttttgttagatttatttctaggtgtttggtttggttttggggggaggggagacattgtttttgggttttttggtgggttttttttttttttgagacagaacctcactctgttccccacgctggagtgcagtggtgcaatctcagttcactgcagcctccgcctcctaggttaaagtgattcttctgcctcagcctcccaagtagctgggattacaggtgcgtgccaccacacctggctagtttttttgtacttttcatagagatggtgtttcaccatgttagccagactggtctcaaactcctgacctcaggttatctgcccacctcggcctcccaaagtgctgggattacaagcctgagccaccgcacctggcctgtttttggcttttgattctatgggaaattttttttaactttactttgtatttgcttatagaaatacattcatttgtgtatatcagccatgtatccagccactttttccacattcatttattctaatggtttatagattttttttttttttaagatggggtctgtgatgctcaggccagtctcaaactcctgggctcaagctatcatcctgcctcagcctcccaaagtactgggattacaggcatgagccactgtgcccagccagtttgcagattcttttggatttttctgtgtacataatcatatcacttgtcattcatgaataacagcagttttagttcttattttgaatatttatatattttatttcattttctttattatactggctgggacctcaactacagtgttaaatacaagtggtagataaaagcagaaatctttgtctcatat

SEQ ID NO: 38508 - DNA, 2111 bp, Homo sapiens
tccaggctggtctcgaactcctgacctcaagtgatccacccacctcaacctcccagagtgctgggattaccggcatgagccaccgcacctggccagtttttggggttgtttttttgtttgttttttgttttgttttgttttgttttgtttgagacatagtttttcactctgttgcccaggctggagtacaatggcacaatcctggctcactgcaacctccgcctcctgggttcaagtgattctctgacctcagctttttgagtagctgggattacaggcacctgccaccatgcctggctattttttgtatttttagtagagacgaggtttcaccaagttgtccaggctgatttcaaactgctgacctcaagtgatccgcccacctcggcctcccaatgtgctgggattacaggcatgagccactgcgccagccacttttatatttctttggtttccactaatgttctttctttagaggttacaagtttatttttttaatatgctttcttggaagtatagtcaagttatttgagaaactgtagtggtttttgattttgctttttaatgtttccatgtttctttttctctccttcatgtggtatttatataatacagtgtagacctttttcccctgtttaattctctttttaggaaacatccctatatacaaaacagaatctagaagtagaaacgaacaggtatatttaaccagttataactgtaagaagataggtgacgtctctaaaaatctgagcaagtactattatgatttctttagtagccacctggctttcttaagaaaaggaatgaccaaagttgacttaccatttttatttttatttgtttgaatttatttttatttatttatttattttggaggtggaggtttgctctatcgcccaggcgggagtgcagtggcgcgatcttggctcactgcaacctctgcctcccaggttcaagcaattcttctgcctcagcctcccgagtagctgggattacaggtgcacgccaccacacctagctcatttttgtattgttagtagagacagggtttcgccatgttggccaggctggtcttgaattcctgacctcaagtgatccacccgcctcggcctcccaaagtgctgggattacaggcgtgggccaccatgtctggcctgacttaccattctagttcctaggttgggtggtagttcatgggtgtttattataatactactatgtttttcatgtatctgtgaaaacaatagctactttggtcatttttgatacttgaagtattctgtattctctattgtttaataagttctgacatactagaatagttaggctagtttctgaacagtaattttaattaaaagctatttattgttttgccttctttcaggctctgtgaaaacttctaattgcatattaggacataatattaaaactttattataaaatacagttataaattcaataacattttaaaagcttgtcacatttcttttaacaattttttctatagaccatagagctaaaaaggaaggattattgcagtgaaatattgaagtattttattgcctaaaacagatcttagatgatacctctgaaataatgtgtttattgggatttctaaatttatattttagagaatgttatataaacacataattttaaaagctattatttctcatagtacttgaagtttcctgttaaaacttataccttctatgtttttataatcaatatatatttctcctacattacttcttaggtttccatataaaagaacaactattattttcattcatatataattttttcacttccgttaagggaatggatccaattacacgtcaagtaggacaacatattgaaatggaaccagagtgggaagcagccttcacactacaaatgaaattaacacatgtcatttcaatgatgcaggactggtgtgcttcagatgtgagtttcttctgggtgcggggaataggaggaaagtggaagagggaggaataagcagaatcctaagtaaatttcaaggagatctggagaaaatagtggtgatacttagttcattaaacagcgtattttccttctccacctataaactcagtaaaatttta

SEQ ID NO: 38509 - DNA, 1026 bp, Homo sapiens
gcacattatgcatgcccattgttggcaaaggtaatgtatattcttaatatttgtcaagagaagtttatctaagggctcaatattttttaaatagaggaaatttcattctagaaaaaaggaaaagaactaaaaatgttgaaaaaatccgtatcattgcctaataaataacaaaagttatttgccttgtcatagatgtaaagtgtatgtcagatatgttttttaatttagctttatatccaagtctcttctatatcttccaaagaaggaagtggatctgtatcagtctgtggatgaagaaaagggtttttacagtaggataaactctagaagggtaatgttgtctttctttgggtccagggtggacaacttttgattccatagatgttagtacttgctttgttacttcccaaaattgtaatggctccctgtgatgagatgtcctgaatttgttctaccttggtgtttcctatgcttctacaaaaccaacaaatcaataatactattattctagaactatgctcacccagttatcatgaactacccctaacaactagccaccacattgtagtcccagctacttgggaggctgagacaggagaattgcttgaatgtgggaggtggaggttgcagtgaaccaagattgtgcaactgcactccagcctgggcgacagagcaagactccatctcaaaaacaacaacaacaacaaaaaaaaaacaaatagccaccagccttggggaagtggcaagagaacaatgacaccaagaaatttttgttgctgctttgtgaatgcttttttacatggcagtctttttttttattttactcttttagaacttttaatccatttggatttttaaaatcactcaaaaatcatgttaaaaataatttagtttaagattttcatttttgaactatttgtggaaacaaattattttaaatgttgaagcttatggctgtcatttatgtaaattaccattgttttgatacctcatgttctctaattgtaaaggtattttgattccgtt

SEQ ID NO: 38510 - DNA, 1051 bp, Homo sapiens
gtggacaggttggagcttgctgacttgtaagcctcacaataaggtgatcaggacacctccagtcttttgcttggtgacccccgaatgtctgtgtaaaaacaactttcccctgaggattgttcactggaaaaactaatctctgtggaagtgggtatacattgctgatgttctcaggatgggaaacagggtcaaggatctcattgtgtagtgtgtaggcttgtgcccagcaccctgttttcagccctgtgcctcacccctgctaagtcaaagagtctaactcctcttgggcaggggcagtttgcattatctctgatcactgcatacaattatctctggatatatgttaagtggttcaatttcaatatagcaaagagctgttaagaaaccgaaccatttgattgatatgtgcacattgttctgagctaattttatacatgtttacttcaggatcccttattctgagagcataaaagaaatgctaacgacatttggaactgctacctacaaggtgggactaaaggttcatcccaatgaagaggatcctcgtgttcccataatgtgttggggtagctgcgcgtacaccatccaaagcataggtaagagatttacagctgtttctctataagtcacaagcattcattgatatgaattaggcatagaatcttgtttttaaatgaaatgtttgaagtgggtaacaacgtgaagaaataataaaaagacttagaagcaagaaatgtaatgtactgacaaaatactagattgatagttcataaattaaccacagcaacagagaactcttggtggtggtggttatagcttcttgtcagttgaaggaatgtactgttcgtttttactttgtaaccaaatttaattcttgtgaaatgactttgaagattctgaaacttgacaatattgtactttctgtaggattggggtttttttaacctttttaagaaaattatattaaaatatacataacataacatttaccattttaaccatctttaatctgtagaaagaattttgagtgatgaagataaaccattgtttg

SEQ ID NO: 38511 - DNA, 1032 bp, Homo sapiens
agtatacgggaaggtgagttagttatctttacataacgcatttccctaaatattgctagatgatgatagcatgagaaaggaattcgtttgttaattaggggaatttgttgtctgttgacatgtttttaaaataagacgtggagtgatctgcagagcctttctgaactattcatatactaacataattggaaatctgggagaaaggtgataatatgcagagcttcccacatttatttggctgtggaacccttcatttgctcagggatctggcagagactagaggatagatcaaatgtactttggaaagttgatactctaaaacttatgttgtctcattcagaatgggaatttaaaactgcaagttaaattggcataatttatttttaaggtaatattcagtagtagcaggaataaaatgaaattattagaattccatgtatggttagagtcatgatttgctacaaatagcaattcagtagtttgcttagctttcaacagtatatatgtcaagaatctgtagtcaggaacctataaaaatgtctgttttttgactatcccatttctgagaacctacattaacaaaataattcaacatatagaaaaaaaacatataggcatataaagatggacactccagccaggcacggtgtctcacccctataatcccagcactttgggagaatgaggctggcagattgcttgagcccaggcatttgagaccagcctggccaacatggtgaaaccctgtctctaccaaaaaatacaaaaattagccaggcatggtagcatgtgcctgtggttctatcttctcaggaggttgaggtagtcagatcacccaggcaggtgaaggctgcagtgagccatcacaccactgcactccagactggacaaaagagtgagaccctgtctcaaaaagaaaaagatgtacactctgatattatttatattagcaaataattgaaagcaatctaagtgtttgcaggggaatagtttgatatagtgatgaatgtgttccaaaatattataaatcta

SEQ ID NO: 38512 - DNA, 1010 bp, Homo sapiens
aaggtaatttatactttctttcaaaacgtagggagagttagtaatcctttactccagcaaatataaagatcacttgcaaaaatgaaaattgactaaaagttcaaagaatagcttattgactatggtgatgtacacatttatagcataaaatgtatgtttatgcatatgtctccatttatttggatctcagtaaatgactgttaaacttctgtgtaaatgtttttacacctgcaaagcccttctcccgtaaagatcatagttttgctttcagatgttaaaatgttcagttatgtattattcataaacaaggttcctcagatttgaaaaggtgaaaactgacaatttcaagtgatttttaacttgaaacatgcatagcattaaaatttagaatacccataattgcacataaatctgattttaatctgggaattgatttgctctttcatagttgttttccatgttctgttttgattcatttcataaaagtagtatgaatgtggacttgactgtatctctgtatcccacagtgcctggcactggccgtagagtacctgcatgcagtgctactctctgaaagtttgtccactggcatttccatttagctagttgcctaggaaccatataaaagagtttagtcttccagattatttgcagtgatgattagagttggtatttaaatctgtgtctcgtggtaaaaccatcttgtatttctgtattggttgatccttttccagagcacccatacatttttatcatttaatgttcacaataaccctgtgcagtagattgtgcaggcacaccattttgcaaatgataaagccgagacaccaggacattgggaccagtttgatgtaggagtcgcctgactgcacttgacgcattgcgtcattttccatggattccttccatgtgccattctgttaacttcctacaagttacgtacctggcaaattggaagtctttcatcctttttttttaaactctgctattgcttaactctcatgcagaat

SEQ ID NO: 38513 - DNA, 1050 bp, Homo sapiens
acagtcctccgtcctcagcctcccaaagtgctgagattacaggtgtgagccaccacacccggctcctcatttctcaatcatttcctgtgtatggttttccatagttatcaaaatgccctcacactctcttagaaaacacagtaaagaagtataaaaacatttttgtcagggcatctggtttttaatatattgtagagttgtcttttctttaaggtctagtgttggtatactcactagaccttaaacccatacctggctgtgccagaaattcttcaacttagacatttacttccgagtcttttaatgaaccacaactattattaatataataaattactgtgctaaatgtttggagacttcaactaattattttatatttatgttcagcacataaatccctttataaggaggtttgttaaatattaagtggattatcttggaaggacacacaatcttttattctgtggatctttaaaacttgtatttccttacgcctgagagaagtgaattgtctgatttggagcagatgtggggaatcagttgattcctcactttttttacactggcttgatagatgcctggctggataataagggtccagcattagtcagtggatcctggaccatggaggaccaggcctgcatcccaaatcctgtgctgtaccatcgtcaaaaagtgctcacatgtagccttggtgcatattcttggaaagtaaattagtaactgacattaaccctaaaaatgtcctttggaaaccagaatcttaggaaagtaattgcattgggtaaacagttattaggcatgtatgtatcaggcattgcactaaactctgctaacacagaaatgaaaggaaactcatccagttttcatggaacttgtaagccagtggggaagtcagaaaaaccaagtatactcatatgttgcttaagaaggaggatacgttctgagaaatgcgtcgctagacaatttcattatcttgtgaatatcagagtacacttacacaaacctagatgatctagcctactgcagacccaagctatatggtatagc

SEQ ID NO: 38514 - DNA, 1032 bp, Homo sapiens
tggtacagaaagatgtgtactacaatgaagagtttccctcctcgtctcgttgcccacccacccagttgccatcaggcaaccagtgaaaccagcttttatggtgtgagcttaagttccttcctcacttttgtattgggaaaactttcaaacccatggacaaattggaagagtacagtgaatacattgacgtggtatcaccagtcatttctgttttgcagtatttgctttattggtgctaaatgtctatagtctctatgtgtatgtacacacacacatttatactttatttatatacttttttctcttaaccatttgaaagtactctgcaaacatcacaactttttatccctaaatacttcagcaggtgtctcctaggaacaaggaccttttaatataattatatcaaatttcttccatttggcctaataacgccctttacaaaaacagtttttcactttagaatccagagagcactgatttcatttagttgtcacatctctttagtctgtaacagcactgatcagttgtcttctagagtggccttgtctgactggacttgtctgactggaagtatgtttcctcatgactcggcttcatcaggctaaatggtttgggcaagacacatgttggtttgtcccattcgtggtgatgctgagtgtgggcacttggttaagtggcctctcccagatttctccgcaagggtctcaaaggtgtcttgttccctttgtaaagaagaaatgatctccaggatagaccatgtgactattctgtttctcagcctctcaccctttgatgcctctcacctgaatattatattgatagtcacaaaataatgattttataattgtagtatcctatctatatttattgcctgggatttttccagaaagaagagcttttttggccaggcacagtggctcacacctgtaatccctgcactttgggaggcagaggcgggcagatcacttgaggtcaggagtttgagaccagccaggccaacatggcaaaaccccatctctactaaaaatacaa

SEQ ID NO: 38515 - DNA, 1084 bp, Homo sapiens
tacttaacaatacatcagaatcaactggaaagctttaaaaagttatagattcctggccgggcgcggtggctcacgcttataatcccagcactttgggaggccgaggtgggtggatcacgaggtcaggagatagagaccatcctggctaacacggtgaaaccccgtctctactaaaaatacaaaaaaaaaaaaaattagcttggcgtggtggcgggtgcctgtagtcccagctaatcgggaggctgaggcaggagaatggcgggaacccaggaggcggagcttgcagtgagccgagatacactcaagcctgggcaatagagtgagactccatctcaaaaaaaaaaaaaaaaaaagttatagattcctaggccaggcgtcatggctcacacctgtaatcccagcactttcagaggccgaggcaggcgcatcacgaggtcaggaggtcgagacgagcctgaccaacatggtgaaaccccatctctactaaaaatacaaaaattagccgggcgtggtggctgtaatcccaactactcaggaggctgaggcaagagaatcgcttgaacccgggaggcggaggtagcagtaagctgagatcgcgccattgcactccagcctcggcgacagagcaagactccggctcaaaaaaataaaataaacaataagttaaataaataaataaataaataaataaagagttatagattcctaaaccccacattagatttctgaattgatctttgtggatggaacccagaaattctccaggtgatcttgacgcaacctgaatttgagaaccactgcctcttgatatccatcccttaccccagcttcaaattctccagagagtctgattaggccacttgtggttgagtaaaccatgactggaggggtagtcttctgggcggcacaaggaagtagttttccagggcctctgctgctcaatctggagcctttgtacaaattaggaaaaagtgcccctcagggccaaagtataaaaaggcacccctctgggtagacaacctgctttactggtaggcttggcacttttagagggtgtgtagcggttgcttcttccctggacttt

SEQ ID NO: 38516 - DNA, 1048 bp, Homo sapiens
ctggggagggcgtgggaggaggggcaagtggtgctagaaaaatgatgtgcctgcacagagtacaggacagaagaggggagggagcccagatggtcctggatggagagctggggaggtgagacatccccagttcattgcagacttgaagatcaccagcttattacttggaatttgtatgtgtttcaaattctccaagccattgattaatttcaccaagcaggcctccaggggatgtatttatttttgtggtaaattggtattctagcagactgtgctgtcagtgttaaaactgctgatggcatttagccttcagactggtattccattcagaggcatcagaagacggtctctatcaacaagatttatcgagcgtccagcatatatcaagtcccaggctaaggaaatacgaaaaaatctaatacataatgcacattttggggacccttgtggtctatgtggagagacacatcaaatgactgagggtccttagggagagcatggatcctgcagaggcccagagtgaaatctagagcaattggcattagtgcagaatggcttcctgggggagaggcttataatgcgaggtgggcaggatgggcagagaagcccttagaaggcattaagtattttcctagggcctcaggcacttcacaccctcggtggtagcactgtagcactctatacagtggtagttatttgtctacacctttatctgctgcattagactgagtatctggaagggaggggaccttgttttcatctctgtatccccaggctgacacgtaggagttgcctaatacctatttgaggaagggtaagaggaaatgaggaaataaatgtgcggagacagtaggaacaagagctctctggagggcatggagcaaattaacttggtagaaatagagctgatgttggaacacatatgaaatcaagtaatctaacaaccataaaagatgttttggggacaattaaggaaatttgaatatggactactgggtgatgttggaattgttaattttccaagtatcataattgttctatggttatg

SEQ ID NO: 38517 - DNA, 1093 bp, Homo sapiens
agggcagtgcactgaccttacgctgctccctcgtgtcctggacacctggctgccgttccctccctccctctctcctgctgctcctcttcccaaggcctcccatttgttgtgtaaaatgcagtgtttacctggccagctcccgcccctgttcctacttccacctggccttgactgttggtcctgaaccttgttttctgatgaccacacttgatcactctgaggttcctagctgttgtacctggagtgcagttgggaggacacccggttcccaacaccatctggtcacaccatgttcctcagggccaagggaggagcagagaggctggcctctagggagaaggggtggggaagctcaggcacctcccagtttgtcctgaaggcagggatcggggcaattggtacagtagtgatgacaattgtatgtattcaaattgtatgctttaacttttactattaccacactcttgtgaggtgtgctgttaacctcattgtgtagaggagaaaacaggctagagtcaagtgatatgcttggagtcaggtgaccttggagtcaaggtcctgctgttaaggagtggtatagctgggacgcagacactggcgttcagattacaaatccatggtacttccactctccacagctgccagggcctcttcccccaacccctggcactgacagtgtgagttgtatcgaactggtttagtttcttggccttaacctgtcaccaccaccaagattctttttgttttgttttgttttgttttgtttttttgaggcggaatctcactctgttgcccaggctggagtgcagtggtgtgatcttggctcactgcatcgtctgcctcccgggttcaagcaattctctgccttagcctcccgagtagctgggattacaggcacctgccaccacgcccagctaatttttttgtatttgtagtagagacggggtttcaccatcttggccaggatagttttgaactcctgacctcatgatccatctgcctcggcttcccaaagtgttgggattacaggtgggagccactgcgcctggcctaaccaccaccaagattcctaaaaggcgaataggaagcagct

SEQ ID NO: 38518 - DNA, 1015 bp, Homo sapiens
ccctctagtgtggagacttatgctgtccagatgttgaccgcagccctgcatcactatagttcccaaatatgaacaaaattccccttattttttgatcttgaaagaaaagcctattttttatgacagatatatatgggtccatgctaagtcacttgtttcaatgagatggaccctactgccagctctggtaatagcaatatgtattagcaccaactgcccctaagtggaaaagattgcccaaaaaagacattaaaaagccatattggctgggcatggtggctcacgcctgtaatcccagcactttgggaggctgaggtgggtggatcacgaggtcgggagatccagatcatcctggctaacacggtgaaactccgtctctactaaaaatacaaaaaaaaaaaaaattagccgggcgtggtggcgggcgcctgtagtcccagctgctccggaggctgaggcaggagaaaggcgtgaacccgggaggcggaccttgcggtgagccgagatcgcactactgactccagcctgggcgacagagcgagactccgtctcaaaaaaaaaaaaagctacagaaaaaatgttactaagaaggtcataagaaaaatatatttactgttcgttaagtggaagtggatcatcttaaggtcttcatccttctcatcttgggagaagctgattttgaagtctcggggtggcagagacaggagaaaatccacatatatgtgggcccacatagttcagctccatgttgtgtgtttgagggtcaatggcaatctggcttttttttttttttttttgagacggagtcttgctctgtctcccaggctggagtgcagtggcacgttctcggcttactgcaagctccgcctccttgggttcacaccattctcctgcctcagcctcccgagtagctgggactacaggcgcctgccaccacgcccgctaattttttgtatttttagtagagacagggtttcaccatgttagccaggatggtctcgatctcctgacctcg

SEQ ID NO: 38519 - DNA, 1056 bp, Homo sapiens
ctggagaattgcttgaacccaggaggcggaggttgcagtgagaggagatcgtgccattgcactccagcctcggtgacaagagggaaactctgtctcaaaaaacaaaaaacaaacaaaaaaagaaatacattctctctcagctctggaggccaaaagttgtaaaattagtgtcggcagggccatgtccttctgaggttctaaggaagaatctgttccacatctctctcctagattctggtggcttttgacaatctttggcattccttgtagatgcatcactttaatctctgcctctgtcttcacacagcattctcctccatgtgtctctgtctctgtccaaattttcctcttctaaggacaccagtcatattggacttaggtttcaccccaatccagtatgatctcattttaacttgattacatctgcaaagaccctgtttccaagtaaggtcacattcacagattctaggtggacatgaatttggtgaggggagggggtaggggactggatactgtgcaacactatgtaccaggcactgtgctaagtactttgcatacattgtctcatttaaccttcacaatactcccctgagattcctttattattattattcccatttcacagatgaaactgaggcttagaaatgttaactgggcacagtggctcacgcctgtaatcccagcactttgggaggccgaggagggcagaccacctgaggtcaggagttcgagactagcctggccaacatggtgaaacgctgtctctactaaaaatacaaaaattagcctggcatggtccagctacttgggagactgaggcaggagaattgcttgaacctgggaggtggaggttgcagtgagctgagattgtgccactgcactccagcttgggggagagagcaagactcttgtctcaaaaggaaatgttaagtagcttttattcagccagtaaggcagtaaggcagagctggaattcaacccaggtctgtgtgactctggagtctcttgtggtcttgaatgaagtgatactgctggctctaagattctagaagtgaa

SEQ ID NO: 38520 - DNA, 1032 bp, Homo sapiens
tgagagcttctaggacctacacctcacctcccttctacctcacacctttgcagctggcatactgtgtggtacaattcctggagaaggagagcagtctgactgagccggtaattccccttccgggccccaaggcccacctcttactgtcagcatcacttgccagtctgtacctactgggggtgccataagggggaactcaggagggctgtgacctgaccggtaacatggtttcctctctgaaggggaagcaaaacctatatacacctaggaaacagatccaaggcaaagaaacgggtagctggctgagatcacccaaactgtgcccaccagggtgggggagagagcaggtaggaaaacttcctggtgacctaggcaggtgcaaagaattttcatccccatgccctccttgtctcccaggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtgagactccaacctagcatatcctagcccctgccagaaactgaggtcttgagtgaaatgagcagcacccaccgagtctgcctctccccaccaggtggcagagcgtgctctctattactggaacaatgagtacatcatgagcctgataagtgacaatgctgcccgagtcctccccatcatgttccctgcactctacaggaactccaagagccactggaacaagtaaggcgctggggtggggctgggtggtggggatccagtttgggaaactttgagggtatggaagaactaaagagccaggggtctcacctagtcacccagcaagtggggctgatgtcccctgcatgttgataggaccttgaggggctgactggagcgaaaagatgcctgtgtgcaagatctctgtgataccaaacagcagggcagcggcctgttacaccgctc

SEQ ID NO: 38521 - DNA, 1031 bp, Homo sapiens
aagaatagagaatataagggaggatggaagacttccattcttaagcccatcgacctcctaacagtctccacaagcccagacccaagatattttggagagcgggagtaatgaagtgagagtagcttcctgctggggctatttcaggatgggtcccatggctatttaaagcttagggtgtggagttgggggaggttgggtgggtgggactagcaagccagctgaaagccatgtctctttcctgcaaggggcctcccttatttgagctgttttagtgcctgaggttttgcctggccctttcctctgccagggcttcttaaacagggagcagatgatgatacacccaaactcaggagatgcttgccagcaaaagcattgtcagttgcaaggatttgcctgaaaaaacctcagatgtacccaggtgtacgtgccactaggttgacaggttgtgtttaagagaccatgaccagctgggcatggtggctcacgcctgtaatcccagcacttcaggagaccgaggacggtggatcacctgaggtcaggagtttgagaccagcctggccaacatagtgagaccccatctctactaaaaatacaaaaattagctgggcatggtggcaggcgcctgtaatcccagctacttgggaggctgaggcaggagaatcgcttgaacccgggagggaggcagagtttgcagtgagctgagattgcaccattgcgctccagcctgggggcaagagcgagacttcatctaaaaaaaaaaaaaaaaaaaaagaccatgacttctcatgctggatctttctcttgtcctgcccaagggcattttttgcctcccttcccctttttttttgttttgagacagagtctcgctctgtcgccagactggagtgcagtggtgtgatctcggctcactccaacctccgccacccgagtgcaagcaattctcctgcctcagcctcctgagtagctgggactacaggtgcgcgccaccgtgcccagctaatttttgtatttttagtagagacgggtttcac

SEQ ID NO: 38522 - DNA, 1071 bp, Homo sapiens
ccttacaaaactccagcctccaaaactccgcccttcgcgattcttccccgcccctcggcgtccagacagatagacagacgacctgccccgccccctgcgccaccgactgactcagtgacctcggggtcgttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtaggtgaccgtgacagagacaaaaccatggaagtgactgggtttggagtgaccaggtgttcctccctcccctttcccagacacgcctcttgctgtaggtctctggttaagtctctctctctcattcccttcctgggagacagtagctccctaggcctgcaatgagggaggctggcttggggaaggagacgggaattgggcgtctttgaagacctgtgggcagagggagggagggagggtgtttgtcctgggtggggctctgggccaggtcctctgggtagctgtgaagtggtgaaagaaggggtgggaacgctggacttctggactttgggcagggcagatcctctgactctctggctgcagaacagtttcttccgtgctctggcctgagtgccacagccagggcctctgctctgtacacaggtaagaaggcttcaaagatgagaaacaagacccctctgaggaagtgggaacacagtctgagtcctggggggtgggaagtatgggttgaaggttagtgggaaaatatgcagggctgaccaggtttggagatgctgggcttagttctgcaggtgatgcagcctgaagaccttgagctttctgggaccctgtaatgtggatcctgcaaggaaggctcttgttttcttcttttccctttcttccctgattt

SEQ ID NO: 38523 - DNA, 1047 bp, Homo sapiens
ggtatgtgttgagtgaacgctcaggtgactagaacgtcatccaccaggtgtcctgcagatcccaagcccctgttagaagtgtaagccttgataagcgggatatgcactcacaggtttaggtgtgtatgtaatttctgaagacaaagtcccgagtcgcagggtagggattgtaagttacatattaggaaggtgtagatatgtgtttctcaaattagagtggagagtatagggcaggtcaccaaagtattgatgaaaagtttagtttcctgggccttactgcagacctgcccatcagaattattgagggagaggccagaaaatgcattttatttatttgttagattatgttgctgtttttgaatagctgatccagttacataggccagatttcaaaaggaaactgcattttaatttttatttatttatttttgagacagggtctcactctgtcacccaggttggagtacagtggtgcaatcacagctcactgcagccttgtcctgttgggctcaagtgattctcccgcctccgcctcccaagtagctgggaccacaggtgcatgccaccatacctggctagttttttaaatttattttttatttttaatagaggcgaggtcttgctgtgttgcccaggctggtgttgaactcctgggctcaagctatccttctgcctctgcttgccaaagtgttgggattacaggcgtaagccatcacgcccagcctggaaactgcatttataaagagcttcctggagattcttacctacgcttaagtgtgagaaccactgggtagccataaggagaatttatcagtctgaagcggaggtgtggtgttgagaaaaagggtgatattaatagtggggggcttaggagggagttcattcaaagtgcttcagtgtcttctatgggtgaagctgtctgaggaggcatggaatgcaggaagaagacaagatggagaaacgtgaatcagatgaagtatgaaagacaccatttggtaaagtgctaagtagaatagaagaacattctagaatgtgtgggatggtaag

SEQ ID NO: 38524 - DNA, 1050 bp, Homo sapiens
ggcgtgagtcactgcgcctggccggatggaattttctttaatgagagagagaagttgattgatagaatcaaacagtgatgtgtggcagattctgaggcctatataggtcctgggggtgtttttcctaaaccaggagttctagctcctgagagatgggtagttgagtggcccagatggatccttggattgaagcagccaaaattacttagagtgggagtgcctaggaaaaacttcctgctgctccctgctctctgtaacaattgtgtttacacatatgtgtgtgtatacacgcacacatatgcacacatgggctggctgggcctgagcccagagagcaacacggagggtgggcaccagaccagatgctggcgggggtgggggtggagggcaggcacgggagacgcaggcagagtgagtgtctgcatatagatggctgttagggagccaaggaaatggcttggaaaatgtccttattgggtgtttgcagctccggctttgttggggtcggcgcctggtgtgggcagatggccctgtctgcctgttgttgctgagggcttcttgcctgctgagcccggtacggcaggctcataccggggaagcagcaccctctgcgttttgtgccgtgtgtgggctttgtgaatgtgaacccgttagcccttactcaggtggggtggtggccgctgtccccatttcacggcaaagaagggtgcagaggccacactaaggtagcgtcactagggagcagcggaggcagggctgtttggcagcagcaaagctgcacatggagctggctgcctccggggtcacgtggcctgcatctccatgggggcttgtgtgcagtggagggggttgcatggcatggcccggtggcaaaagaggaggcagcctcgggaagcccaggacctttcccagaccacagtcctgggggcatactcaagtcagggggcggggacaggaatgtgctggtgactacatcaccttgaggcaggtaccacctcaatcccgaaccgcctgccttcttctctgtcattgctgtcctccatttcttgt

SEQ ID NO: 38525 - DNA, 1032 bp, Homo sapiens
taatatcaacttgattctgcccctgaatcagaattactgtgtgcccttttgcaagtcccttcccttcctcaggccgtttctccatgtataaactgaaaggtctagccctgaccctctgatactgtatcctctccactggccactgagtacccctccccaccactgctgactgtgtctgccctgcaggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctggtgagcctggggtgggggcggaagggatgaggtgagcacaggagggcctcaccacccaggctgcatgctcccccatctttccctctccagatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcggtaaggcatctggctgggagcattccagtaccatgtaccacacacatgcattctgtagaagggggtgcgatttgtatcacagacatcacagatttgtacatgtattatttcaaatttccaagagacacagttgaatgttttgcttttacaagatgagtctgacacagggaagagtctctgggaagagcccttttccagtttgcacaaaggcactctgagctagtgatggttccacttctctctccccaccacccacatgggtcttctgggatggaagggtagagaccccagggatgagagagacacaagagacctaggtagtcaggtggtcatagtctagatagcgtgatccagtgtggcaaagacatcacacacacacacacacacacacacacacacacacacacacacaca

SEQ ID NO: 38526 - DNA, 1035 bp, Homo sapiens
tttgaaagaaaacgtagtagcccagccccctcatgcttatagaagaggaaaaccgaggttcagaaaaggggactggttatttcagggtcacttagatggtcattaccagagctaggaacagaccttggtgtcctgactccccagccaatgggattaccacagtccgctggagcagagaactcaggggattataataatgacaatgataataattatcataagagcagcaaatatttattttggtttttttatgtgccaggtagtgttttctaagtgatttacatatgctaacctacttaatccttacagcaacctagggggtaggtattatcctccttttaccgatagaaaactgtagctcagtagatcaataacttacctaagagtcaggcatcaggtaaatggtggcgttgggatttgaacccaagctcactggtttcagtctgggttctcagtccacacaaagcttctgcaaaggcaggatctggtaggggctcattgcttcatctttactctgggtataggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtgagtcacgaggggcagggagagattcgtccttcctggggcaaatcaagcatgctaagagtgtgtttagggctggcaccaagagaacctctttccctgctcagaaggaaggtgaataggggccagagcctgagcgaagcctcttatatcccgttggcaggcatacctctgcccactgagacccctgctgtccttgtcagtaagtttcaaccatatattctggccctgtctagctaccccagccccgtg

SEQ ID NO: 38527 - DNA, 1106 bp, Homo sapiens
gatttcctagctctgtaagaacacctagtatttggtgaatatcaatttgatgcaaaggaaaaaatatagattaataggctatttcaggtatataaagaggctaaaatgatagcctctggcttatctgttcattctcagtgcattgaccagagaagagaataggacttatctgtatttttgaaactggattgagatttattagttggttttgaaatcaatttggtgggttacaaccaacatttttttaaaaacttaagtcattagtgtgtagcacttagtaggggtaaattttgtagcataaaatatatgtttcagttatatgtatgtatgtttgtaacaggttaccatgtaaaatgtatttctttctgtgagccttagtaacaaagtttgaaagcgtctggggtaggagatagaatctaggaaaggcagggagaaagtactggggattgaggagaagatatggattgggtatggattacagggagtcgggctcacgtccttctatcactgagccagcaagatggcatcgagcagcacatggattttgacagtcgctatacattgctggagctgtttgcagaaaccacatcctctgaagaacactgcatggcctttgagggcattcatctgcctcaggtacactgccagctgtagggaaatgctgtgtacaagggctaagacattatttatgaaaacgtggttcaggactgaatgttagcaccagagccacctgggaacttgttaacatgaaggttcatgtcctccctcccagcccctctccattcagaatttctgagatgagaacccaggaatctgtgttttaagacactccctatgcctttcttacacaaatcaaagtttcagaactacaggcctggggagaaggcctttatatttttctgtagaggaggatacttcagggaaggggagaggctaaagccaggaagagatgaacctgtcccaaggattgtgtcttacagatcccaggaaagctgcttttctccttggtgaagcgctacctttgtgtcacgtccctcctggatcagctgaatagcagtccagagctgggagctggagaccaaagctccccatgtgccacaagagag

SEQ ID NO: 38528 - DNA, 1044 bp, Homo sapiens
gcccccgcccagatccttcaccttcctcaatgatgcctgccagggactggagcaggctcggaaggtggtagcgggtgggggaagagagcaggggaggggtgtgccaaatgggtctggggggcttggctgctttcatcggacttgcctgggtgaagggaatgaggagagggcaggcgggagagctgatgggagcccctgcaggtgctggcctacgcctgcgtgtacagcttctacagccaggacgcagagtacatggatgtggtggagcagcagacagagaacctggagctgcacaccaatgccctgcagatcctcctgggtgagccacccctgccagccaggccctcctcctgcctcctcccctctgttgcacagcccggcccctcccagacaggtcaagcggcacccttaccttccctctctcctcttcctcttcattcttcatggccttctcactgcctggctgttaaagctcaggtcgaaagcctacattgtaaggtgcccaagggcgcagatgttcgtggatgtttcttggtttctggtctttaccctgctcccctagggagcttcatgagaatgtctagagctgcacctggtgcttggtagacgttccataggtgtttgttggaggaaggaatggatgagaatgagaagggagggagcctctgtgcctgccccctctgcagaggaaaccctgctgcggtgcagagacctggcctcctccctgcgcctcctgcgggccgactgcctcagcacgggcatggagctgctccggcggatccaggagaggctgcttgccatcctgcagcattctgcccaggtactgcccggcccagaccccttctgctcctgcattctgcgggagttgaggtcctcctgtcccagcacagcccctgccctggggcgagtccagaaggaaaggcagcaaagcgggtgaatggatgttagacctgggcgcacatcccggcttttgggccaacctgcctgatgctgctggaccctatcacttcacctcctggggattcctacaaaataaaggggttg

SEQ ID NO: 38529 - DNA, 1027 bp, Homo sapiens
gatttgtacaaaggaattttgctaatgtgttagttggggcttttttgggtataagttacagaaacacactagagctagcttaagcaaacaagaatttataataaggatgtagagatacattgcagaatccaaaggcaggaacgcagctggatcttagaaacagcccagaaccaggcctcaactcgcagagctctctgcttctgtgtgcctctctccctgtatttgcctggttctcttctctctgtggacacaccctccactgagcagaagatgtgactacagagaatgctcgagtttacaagttacagccaacaaggagaagctgcctctgggacctgatcccaaattcccatggaaaggtctcagaagtggtgcccacttgtagctgggtcaaccctggctggcagggttggggcatcacaggcagatagagcttctgagagcccagtcccttctagagaaggaactaggacttttttttttttatatttttttgagcagggagatagctccatgaacatatgaccaaaaaaaaaaaaaaaaaaaaaaaaggtaaacagaaaaatttaagccacagaaatagggatctatgcaaagctctgctttttcccctgagatatggtaactctagccacaggtcgacttagccaacccatcatccaggccctaaagcctggaattctacccttccctctcccgttctggagtgcctgtctcagagtttaccttggaagttcttgggtggtttcctcccattctctctggcatgctgctccccttcagaggcccttcacatagacagtgaaactgatagccactctgagtggagaaaaaaacaccctacttttctagagcctgatttgttgatcagcctgtgaagcggagaattctttccctacacactaaagaaagaagaaaagagaagcctcagtgggaggactggcagcccagagtgtcaagagggagaccactgccacctctgtcctgtctcctaccaatagcagatgcttgtgtggcttccttgcag

SEQ ID NO: 38530 - DNA, 1055 bp, Homo sapiens
gcccagcctcttgcctccgcaccacctccttcactgagatccgcagcagaccagcccctgcgctgtggggggctggccccgtggcaggtaccactacagctgaggtgggccctagaggggtgtccactgtggttggggggtctgggacaggtaagacaagctcacaggtcttgccaccatagccactggggcagaggcagtcgaagtcgtggacacggtcccgacagcgggcccctctctggcatgggcggctggcacagtcatccaggttgatggtgcagaagcgtccagcaaagccctcaggacagaggcaggagaagcggtttatgccgtcaaggcaggtggcaccgttagcacaaggccgcatcaggcagtcatccacatttacctcacagcgggcacccacaaagcccaccaagcagcggcacgtgaagttgagagcaaagccctggtcgtcctggcactgcccgccattgcggcatggggagctgtggtaggggtgagagaggacatgataaccaacttaccaacacctgtagggcagcccaggtcagtatcctgaccactgcccgccatgtcatcttgggctacacactccgagcctcaaatacctcattttaaaaatgagaataaaaatagtacccagcttccctaattgtgagggttgagtgaaataatcaatgtcaagccattagcacagggcccagccagaaggcagggctcagggtaagtgtgctattattatcctcacaggctcctgggcctgatgcagaaatgaggacaagtccagccctgcaggctgtttcctcatccctactgtgacacagaagggtgcaagccagcgttcaggagaggatgaggagagacccaggcccttcagtctccccacacccaccctccccaaccagaacagtcacacgtttgttacccctctagctcctatagattgttgaagaaatggctcagaaggtacaaaaaaaaaagttgagaaaccctgaactaggaacactttggcatgcaggggttttatctgagtgtccccgtgtgggtctgac

SEQ ID NO: 38531 - DNA, 1046 bp, Homo sapiens
agtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtatggcctaacttgtcttaatgacctcccctctcccacttttctccccattcataagtattcccagtcctagtctcatcctagtcggctagtgactccccctcgccccactctgcctagggtttccctaggcacagagcatcagggagcgggaaagggggcaccttaagtaaccttagcagggttcctgagtcttccctcggaggcagggaccatatctttatggggctagtgtaaggtgttgcctcagaggcctgggttctaggcctggccaggcctattttgagatcctggaccaggtcacgcagcttagagcttgggctgtgcgatgctactgccccctagtggtgcttactggtagttccaattcctcccctactgccggccccaagtga

SEQ ID NO: 38532 - DNA, 1030 bp, Homo sapiens
tccagagagtcatgatcaaaccactgcatgcagcctgggcaacagtgagatcctgtcaaaaagaagatgaagatgaagagatatatagagcaaggcatgtgagaaggggtgcggagctttcatgccctccctgggtgagccaccctccaggaatctctactattacagctatttggaacctctccggaccctgtcctcttgggtttttagggaggctccgttatgtactcatgactgattaaaccattggctatgggtaatcaacttgacctgcagtatctctcttcctctcccctccccagaagttgagggggtggggccaaaagtcccaaccctctaattatgccgtggtctttttggtgacctgccctatcctgaagctattagttaacattagcatacaaaaagacaaaacttgggtgattccaaggatttttggagttgtatgccaggaaactgggatgaagaccgaatatatatttcacaatattataagtatccttttctggctgtgtgtatgagtatattgctctttcttttctttttttttttttttttgtgggtgggggacggagtttcactcttgttgcccaggctagggtgcaatggtgcaatctcggctcaccacaacctccatctcttggattcaagtgattctcctgcctcagcctcccgagtagctgggattacagtcatgtgccaccgtgctggctaattttatatttttagtagaaatggggtttctccatgttggtcaggctggtctcgaactcctgacctcaggtgatccacccacctctgcctcccaaagtgctgggattacaggtgtgaactgctgcgcccgatcttgctctttattttctttgaggcctatcctcttcctagttcaaataatgatttaaaaaaaaaaaaagtcaagtatttctctaattctctaatttgagagtgttttagaacaataattatattagtttttatgggtgtcatggtgaagaggtaccgatgttttcatttttatggtaaatataaa

SEQ ID NO: 38533 - DNA, 1039 bp, Homo sapiens
ggcttcctgtgaccttggctgtctctgggagcagggctggggtacctgagtggggtgcatttggggtgtgtgggaaggagagggaaagaaagatggacagtgggactctcccctagcagggtctggtgttccgtaggctagagtgcccctctgctctgcgagtgctgggcgggaggggagttggtgagagctggagacccccaggaagggctggcagaagcctttccttttgggtgctgtcaggtccgcatgtcttggcgtgttgaccttcacagcttctggcgaggggaggaatgatctgatgcgggtggggagggttagaggaggcctcaggcctaaggtggtgcagggggccccctaggggctgggcagtgccaaggcataaaagccttccctggtccctggtggcatttgaaggtgcccaggtgagaggggcttggcacctcctcaccctgggagggagaagaaaccagggaacaggtaggagtgggagacaggtgaggctttggaaatctattgaggctctggagagatttgtgtagagaggaaaatgtggttctcccccagggtctcctcctgggtttttaccctctaagcaacctgtgggcatgctgggttattcctaaggactagaagagcttggatgggggagggtggttggtgcccttcggtcctcggcacccccctccgtctccaacaccagctcaccctggtatttgtcatgtcagcaggagaaggtcaccatgttgtttttctcgcccctagtccttccttcctgccccagtccaaatttgtcctcctatttgaccttaatacttaccatggctttggaccagggaactagggggatagtgagagcagggagagggaagtgtggggaaggtacaggggacctcgacagtgaagcattctggggttttcctcctgcatttcgagctccccagcccccaacatctggttagtctttaacttcctcgggttcataaccatagcagtccaggagtggtgggcatattctgtgcccgtggggacccccggt

SEQ ID NO: 38534 - DNA, 1027 bp, Homo sapiens
gggttccctgctcacctcttctggaggcctgggaggagggctgcccaaggagccccccagtctgggcttttttgtcactttgtcatctctgtctataggattggagttggagttgtaacagctgttggagtcagggaagagggaggggagcggagggtagggtcccacccaggagaccttccagtctccccagcccttccaggttctcctggtccatcctttcctccacctcctcattgctctttgcataatgttggctccgttgcccgcccccggcccctgccagtcaactctggaactgcagggccctctggcattctcgcttcagcctccttagggagatgatgaagattacctcctccctcaagtccccactgcccaccatcagtgcccacctccgctcccaccctgagtccccctgaaaggaagaggcatatttgagggaagcagggtagagggcagtcattcctctctgcttcagcctctgcgcttcctgtgccttctgtgccttctgtagccctggagctctggagcactcagcccagcttcccgggggctcagactcaccaggctctctgatctctcatctccctcacccccagtgtggcttcagctatgcacggggacagccatgaccggtatgagcgtctcacctctgtctccagctccgttgactttgaccaaagggacaatgtgagtgccctccccccaaacttcttagtcccccaccccacccccagggcacatgggctgagaagtccctcactttcagtgatgtggagtcagggatgctggtttggcctcctcctcagcaaagaaagtgattcaaccaaggagccacaggatgaccccccaggccctgaactcctggctgctgtcctctatgtcacagtctccaaactagcacagccttaacattcatgaattcccaactttgtttgccataaagagttttgtgcccacttctgctgattaatcctaaggccaccttttttccgtagtcatggttttagaaataataataagc

SEQ ID NO: 38535 - DNA, 1030 bp, Homo sapiens
ggcctgccctcatttgctttcattttagtggggaggggtggacagggaccggatgaactagtaatagagactgtgtcaagaagaggtaggtgctaagaaaaccacagcagggaagcaggcagggtaagaggggttgggaagggttgctatttctgatgggatagacagggagggactctgacagcgtggcatttgaacagagacctgagtgaaccctactagtcaactgtctattcattcagcccacatttattgtatacctactatgtgcttcatgcctgggagacagagtataatcagacctgatcagtgcccttgggaagctgaagatcctagttgtgtttcaggggttggtctatagttttgtttaggagaggtcagcctataagcaggggtaagggagactctagtcctaattggagttttttggatcactgggatgagcattatggagtagccatttcattgatccgctcatttaccacatgtgtattgaacacctgctatatacaagctgttgggacagggctgggtatatggtgaggactaagagacagcgcttgagctcattgtcaggattaggcagggcttgtggtccaagtctgcagtctgtctggattggaagactgtctcagcacaattaggaaatatcttgcatgcaaatcaacgggcctgtgtggttggatttagaggattagagatgagtttagtgagaatgagagctcacccttccaaaggggaaacctcaaatggtttgaggaacaatatcagaggaaaggtctctagcctcctgggaagtacatctcaaggaccctatcccagatttaagtttctaaattctcatgggtttatgaggactatcttaatactttagaacagtaactcatgcattcaatacttggtggtccttcatttaaaaaaaaaaacaattttttttgagacagagtctcactctgtctccctggctggagtgctgcaatacaggggcgtggtcatagctcactgcagccttgacctcctgggctgaatc

SEQ ID NO: 38536 - DNA, 1043 bp, Homo sapiens
tgactgtagtggaggggggcgccaagcttacttgggtggaggtggagacaggtttgcaggaaggagtgaaagacaaccccaccatacacgttccctcaaggaggagaagccaggttggggttaggcagccaggatgggttgatcaacagaatgaggttcgacagtcaagttgctccaccccacccctccttccacccagaggctctgggctggggtacagccattctgaggtagccttgcccttccttccccgcttaggaaagtgaagccagctgaggcagagaccgcaggagccatcatggccttcttcctgtgtctgggtctggcactgggggctgttttctccttcctgttccgggcaattgtgtgacaaaggatggacagaaggactgcctgcctccctccctgtctgcctcctgccccttccttctgccaggggtgatcctgagtggtctggcggttttttcttctaactgacttctgctttccacggcgtgtgctgggcccggatctccaggccctggggagggagcctctggacggacagtggggacattgtgggtttggggctcagagtcgagggacggggtgtagcctcggcatttgcttgagtttctccactcttggctctgactgatccctgcttgtgcaggccagtggaggctcttgggcttggagaacacgtgtgtctctgtgtatgtgtctgtgtgtctgcgtccgtgtctgtcagactgtctgcctgtcctggggtggctaggagctgggtctgaccgttgtatggtttgacctgatatactccattctcccctgcgcctcctcctctgtgttctctccatgtccccctcccaactccccatgcccagttcttacccatcatgcaccctgtacagttgccacgttactgccttttttaaaaatatatttgacagaaaccaggtgccttcagaggctctctgatttaaataaacctttcttgtttttttctccatggctccctgtgtcctccagccgtggcttcatgccctggagtgggtagagggctg

SEQ ID NO: 38537 - DNA, 1811 bp, Homo sapiens
tgggagtcttctgctggaggttccttcactgtgcgtgctgaccatggtaagttagcttttctgttacaaggtagttgggttaggattttctgggctcacaccagtagcagaaattttgggcatcctgtctgtaaagcagttcttcacagcagttctgctgatacttactaattgctggtctcaactgcatatactttttaccctgttacacgcttgtaattgactcttctaggtgagcccattggcaggggtaccaaagtgatcctccatcttaaagaagatcagacagagtacctagaagagaggcgggtcaaagaagtagtgaagaagcattctcagttcataggctatcccatcaccctttatgtgagtatggacttttaaatcttttacacttaacgtgcaggatgtttcctgttctggagaatctcattgtccctggcttttgctttccctggtagtgttttgtactccaaggctaacttctgtttttgttacttagttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaaggtgtgagaagcctttgcatgttggctcaacatgcacatatggagaggaatgagttaggtggaagagtgttgggtaatagacacacggaacttgtccaactgataacagaaatgtgatagccatgtgatttcacttactgattaccctgtcatagtgaagtgccatcatttctaatgacctcactttctcttcttatggaaatctgggtaatgtctattggcagccttacacatccagggttctgatcagaggggactgttttctacatacagctagtacccatctagatcgtggagggcattaaggctcagttttctcaggagctgcttgttgtgtgtgctctatcccttaggcttagggaggatcattgttccacttttagataatttggtgttggggctaaaaggtcctcttttgaaatgtaccacttatttttggtttctttcagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcagtgagtatctccttggcctaatttagttgggtgaagtcttgggaggttttaggcattctgctaggatattctaaggtaacagttttctgcaatacatagtaggtgtaagggttcaggaggctattagagccttctgtttgaatctggggaccaggtctggtctagctgttttttactgagctttctcaccctggttgatggcagattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaa

SEQ ID NO: 38538 - DNA, 1104 bp, Homo sapiens
aagctcatgaaagaaatcttagataagaaggttgagaaggtaagccattctggggctaggatatattttgtaacatcttcgaggtgggctccctcacaagcatgtttctatacaattagtggtttgaggcagcctatttactgtttcatgccttcttgcctcttgttctcttctctagtcaggtttaaggctattttaataaaatttggcacagattaggcattgcttcagttaacttctgagagtagataaaataccatcattttcttttttttttctttttttgagatggggtctcgctctgtcacccaggctggagtgcagtggcacgatctctgctcattgcaagctccgcctcctgggttcacgccattctcctgccttagcctcctgagtagctgccactacaggcgcccgccaccacaccccggctaattttttgtatttttagtagagatggggtttcatcgcgttagccaggatggtctccatctcctgaccttgtgattcgcccacctcggcctcccaaagtgctgggattaacaggcgcaagccaccatgcctggccgattttttttttttttggactggatctcgctcactgcaaactcaagtctcctgagtggctgggattacagatgtgtgctaccacacccggttaattttttgtagacagggttttgccatgttggccagcatggtctcaaactcaagtggtctgtccacctcctccccctgctggaattaggcttgacaatgcctgttttctctttcaaagtggtaatgtcaatctaaggcttttgtgatcgtccacaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccc

SEQ ID NO: 38539 - DNA, 1049 bp, Homo sapiens
cgtgttgtgcgagcgccagtaggacagggaccgtgatgtcaccacctggctactcggctccaagctcacttgttaggccctgagtgaacatttgttgacttgaatacgccccctcccaccccgcccccccgccccccccggccccgggaagaactcagagttccaactcagccagagttggtcccccggggcaccatccactcttagtccaggcaccacgactctgtctcatactcagaaataaagaagttgccgtggccacaactttgtgtctccattgacttccttgcagaggggaagcagtttgagtgccaggttcagagagcccgtttatgcccgcatctctctggttatctgttatcagggcataacctgtctgccatctcgacagatcccaaggtctgtctctttctgtcactgcctttgcctagatagaagccagaaaggaaaaactggcctaggatagtctctgtttccagaaacgtagtggatagtgccattggtgagccaaagggcagtagagtgggagtgaaatagaaattagattttagtgcgttttgtgttcagagtgtaccgaatttatcagtttctggagcacatcatgtcttttcatgctctgtgtctttttttcgttacattttatggcttctttttttttttttttttacatcttttgccttcctagcgcttgacatctttctgatcatccttcaaacctagttcggaaacacttcttggaatctctgtaagaattaattgcacccccgatattctcatgatacctttttcttccgtttgttaaaacttgctttgtctttttgtaagcatcacatcctctgtgtggtactcggtaagtttcttaacttctgaaagcctcagttttctactttttctaaattgggataataatacttaacctctcttgaggattacacgagttaatacgtttggaatatttagatcagagtagggcacatagtagcctctgagtaagagctagttgctctttcacctcaccagacagcatggcgagaggaccaggtcttggt

SEQ ID NO: 38540 - DNA, 1034 bp, Homo sapiens
tggccaacatggtgaaaaccccgtctcttctaaaagtacaaaaattagccaggcgtggtggctacttgggaggctgaggtgggaggatcggttgaacccaggaggtggaggttgtagtgagctgagatgctgccactgcactccagcctgggcgacagagtgaggctttttgaatgtagaaattggctgttaagaggaagatgatttttaggctgaagaagtcgttctgatttctgtttgtcttagtggtaccagttcctgctgtcatatttggtaggacttaagtcctgtttgcctgcctgtcatccagctaagtagactggatggaaaaggtgggctgggtggggaattaggaaagacagagggaatgtcatagtagttttacttaaattttaaaacatatcaaatgaaaggttacggtgaatttagtgagtgtaagtcaaatgcttaaagaaataagccatggtgtgagaatcaaagcatgagaaaatagtatgaaaactggaaacactgtaagaaacgtgattttgtattgtcttccaaatatttcaaaatttctagaaaagcgtaaataaataaaaacatgatagatgagaaagaaggcttatgatcatgattcagtgaagtaaccttttttaaccattactaatcttgcataattaaaataaaatagaatgtgatgagatggggaatattgactggggtaagtgtaaccacacagcaaatattctgttgtcaaaaagaacagtttttgtaattgaaggatgagagcacaagtcagtgtatccattgtgcaaattggatatttatgccaggtaactgattaatatataaaatgatctatgtttaataggtatgaatggctggatccaagcattaagaagacagaatggtccagagaagaagaggaaaaactcttgcacttggccaagttgatgccaactcagtggaggaccattgctccaatcattggaagaacagcggcccagtgcttagaacactatgaatttcttctgtaagtgagtcttcagaaa

SEQ ID NO: 38541 - DNA, 1050 bp, Homo sapiens
tatatctcaaagctattcaatgtatagatgagtggattaaaaggaaaaaaaagctgttgatttttttcatttgccatttatttaatttatatttagtaagtacatttccatccagagataagatatgtatttacttgtagttccttttggtttttctttttgccttattatgtgtatgtgtgtgtgcacctttaaattaaaactaggatttgttttggtgaatggtgtgaggtaaggatttaaataactatttcttccccaaataaatagatactttttttttaactgtatgggataatttatccctgtcacatggcatatgattttcaaagtgattttgcattcttttcagacgtcttgctgccctccaaaaaagaagagaacttcgagcagctggcatagaaattcagaagaaaagaaaaaggaagagaggagttgattataatgccgaaatcccatttgaaaaaaagcctgcccttggtttttatgatacttctgaggaaaactaccaagctcttgacgcagatttcaggaaattaagacaacaggatcttgatggggagctaagatcgtaagttgcctttctgattttggaaatggaaaggaatagtaggaggagtcttacgaagggccaagtattatccttgtcagagccagatttttattatttatttattttacattttttaaaatcaattttttttttgagacagggtcttgctgtgttgcccaggctggagtacagtggcacaaacacggcttactgaagccttgacctcctgggctcaagcaatcctcccacctcagcctcctgagtagctaggccttcaggtgcacaccaccacacctagctaatttttttttattgttttgtagggtgggatctccttttgttgtgcagactggtctcaaactcctgggctcaagcgatccttcttaaagtgttgggattataggcatcagttactgtgcctggcctagatttttattagtacaatgtggcctacatatggttttatttatttaatggattcatctttctgagaaaat

SEQ ID NO: 38542 - DNA, 1426 bp, Homo sapiens
aattggacagatttaatggtgcagaagaaaggacttaggagaccagaagaactcttttcccacatgagcacattggctgcatcaacacaagattcttgggcataaacgagttttgtcatatcctgacattcctagtggggatatttattaaactgaaattttgtctttaatttttttcttagtacaccttaggatatttattttggtaaaattactaacacaacacctttagattttcttagggatcttgtggctcgctggaccctttctgtgtgatattttaattggttttcagtcttcctcctccaattttgtataaatactgctattttacattcttggtacgttaatatgttgatttgaaagaatttcagtatagagatacagcctttgtagcttgattctatatcatatgtgaattttcccctcacattctgtagggaaggctttctaaagctatattatggaaactttcaaagccacaaaaaagatgagtactactgtgaacttgtgatattaatcacacagcttcagcaattcatttttctggaatatggaaatttaaagctgtgtcagctctcagttaaaatgttggtttttttttttttttcaatagagacagttttgctgtgttgcccaggtaggtcccgaactcctgggctcaaacagtttgccctcctcggcctcccagagtgttgggattacaagtgtgagccactgtgcccggcctcagttaaaatgttgcttactatgataattgtgtccttttagatttcagatgcagaactccaggaagttgtaaaagtaggccaagcgagtgaaattgcacgtcaaactgccgaggaatctggcataacaaattctgcttccagtacacttttgtctgagtacaatgtcaccaacaacagcgttgctcttagaacaccacgaacaccagcttcccaggacagaattctgcaggtaacgtgtcacgtagtagaatgaggcttttactttgtttattgtccttagaagtatcatgcaggagaactaagcggtttggttgtgtttcttttagtgtaaatggtttgaaactgagtcctgaatgcatagatcttgcaatatttctgtagtagagaagctaaatagattcagcaatcaggtagttttattttcacatttattaaaattcgtaattttttgaagccagcccttctaccttcattagtcttttgtacctgtcagtaaagcatagttttgtaaaatttcacattgcctgccaatcctagaaagaaagaaatacttccttgcatttctgtacttagcttcacatagtgtgcccgcagttctactttcttccctctctctaacacgtggggtagacacagctttgtgtgttcccagggtgtctgtataccagagaatatccaaacctacaaaacatagt

SEQ ID NO: 38543 - DNA, 1033 bp, Homo sapiens
tccctcatttcctatgtttagtcggctctctgtatctgaggattccacatctgtgaattcaaccaactgtggataaaaaatattccaaaaaactcaaacagtacaacaataacaaataacacaaataaaaatacaatgtaccaactatttatatagcatttacattgtattaggtattataagtaacctagagatgatttaaagtacatgggaggatgtgcatacgttatatgcaaatacgatgccgttttatatcagggagttgagtatctgcagggagttgagtattggtcctggaaccaatccccggtggatacttagggacaactgtatgtcttgtctctcacctagattgtaaaatccttgggggtgggaaccatgtcttatgtgataacaccttacctatcaggaatagctgtctggcagcatcaccgttctgcaacacaccaatatacaggaaataggcaaccaggaaaaaaaaagactttgaataattaaaatataggttgctgcaaaatctgtggatcttattcctaggagaatctcttaggcctcactcaggaacttactcatgtttagatgtgatttcaaaagtgtggtgtttggtttccaaacaaaatgtaaaaggaggaactatttaataaagtgtgtacatttgtaataatgacagtgatagtgatgtgagaaccaacagcttgatagggagggaggagacaaatatacacaaaactcaaagagtcatctggggtcattgagtgtggtggcccacctccctgcccactgcatgttcttagtcgccctaatgtgccaagaaaaggttgaaataatgtttagtggacgtagtttaggaaggcaagaaaatatcaaatgtagtgattattgtaagtcagtaaaataaaaataccatgctagctagaccaaacattgattttaacctagagatcctaacaaaaccagctggacagaattttgaaatctttattcttttttttttctatatttcctgtgaaataatttatgtgaaaaacatttg

SEQ ID NO: 38544 - DNA, 1041 bp, Homo sapiens
attttttaggccatacgagatgcagagcgtgtaaaggaaatgaaacgaatgcataaagctgtccagaaagatctgccaagaccatcagaagtaagtgttagaatttctggtttaggaagttttaagtttctttttatatgattgctgcgttttacatcattcataaagactataaaacaaaatttcatctactttctggaatatagcaaagtagttctcaaatccaatctttaaaatgtttcagtagtaccagaaagaatttagaaggaaaaaaatggaaattgcttttgaaaatgtaaaaccgctgtttaattcatgctgtaacaggtaataacattaatatattatagtgatatgtttggtaattgtatttgttttaaaattttaggtaaatgaaactattctaagacccttaaatgtagaaccgcctttaacagatttacagaaaagtgaagaactaatcaaaaaagaaatgatcacaatgcttcattatgaccttctacatcacccttatgaaccatctggaaataaaaaaggcaaaactgtagggtttggtaccaataattcagagcacattacctatctggaacataatccttatgaaaagttctccaaagaagagctgaaaaaggtatgattgagctggaatatttcttcttgagatttaggtagttgttaggtgctgtgtatcatggacaaataatgaacttatttttccctgttggtattcataaacaactgaaatgtatgattaggagatgcatgtttagattaagtgttatgaaaaggacatgctttaaatacctccatcccccgtgttcagtgtgatagacctttagcaaataaacaccgccagggtgtttttggttcatgggtattaatggcttcgttgacagttgttacagttgccgttttctgtattcagctctgctatctctgaataaaaattagatgcctttagtacttaaacatcacttatttagaataatatgaagaggtgagagagactaatataaaaatgtttatagattaaacctttta

SEQ ID NO: 38545 - DNA, 1026 bp, Homo sapiens
tacatgcattttattccttctgttttgacagagcaaacaactgtgattgtaaatagaaatctccataattgtataagaagatacagtgggtctcatcgttggaagcagagtggtcattagcttaaaagtctttttttctttagccttcagccctgaggagcagtgatagacctatggatttggaatgagctgctgtatacttaggataaaacaaacaagattcttacaaactctcctgtcttctctcctgcattcttcctctttcttcgcttttcacaatttcttactttgtgttttctttattgcataagtaatacattatttattataggatttttagaaaatagagaaaggaaggagggtttcgatttatatttcaataacttgtccctgatttcagaataactgagtcactcattttttagtaagtgcagtagggaaactaacatctgttgagttgcctactctgtcgagcacatttaatcattgaactgggattgagaatcaggctacgaaattgatacttgcacagtttcctcttttgaaagtgaaaatatgaggggaagaggaatttaggaaataaattttcctaaattgtatgtatggaaacctaaaacaaggatcacattgttgcttttggagattctgtagagggtaaaccctaacacaatttttgaaaaataataattctaagtattggtttgtaattgtttgaaacaaagtagcttaaatattctctcatattttatctgtgtatatctctctttgttccaaaaagaatttgaagcagctatttagttagcagattatttatggatagtttaaagataacttagccatattctctcgtaatgattataagatctgaacttgtaaatttttactctgtgcagtttcagagtgaaatagcatttctcttttaataaactgtcagattttctttttctttaatatactttaagatatgttaacattgatttgtttccattatttcccttaaggtattaagtgtccattttttcttct

SEQ ID NO: 38546 - DNA, 1017 bp, Homo sapiens
ttgtatattttggatattaaccccttatccaggccgggagtggtggctcacacctgtaatcccagcactttgtaaggtcttgttctttttttttttttttttttttttgagacagagcctccttctgtcgccaggctggagtgcagtggtgcgatctgtgctcactgcaacctctacctcctgggttcaagctattctgctgcctcagcctcccgagtagctgggactacaggcgcccgctaccatgcccggctaatttttatatttttagtagagacgggatttcactgtgttggccagaatggtattgatctcttgatctcatgatagacccacctcagcctcccaaagtgctgggattacaggcatgagccgccatgcctggcctactctatgccttttgattggggaatgtaatccatttacagagtaattattgataggtgaggacttaaccagtgccaattgttttctgtttatagatcctttgttctattcctcctctcttgcttgtgtgtgtgtgtatgttgtgtgtgtgtgtgtgtgtgtgtgtgtgtgtgtgtcttaatggctttctgtagtggtatgctttggattttatctttttatctcttgtctgtctgttacagacttttgctttgtggttaacttgaggcttacataaaacagcttatataacggtattttaagttgataacaacttaattttaattgcatacacaaactatacacttttacacccctttctcccatattttgtatttctgatgttatacttaaaatttttatataatatttattcccttaacaaattgttgcacttcagttgttaatagttttgccttttaacctttatactagagatataattgatttactcactgccattagagtattagaatgtttggatatgacaatgtatataccatgccctggcctggataaggggttaatatccaaaatatacaaaaaaagttttatactttaataaattttcatgttattaattagtgttct

SEQ ID NO: 38547 - DNA, 1056 bp, Homo sapiens
tatgttgctgggaacatagctagtccttccaaaccatcaaattcctatgaccaggtttggattgaatttatctcccaaatgtgcataatagctcctgtccagctaaagggcagtcagggcttcttgaagtgcatttgtgggtattgataagacagtagtggtttgtttatttgaagtagcagcaggatttcatatgaccaaatcaaagaatggctgtgatactggttttatagcaaaagtatttgatatgtttgtttctctttgagaaatatttaactcttaagaatcatgatttaactcagctggtttttaagataataaagtactgtagatttttttcagtatagttacatctaaaataattacttaattttttttctttaagtgtctaaaagaagacgttcagcgacaacaagaaagagaaaaggaacttcaacatagatatgctgatttgctgctggagaaagagactttaaagtcaaaattctgaagtacagtttatattctgtcacaggattaattaattgccggttttcatactctagaaggctgaaactgatgtttatcttcattgacaaatttacccaccatctgtggtttttcagttgtttattttaaatgatatcgatcttacacattctgtgtataaagaccttaactccacaggacggacattttagagtttaaattattaaggctatcattcttttagtaatgtcatatttgcaaacttttttagttttggcctttaatttaaaaagcctaattttaaagtgctgcctgtgagtaactcttgaataaaaacaaaatataaaaaattgagaatgtagccttttgtttgaagtaattagatacttaagagtgcctgcaaaccagcagctatgtactctgtgtcatatttaatgagtaactcttgggtaatcaaaatggtgatgcagtatcttaaacacttaagaggcagttctttgtggctttgttagtttcagcaaagagtggtcatttctgtatacactgacaagttagattaactttttagtacctcaaattttttttttg

SEQ ID NO: 38548 - DNA, 1040 bp, Homo sapiens
caaggaacaaaaatcataccaagggtgacttgagctctaaataaaagataaatgtttaccttgattagatgattttcatcttttaaatcaactgcccacaaaacaaggaaatctctgacatatatacatacgcaatttcgataatgtttgagatatttaaaaattatcatactgatgttagaaaatttaccaagttaacattattcccagaaatatatctaagattattttggcaaacagtttaaagactcttttatctctactattcctattgccaattctcttaattatacattagttacatcagattagtgacatttctaaaaaggtatatctaaatatcctatgtaaggcaaataattttcaccacaaagtcaaataaggtaattttattttacatttcagttacatcgattttttacatcaatgatgtctaccagaatcattatataccatcaactataaacatatatttacataatagactaagttaaaactcaagaacttaaatacacatttgtaggttcccctaaattacatgaaccataccattatttacatattccttatagtcatgtatcttacacctacatctattttgtgcttcaggaaaagcaaaaaaaaaaaaaaaaaaaagacaaagttaaatgctagccaaatcacaataacaatcatcaataaggtttgaatacatatatatgcagtctttctttagaaatatcagaataataacgtgatattccacagaacttcacatgaacacgatgtatttttacaccgaaacaaaatacgtgtcatatatgttcaacttaaatttcttctggctatgtttgtcttaacatttttatacatggcatatacacatgcatgagtgtgaatgcattcacaccaatgactacagaacttgtaataatgattataaaccaggaaaaaaattgtaaattatgtaactgaggtactatagttctgtcatgaaatataatcaaaatttttttgcatgtaagttaacaaatgtcaatctataaaaccagtaacaggga

SEQ ID NO: 38549 - DNA, 1068 bp, Homo sapiens
tacaatggaagaggcatcctgtccatctgaagtgaatcattttacctcactcacatgtcctattttcttagagaccaaagaagatagagagcaaaggcagggagatttattagggaaaagctgtttttgtcatcagtgaattgatttaaagaaagaacaaaaaatcagagatagctttaagcctagggtattagtgaaaatagttgttgatagctaaaaggaagtttaagagggatgtggtaataaaactcatttcaatagctattggatttcttcataagttactggagcatccatgtccatgtaggctttgcatgtttgttaatcaacttcatgtgactattggggcacatacagactgatgggggcttttttctcaatagcatttatttcttattcccccttttttatagcaatattttcaacaagaactggcaataaaccaatatggtagaatttccaccaattatttctgtgggttaaagaaactataaagtacaatttattaaactggaaaaataatcatcatctctggagcctctgaaagcttggcattaacgttatgttttacaaaagaatcattttagtgtctgcatctatttttattaagcctttcgaagaatttctaatgtggcaaatgagctgacagcctagaaggagtattgatgtggagtataaaaatggcccatatgaaggatagagtagggcatatatataaataggaaattggacaagacaattttttttccaattttagcttttagttatttttaaataaatggtattatttaagttaatataggtaaagctggcatataaatgttggttctctcctcctgtgggctaaaattctaaaacttaacccaaatgaaatagaattactacttatgagttgtgtttttacattttaggaaccctgattgctgtccttcaacgtgttcattatgaagttattagtaatacttttgttttctggacttataactggttttagaagtgactcttcctctagtttgccacctaagttactactagtatcctttgatggcttcagagctgattatctga

SEQ ID NO: 38550 - DNA, 1418 bp, Homo sapiens
gctttaattgaaaggatattgagcttatgacccttgcatataaaagacaacattataaactccattacatcttctgtatctcaaacattatgtcagtcattcatctgcatgtgaacatcacccacgaaattatagagttcagcttcatctagcatttgttatagtacataagaatatatagtgcagtattctaatgttacattagatctcaaataatcatggctgcagtcaagaggatagcacacaatatggtactttaaattatttcccattgaaaagcaaaaattaatgactaacagatattaaagttaaatttctgaatagaaagaacccaaggcttgtcattttaatttttattgttaatgtttgttttttttttttttttttttttttttttttttttttttgctagtgatccaggatgctcttgcgtagtgattcttaaatttgggactgtgtgagaatcaagtttctaaaccctcttcaacctactgaattagaatccatgggcacggggctaggaaatttctaatttttaaaatctccctagctgattctgatatattctaaaatttgagaacaaccagtcttgggaaaatattactcctatgattttagatttttgtttgtttctctgaatgttgtgggtttttccctgcatttgtgtttttgttagcaacctttcccctggatctcacaaaaactcgactccaaatgcaaggagaagcagctcttgctcggttgggagacggtgcaagagaatctgccccctataggggaatggtgcgcacagctctagggatcattgaagaggaaggctttctaaagctttggcaaggagtgacacccgccatttacagacacgtaggtatttatcttgattctagctggtaagtttgttatgagttctgtgtttgtctcctgtgcttttctgtttgtccaaaaacaagttagtttttttatcttactgatacaataactgaacacatacagcacatagtctttttttattattatttaggttttttttttgagatggagtcacactctgtcgcccaggctgtagtgcagtggcgccatctcagctcactgcaacctctgcctcccaggttcaagcgattctcctgactcagcctcctgagtagctgggactacaggtgcacgccaccacacccagctaatttttttttttttttttttagagagtctcgctctgttgcccaggctggagcacagtggtgtgaccctggctcactgcaacctttgtctcccgagttcaagcgattctcctgcctcagcctcctgagtagctaggattacaggcacatgctaccaaacctggctaatttttgtatttttagtagagatggggtttcaccatgttgatcagactagtctcaaactcttgaccttgtgaa

SEQ ID NO: 38551 - DNA, 1050 bp, Homo sapiens
ttcttagtctgtcattttttatgagattaattgttgttaatgtcattatttgatgaactctaaaaatttgcaggtcccttccatcaccagtaaaattaacccagaatctgataacctttggttttctcctataattaatacatgtactgataatataaaatatcaagaaaggtatttttatccatttaataatctgagaagaggatgatacagtgtataaagattttgattaaaaatatttaagtcaaatgttggccttttttctaaaggattattatgtttatctgtaaattagacttgcatagattgcttcatttctaataattctggataaattatatctggatgttatttactccagattataagagctataagtgaagcttatccagttgaatttcatacacaggaatacatggagttttcacatttaattattattctccttagatttcgtggtgtacatcatgcatttgcaaaaatcttagctgaaggaggaatacgagggctttgggcaggctgggtacccaatatacaaagagcagcactggtgaatatgggaggtaatgaaaactttgttaaattctaaaaagtcctaattgccttaatagctgtaagcacttatattagggaaattaaaatttatgttttatttttaatatattggtgaccatatattgttgactggctgtatagatgttctaggtcataactgaatattttccacagagcatttttgcttcattctatagtgatgtatgaaaaggataggatttactaaaataggcaaattgtgacaataaggacacaaggctaaactatttgtaaggcctcccctccagtccagaccttcctttaagattaaaactgatatatacagctatctgatcattattatatccagactgtccaaatctttcccctggcaatcctgctcctattcctaaataatcaatttttatacagtctcacaccccaggctggaaacctcaatgttctcttaactcatccctacccctcacttctcatattcacataccaattctgtct

SEQ ID NO: 38552 - DNA, 1303 bp, Homo sapiens
taacatagtctttgcactggaggagcttacaatgagatgtagaagttaaacatgtaagtagttaaaattacagaaataataaaaattactaaataaatactactgaatcacttggtatatggccaacactgtgctaatcattttcatgacttaactcgttgaatttccccaacaatctgtgcagcaggttactatcatatccctcttttatagagaaggaaacaaaaagcatcaaaagtctaaatagcttggccaggtgagtggttcagggcatcaaacccaggtggcctgacacccaataacacagccttattaaggaggttgtattcttgctttaccagtggtatgaacagtactctgtgggaacacagatagtggagtggaaatggctatgaccatatttgggaagtcgcaagaggcttcacagagctgatatttgatctgggctttgaggcatcaataggcgtttgtcaagagaaatataaaggtgcaacatgagcataggcatcatgtcatgtgtaggcctgttatctttgaagaactacagaaaattcagtctggttgaagaataggtcctcataggggaggtggtaggagataaggctagagaagtacttaaggaccaagttgggaagaaccttgtgggccaagcctagtagtttagatgaactctatggagcacttgcttaagcccgggaacaatgtgctaaggtttgtttgacagcaagattactttggaagtcgtatagtagatgcattgaaagctaggatgtaagaaaggaagttctagcaatgatctaaccagttagatgactgtagaaatggagaggagataaattttagggacatttatggttaactccataggacttagtaactgattatatgtagaaggtgagggacagaaaaaagcaaatgggacttcctgtgtttctaattctaatgcaggaaactaggaggatgagtgagaccattgcagaaacacaaactcagggtcaggagggatgaggggcaagtagaatatttaagtacaaaggatgggaccactttgtttaatcctttgtctttatacatatgactcaggaagtataaataaggaaaaaaagagtacttaatacgtgcaaagctctacatacattactttttaaaactgtataagaacctagcaaaacaagcagtattatcctcatttttcagataagaaaatcatggctcagagtataagaagcttgcccaagttcatgtagctagtatgtggcagagctgggaactgacctcagatctgttccactcaaaaccctac

SEQ ID NO: 38553 - DNA, 1061 bp, Homo sapiens
cctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagcactccactgcacatgctaatgacttcctctgacagccacacaccgaatcttgatgaaaaaagagaagagcatttgccttgttacatagtctgttacaagccagatatgttgctagctctcaagagttgtaatatattaagaactacaacttatttgattaaaactcagctgtatagatccttttataaagcaccttttgttaaacatcagcctttcattggtattttaaaagcaaggcagatagatatgaagtcagccaactctgacatgcgtcctttcttatctcccttacctgacactaggggctctagagaggcagagagagcactcacaaatcacactaaaactgccagcggcctgactcttactcagtttagcaaaaattcttgcctaaaaagtgataagtaaaaatctgtttatggtatacagttatgtctcgaatctttgaatcaaatccatgttc

SEQ ID NO: 38554 - DNA, 1008 bp, Homo sapiens
acagtccagcactggctaggcatcgagaacataaaaataaatgagaagtgttcctgcttttaagatgttcctactgtggcaaacagagagctacaaaatataataatatagaagtatgtaaaaaaaaaaaaaaaaaggaataaccaattctgccaggttgaatagtagggtcacgaggaaacgacgtttgagctaggtcttgctagatgtttttaaataaaatgtttttcttccataatgaatatgaaacaattagaaaaaaaatgggaaaattgagttttcaaggatgagttcttcaggaaaagaaaagctttggcttttagagaaattggattcattcattcattcattcatattcatttagcaaatattcattgccttcactccaagctagattccgagaatccaacaaacggtacttgccaaagggaacctgtcggctggtgggatgatagagatcagacagttgccacacaatgtgaaaagtgccgtgaaaaagtaagcatagggtgatgtggaagcacatggttgcctctaatctggacagactgaagacactgagatttacagttaggccagggtcatttgaagcactgccttgttgtatttgtatgtaatgacatttcgaaacgtggaatgaaaggaaaagtacaggcagactataagaagcttccacggatgtgtctaactttgcaaatgaacaaaaatctaatgtagacatatcctggaaacttctagtttgcctgcacttttccattccaaatggaggtttggacatttaacagaggcctcaaagggttatcctgttaagattttagtatatacagcaggggcttgaaggaatgttgattccattcctcttggcctccttttatgaatccagttctgtgctagctctgtgagtaaatgaaaatgccttcaaaattgggatgccagagttagacagcaaaggagcaaaggaacccgtatcagctaagtgtgggaagggaaatatgtaccagttgctat

SEQ ID NO: 38555 - DNA, 1085 bp, Homo sapiens
atttttgtatgttttttgtttttaagatttattattttaggacaagtgattaatcacatgtacgtggtaatttctttgtttttagaactgtctcaggtaatcagtctttgagataaaaatcttttttgttttttaaactttgattaagtttttttggtggatatctgtcacttattctaatttagtaacattaggaagaatataatactgtgtaaaaatttccttatatcaaatttccttctctttttctctttggatatgtgctaagagtgtattgtactatgcaaacctttgtatgctatttgaagtacaaagaggaagggtgggttttgtgtgcagtttgttcactatcttaagaatgactagatttacttatctctgttgaaaaacatgtaagaaatgctgcttatcattccatatttaacaagcttgagaaaataaatgacggaatttctaatatataattaaaaggactttaggatgatattgtgctttttattagtagtattttgactaatggatctggtacctaactttagaggacttaaataatgaaatgttattagttaatgacattaagcaatgctaatcagttttgcgtttctctatttatggtaaagaataaatatttcgttctgggaataatttatggtaaagcctttttgtttgtggtaagaaatacttagccctgggaataaaaagtaaatacatatatttctttcttcctgatatgtgtgtgtgtatgtgtgtgtgtgtgtgtgtgtgtgtgtgtgtgtaatatatataaaatcaggaaataagtggaaccattaaagtattttcatcatattcctactactttgagagtaaagcttgtaattttttatcttatactgaaatatatttttgttaatttttgtgtaatttttaatattttgtcatctgctataataaaggttaacactcaatagtatactgtgatcagtgatataatatagagaaggttaatttgacagactcagttagatgccattgtgatatttatctgtattgtgttgaccagaattaaaagtaaacattctgtagtcaatgcccatacaacttat

SEQ ID NO: 38556 - DNA, 1045 bp, Homo sapiens
ttatgcccatttcattgtccctttgcagtgtgtttgtcttccagttttaaaagtattttacaaaggatattgaacacaaggatctatgaacttaatgtacagaatattatcattttgccatcttgcttaagtgttactttttaataaagagaacattacagatgagattgagttctcatcacctccttctcatttctcttcctttgcaggaccacctgtgttcttaagttgtatgtatcctttagtccatagttttacacctatttgcctgtgcataaacaaatagtattttgtgtgatttagacacttacataattgtttcacattgcaccttttctttatatttaatgtgagatttcaacatggatacataatgtagttgcatctgttacaaatgggttttataacactagttagcttataggtaattagtagagagaaatgatgtcaggacaatgagaaagtgtgttagtttattttctaggtaagaagagctgtaataaagattgtaggattatgacttcagcaagaaaatggaagcagcttggagttcttttgaatctgaataccttttttttttttttttcttcttttaaagtaaccatctgtatctctaagggtatcttcctcaaagtttacagttctggcattgagggctcttaaatcctggtgctcactttcactgtctcagcatccataagccaaccaacattcccacttaattgttttttgttttacatttttaatagctactgaagaattcttcagtcatgactgcttgggcagtctaagttattgcctatctatgtaggttctagttattatttgttttcgtttatagtgttgaggtcccaaactgcataggtttttgcataaattgagtggtctgcaaactctattttttatatagtcactggtatttttagtgtttgattttgaagttttcacataataagtggtattttagtgtttttttttctcccagaatgcatggtgtttaagactgcacatacagtattataggagagacacctttactactact

SEQ ID NO: 38557 - DNA, 1031 bp, Homo sapiens
aatccaaaatgagcaagtactctttggcatgttgaggttgtaactactagtcttttatgtagattttgtttttattagtatgaaaaatacttagtgcagtctgaaaactgtgaggttgatgggtgttattaatagcaaatcaaagtaattttcttatgtgcattaccaataaaaacagggaaatatttgtgtatctttcatgttttgtacttagtaatttttcaaaattctctacccacttaactgtttttccaaaataaaagactcccccccgattgaaaaatattcattgttcttttaaaaaaagaaaagtttttttgaacagttacatgaagaggtcatgttcatcagaaatcctacgtgtggtaggcataaatgcctggagaagtctgtgaaggtgtgctcctacactcaatgaagaagtatacctgttgttgctgctcttggtctgtctcccttcccacctcccatggatcaactgaaagtataatgttgagacaggtatacaaagaactaggctgtaaatttcttatatccaagagaccaaagtgattccaataggagcaaagaggcattacaaggagatcaagaatttggtgaaagaaaggaaagggagaattatactgtggagagtaaaagggagtgtgaaaacaaggtacacttctctttcagtcctttcctgaaggaggtaagtttcatataaagtagattcttatttcctgtggacacagtgcaccataatgaatgaattgatatgctagcttgaagaggctgcccagtagaagaaaaagatagcatctggtatgtggtgatttggtatgggacatggaagtaactatgttgtcagctgtgccaggaagctgcttggagtacgttgagtgatacctgcagattagttgtttgtccccaaccagagaaagtactagatactgcttgtgccagtggccctgccctggatttcattatttttgaaagtgacaaggtttagttttctacccagagttacatgggagttcagagtcaagaaaatt

SEQ ID NO: 38558 - DNA, 1377 bp, Homo sapiens
ttgaaattagaattttagtgtctataaataaagttttattggaacatagttatattcattcatttaaatatctgactgcatttataccacacataggagtgttgatggttgcaacagaaagtgtatggtctgcaaattgtaaaatatttactatctggcactttatagaaagtttgtttacccctgactttgaattattgtttgtctttgtatctcagtgtttctttgtagttggggtgagtggtcggggtggggtttgagcctctctttcctttatcttcatctccagttctgataaaacttaaactcatgagtcactgttaccaaaatgtgttttattcttcagatatgtttgagcagagcaaaggttggaaactattgatattatgatttatatagtaattactgtagctattttttggtattttacatttgaggatttaatataaaaaatataacttaacttgcctctttatttattttcccttttgtaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagagtatgtaaataattcctttcctgcataattacatcaaaatagaaggatattttataactgtgtctaaattaagaaaaattagttcagtcttttgtagacaactacagtaacttcctgcaaagtctcatgttactagttattgccctgtgtagtcaatcttaatttttagtcatgtgcaatcaataacaaatcaatatcattataaattaaagcatgaggctctgttttcttatttatctttcagactctgctgaatgattaccattttaccttaactatattttaataccatttatttagtgggattctgaaatatctgctgattcttagcatagatacaagaattttgatagtgctttttcttcagttgttaaacatctgaacataaacatttccaaggtggttggccttgcaaattaccttgtaaggatttggtactgtgtaaatatgttaggggaacaacttggcaaagaaggagagcattacatttgaaatcagataagggtttgagtctgtcttatgacctcagaaagatcatttaaactgttgagttttatttgctgctagtgagaaagtggttaagaaaaaaagcaaaacaaaacaaaaaacaccaggtaatattgctgttctcaaagagcttacattcttggaaaagaaattgttatttaaggccaagtgcagtggctcactcctgtaatcccagcactttgggaggcctaggtaggtgga

SEQ ID NO: 38559 - DNA, 1038 bp, Homo sapiens
tgagactacaggcacccaccaccacgcccggctaatttttttgtatttttagtagagatggggtttcaccatgttagccaggatggtcttgatctcctgacctcatgatccgcctgcctcggcctcccaaagtgctgggattacaggcatgagcctccacgtccagtctgtttgctttctttggcttcttttattataaaaactacaataaaaaatcagatacaaattattaattgctttaggaaggggaaaaaaccttacacagatgtaactttcttatttggagactcaattattttatctacttgatggttatctctgttttgtacctttccatgctattggttgcatgtagtgtgcttcttttgttgttttgggggtgaagttagattactttttgtcttgataaacaatttcgtagattcacagaatgtcagagctgaggtaactgtagtggttttctagttccgcattgtaattttatggcccaggaaattgattcctagagaatttcagtgaaataactaggtaatgacaactgtacaagaacataagtcttctgacttccagtacagctgatatttctattgtagcatgacatctttctttacaaagagtttatttggagatcatgatttgatgcagtgaaattcttcctgtccagattacttcttaggattctcctttgttgtcctctctccttagagtccttgtatcaccaaatcctactttgttagtaaaactgttttccttgctctagaatatctgccacatctgtcccaccttcttgtatcttactcatatttcattgtgtaactcttatttcttctttgaagccttccatatctgctccagttcaaacctgtcctttctaatttttgaaatatttgtagtttatattaaatattttactctcattatgtattcaagttttatcactaatttttttctagtatgcatgttttcttctcaagttctgttaagtgtgcatttaaattattaagaaaaatcttgttaggattgttggtgataggctac

SEQ ID NO: 38560 - DNA, 1065 bp, Homo sapiens
ctccagaacgactgcaggaatatgttaggaaagccgagagaacccacagaccctctgaaggaagcaaactgctccagtaggacctgggagacaccccaaatgctcagtcacagcaagatccacccaaggagagtctgagatcagaaatgcctagccccgcccgcacctaatggtcctttcctacccaccctagtaactgatgacaaagggcatatactcttgggagctctaaggcccagcctatcacctgttcctccccatactacatagctgatgctctcttgaaagtgccatctcccagcaggagaccaaccagcacaaaaatagtgcattaaacagccagagctaaggaccttcacagagttcatttcaataccccgcccgctggtcccaaccaccacttccaccagagcaggtgctggtatccacggctaagagacccacggatggttcacatcacgggactctgtgcagacaacccccagtaccagcccggagcctggtagacttgctctgtggcagaagagagataatctctacagttcaactctcaggaagccacatccctaggaaaagagggagagtactacgtaaaggagcaccccatgggacaaaaagaaactgaacagccttgagccctacacttccctctgacagagcctacccaaatgagaaggaatcagaaaaccaactctggtaatatgacaaaacaaggttctttaccattccccaaaaatcacactagctcaccagcaaggtatccaaaccaagaagaaatccctgatttacctgaaaaagaattcagaaggtaagttatttagctaatcagggaggcatcagagaaagatgaagcccagtttaaggaaatcaaaaaaatgatacaagaagtgaagggagaaatattcaatgaaatagataccataaataaaaaataatcaaaacttcaggaaacaatggatgcacttacagaaatgcaaaatgctgtgggaagtttcagcaatagaattgaacaagcagaagaaataacttcagagcttaaagacaaggtttttgaattaacccaat

SEQ ID NO: 38561 - DNA, 1057 bp, Homo sapiens
ttattggaggtacaatttacatacagtaattgtgtccctttaaaatatacaatctgatgagtttgacagatgtataaatccatgaaaacatgtacagaacatttccatcacccccaaaatattgctcatgctttttgcagtccatttctttttctgcccttagtcctaggcaatcatagatctggtttgtcattatggattagtttgcagtattatgtcattttgacatgtctccattattttctgtgaacttccttactctgtgatataagatattccaagctcattttgaaccttccctaccctagtcttggaatcagctacctatcaaggcaaactttttttttttttaagagaggaatagtgtttgggcatcaagatctgggtagaggtgtggtcattgctactggggtaatgcttctgagcctgcttagtggattaagctgggaaatgcttacatgcacatacaatcccatacctctacccatatgtcttgatcattcatctatttatccatctttactagtacctctaattccaatttaataccagaaggtatattttcatctctaatgattttatttctaagcccattgaccatagaaatgtgtgaaatgagtaattgagtttgctttacatttatttatttatttatgtatttattgagacggagtctcgctctgtcacacaggctggagtgcagtggcgcgatcttggctcactgcaacctccgcctcccgggttcacgtcattctcctgcgtcaacctcccaagtaggcgcccaccaccacacccagctaatttttttgtatttttagtagttacagggtttcaccgtgttagccaagatggtctcaatgacctcgtgatccgcccacctcggcctcttaaagtactgggattacaggcgtgagccactgcacccggctgagtttgctttacttttaaggaaatttaatttttcttccaagttttagttatctaaacatcgcaagctacaattgtgttgccttgttcgtttgctttttagtataaaagccatctaatattaggcttg

SEQ ID NO: 38562 - DNA, 1050 bp, Homo sapiens
tttaaaatggctacaaatccctctatgatctggcatccccatatccctccctccacctttcttacctcatctcttatttaactttcccctttgttcacattggtcaccttaggtttcttaaggatgttaggaacattcctctctcacagcctttgtgcttgttgtatacctttgtctggaatcctcttcttcaagatgtcctgatggctacttgtctgattcaggattctctcagaaatcaccttatcagtgaggcccttactgacagctctgtgtaaaacagcagaaagtccccattatccactttttaattctcttctcttttttttttaacgtttcaaagaagaatttgttgctattgcttattaagcttattgtctgtctacctgctcattagaatatatatatatatatatatatacacatacacatatatatatatgtatgtatgtatttgtttactcattgtctagaatggtctctgatatgttgatgctcagtgaaacagtgaatagttttttgtggtatatgtagaacttttcaaacacttttgtcaagtgaaatcctcttgagtttttgttgttgttgttgttttggtttttgctttaagttctgggatacatatgcagaacatgcaggtttgttacataggtataagtgtgccatggtggttcctgcacctatcgacccatcctctcaattctcccttcccccgctcctcacccctcaacaggtcctggtgtgtgtttccctacctgtgtccatgtattctcattgttcaactcccactaatgagtgagaacatgcagtgtttggttttctgttcctgtgttagtttgctgaggatgatggcttccagcgtcatccatgtccctgcagaggatatgatctcattcctttttatggctgcatagtattccatagtgtatatgtaccacattttctttatccagtctatcattgatgggcatttaggttggttccatgactgcgatattgtaaatagtgctgtaaatattgtaaacatatgcatgcatgtgtctttatagt

SEQ ID NO: 38563 - DNA, 1026 bp, Homo sapiens
gagaaatatttgttacaggaaagggtgcaataaatgtatataagtgggctaatccagacttggcaagctgtgaaggaatgtgccctagaagaagtcatagattgagatcccaaaatggctaggaaatttctaagcaagtttgtggcagagggtgaggaaaagcatagcactgcaagatcctgaaagagatttaattcagaggcattatagagtatataattagatgtgaatgttgagcctggagaaattattgggtcagacataagaaaacattacaaaagtgttaatcaaatcacagagaagccatagagcaaaatcatgagattgtttttcagataaattggtggcagtatggagagtgaattgcaatgtggggagtagattggagaagagactgagctgctgacgccagttgagaatgttttgataatgaggtagaattagcctaaactagaggagtgctatggggatggagagacacgtgtagaataggatctatataagtgatagcacaaagaacaggacctagtgataatgttatttgggggatgaccgaaaaagaggagccaactgctaccaggtttttggctttgtaagatggagatgtcatttgcagagataggatattgggagatgatgatgtatcgttaaaatagatgcctagatattgaaaataggcagtactaattggtaggttaattatttttggatcattgaaaattaccaacttttactaccatgttggctattcacttttggagatattaaatttgaggcttgtagggatgtgagagcatccaaatgaagatatttggtagtcagttgtctatgggtctgaatccttagaaaaattcggatgtctgtgcaaaactggggcttgatagtactttaggtggtataagaaacgatgagtaggctgggcgcggtggcttatgcctgtaatcccagccctttgggaggctgaggtgggtggatcacaaggtcaggagttcgagaccagcctggcccacaagttgaaaccccgtc

SEQ ID NO: 38564 - DNA, 1017 bp, Homo sapiens
tagacctaaaatggactgtttttaaaatggatttagaaaatattaaattacttgatattttggcactacttaaatttcctctagattgtcaacattcattaaatttactaaacttctttgaatgtgtggagtattttatttcattagcattttgctggcattgtgaaatgaaaccaagtaagtgagccataaattataagaactaaaaagaggctttaaaataaaaccttaagctgttaatttggtggtaaaatagctacagtctgtagaacattttttcacagttccttctatcagtcctatctctttaactctgaagaaattatagtatttcagtatttatttgattcgtgtagctacatctcatttaaagactgtgttttggttattgagatactattaagtttcctcctaagataggtggtttcaactttttttattcctttcctaacttgctacgtattttcttatgtagcagtgaagagttgggttcaggaaagagaacttccactttctatcctacatattcctagctctgagactatctggcattaggattgtggggtcaaattgattcttggttttaaaggtaaagtttggaattctcatggtttttggggtggtgctctatagccatgtaacagctaggaatgttggacaagcaattcttggcattgtgatagaaattagactagatgatcttgtgccccttctaactctaaagcttaggattatattgaataactttagttgattaatgattatattatcttttaatcatccttgataatgtctactactcaagagttgttattagtgactgtagtctcagggttaccctatataatggtctggtcaggcttgctttgatcactgatccaggaattgataaaatagggagcacatttgctgtgtttgtaggtgcaccacaatatggtgtttagagttggggaaaactaaagtaagtattttagaagataacagaagacacagtagtaggtaggtaagttagcagtg

SEQ ID NO: 38565 - DNA, 1951 bp, Homo sapiens
tttttctgaaacttccttctagtggtatttagctagataatggtggtgtggatagtggaaggtggtatgggtaaaaggaagctgaagtgtttcaagagcaaagaacagaaaatccttattgaaactgacttaaacaatagggaaaacatctcacataattgaaagtctagaagtaggagtcatatgacctgccactcagtgattctgttatggacctgaattatatctttccattctgccatcctcagtgtacactttatcttcagactgtctcctcttgtgatcacaagaatgctgagagtggcaatcagggcgacatgatttcttgtccatttgacagaaaagagaggaaaacctctccccaaccatagaatgtaagtcctttcagtttcttggaccacttttgagcacatttacctctagaccaatgaaacttataagaagaatactatttactgattgtctcagtgtaatcatatgaaagtaggattgatttgggaggactcaactgcattgtctgctgaagactttgagatatatttaggatctatcataaggaatgcaatttaggttctactttgacatcttgttgactaatgagatactaatgattatgacgatggggaaatgagataggaagtatggaatagagacagtttctggaggaaaccatgtgaattcagcttttgacatgggatttgatacgaaatattggctgaacttttactaagagtttgtattaagtgtttagttggaaggtgctattctggaagttaggtattaaatttacaggtatgggtaagattgtccaagaagattgcttagcgtaagaatgcgaagagagctttctcaggatatatacatttaagaagttgtttgatgaccaggaactcttgaatatacacacacacacacaaatgtatatacacacacatatatatacacaaatatacacacatacacacacacaaatatatatacatatatacacacacatatacacatatgtatgtgcacatatatatacacatacgtatgtacacacatatatacacatatgtacacatatatatacacacacacacacatatatatatatatatttgtcagagtcatctgctagaagtaggagagctacaaataaaatgaagaatcataagatcaagatagaggggaagaggagagcccagtaaagtctggcattggggctcatatttcctgttggagcatttgccaatcttgaaagtggtagcttagcctatgaaaagaactttcgatagacttttgggctcaaggagacaaaaattagagttcaaagctcatgaaagaggaggtatcctagtgaactaggttttgatttagttcctaaagggatttactgttggaggaagtatgaaatggaaatagacctaactctgaggaacactgaagttcaacttctaataatctcaattcttgatgggaggaaggtgacctgggatttttactatccctaccttagcttactgaaagaatgaaagtaaaccttcattgtctagagaagaagacatcatctagagttttaaattatctctatgttttcctgtaaatcttttgtgtcttgtactcattcagagataattaggcatactgatagatatgacacatggctagaaaccaagaacaacagacaatggaacctggcctttaggggatctagatattagagatactagatataagctttaaagtaactgtgcttaataaatgttagaagtaataaaagatggggttgataattttgacagaactagaaccttgtaagtatatatgaatatgagtcagtctaagcttaaatgaatttgtttacatatataagtatatataaatatatacacacaaatgttaatatatgtgtgtatatttttaaaagaaaatatctgaactgaaacataaggagacaaaaaagata

SEQ ID NO: 38566 - DNA, 1109 bp, Homo sapiens
agagcttattcatgtaaccaaatgccacctgtttctcaaaaacctgttgaaataaaaaataatctaaaataataaaaaaaatttaaaaaaaaatacaggagcattctgtacattttgatttagctctcactgttgcttaccttccagagttgtccttctattgttgcaatttaatttttaagtattatttttaatattttctgtatactaatatctgttgaatgttaattttatgttataataattttctacacttaactaaactgttctcacattttttattttattgtgatcagccttaggagagagttttgcgtttatggaaatggttttacagaacagaaagtaatcggtattaggccatacaatctttaatgtcattaaatcacaatttaaaaaaaagtcgtgtttcatactagtgatttttgcgtgtttttttcttatttcaggattaatggggaagtttctagcatttcatcaaaatttgaaactgagccagtatcaaaactaaagctagattctgaacagctgccccttagaccaaaatcagtagactttgattcacttacagtaaggacctccaaagaaacaggtaagtcagcatggacagcggtggtgcatttaaaaaaaaaaattgtcaaagaaactctttaagagatatatttatgcaatttgtgtgtggataaagttggataaagttgaaattacacagttgaaatttgtttaaaatttagcagccaaagtagaaataataaaagaagataagtaaaatttttatggtccttactgatcagactttatggtttcttactgatcagaggactgaaatagatgttaaaagatgacccatctattactccctctttatagtggaatgactgtactacccaacggagatatgaatacactttagttttaaaagtttaaaaatgagatgacatagactttcagtgccagcattagattatatttcataggactttaaatttctcctcttaatctagagatacttttatttccagtggaggaaaatatgctttttctaacccttttgctaatttttttttaagctttaggactggtttttcagcttactgatatctttgtct

SEQ ID NO: 38567 - DNA, 1068 bp, Homo sapiens
tgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtag

SEQ ID NO: 38568 - DNA, 1050 bp, Homo sapiens
aaaatgttcatcatcactggccatcagagaaacgcaaatcaaaaccacaatgagataccatctcacaccagttagaatggcgatcattaaaaagtcaggaaacaacaggtgctggagaggacatgcagaaataggaacacttttacactgttggtgggactgtaaactagttcaaccattgtggaagacagtgtggcgattcctcaaggatctagaactagaaataccatttgatctagccatcccattactgggtatatactcaaaggattataagtcatgctactataaagacacatgaacatgtgtgtttactgcggcactattcacaatagcaaagacttggaaccaacccaaatgtccatcaatgatagactggattaagaaaatgtggcacatatacaccatggaatactatgcagccataagaaaggatgagttcatgtcctttgtagggacatggatgaagctggaaaccatcattctcagcaaactatcacaaggatgaaaaaccaaacaccgcatattctcactcataggtgtgaattgaacaatgagaacacctgggcacaggaaggggatcatcacacaccggggcctgtcatggggtggggggagggggagggatagaattaggagatatacctaatgctaaatgagttaatgggtacagcacaccacatggcacatgtatacatatgtaacaaacctgcacagttgtgcacatgtaccctagaacttaaagtataataaaaaaaaaaaaaagaaaatgttctgtttctcagtttcaagtttgcctagaaatatttgtgacctattttaaggaattcttttgagtacaaattctatttagtttttctttaaatataattttcaacccacaatagccaagtagaaagagtgaatcagatgggttgggtcagggtgggagtttgctgagaaaggtttaacaaattaaaaactgctagaagcaggcttgtaaattgcttaaaggtatagcagcctattattaaagaaggaagaagatattaaaaagataataagctaata

SEQ ID NO: 38569 - DNA, 1040 bp, Homo sapiens
gtaaattagttcaaccattgtggaaagcagtttggcagattctcaacttaaaacagaactaccatccaacccagcaatcccattagtgggtatatacctgaaggaatataaattgttataaagacacatgcacacttatgtttaccacagaactattcacaattgcaaagacatagaatcaacctaaaggcctatcagtggtagattagataaagaaaatgtagtacatataaaacttggaatgctatgcagccataaaagaatgagatcatgtcctttgcagcaacacggttggagctagaggtcattatcctaagcaaactaacacaggaacagaaaaccacatagtgcattttctcacaagtgggagctaaacattgaatatatatggacacaaagaagggaacaaagataccagggcctacttgcgggaggagagtgagggttgagaaactacctatcaggtactatgcttattacctgggtgaaaaaataatctgtacaccaaagccccacaacatttgcctacataacctgcatatgtattcctgaatctaaaataaaagatttttttttaattaagatttttaaccagatcccaaaagtgggatagtgggttccactattgttcagatttcttcaaatcttaagtagtagaactttttagaacccaaagatactgctgttataaagggaatcaaatttagcttttcctcctcataaaattcaagaatcaaatctgggaaagctattttgcagtctgccagatgtgatgatagaaatagatgtttctactggtgatcaactcaaatttgtaaaagaattttttaactttaatattaaatgccattcatgtttatagaatttttgagcaatgcactttgatcttagtgttttatttgccttaaactctatagaactcagttttctttgaaatcatttagaataactaatgtaaatcttctctatttttgatcacattctctaaaataattgagatttggggtccagggtcatagttaagacttctagactagtgt

SEQ ID NO: 38570 - DNA, 1034 bp, Homo sapiens
tgcagctaccctttcttaaaaaaaaaaaaaagtcatttagaagccaaaatatatttcttgaggaagactactctcccagcaatagttctgcatccagtatttggaaaagacatagatatagcatcaactttattgctgaacaagatttaagagttattacttatgtatattttctgtgtggcttatttacttgttccccaaagcatacaggcaatgttatcattgactgttgctaggaccatatttgaaagcagtgccatgtttaataccctttagaaacctggaggcttgctaattttaattttatacttggcctgcacacaacacatccttgatgtgttgtccccatacttgttttattcatttcttattttcttttcatcttcctctctaaattatgtattcctttaatgtgggaaactgttactctttttttttattctccctgctctaatgcccaacattacttccttttgacaaattaaaatagcaggctcttaaatgttcctaaataaatgaaaacaattcagaatttctccactacatgaagttttatgctgcttaaggaaggttgctgtatttgttgtcatcagttctgggctctgctagatttacacttggatcttccaggatctctgaccctaccagcattggtacgttttgaggaagtgttcatgtacatctccttattccagggaaattagatatccttataacacattaataccttgacataccagctttccaagaagtctcttttttgaaagaaacaaaagtaaattcaccagttgcttctaaaaatgttttaaatatatatggtgtttttttaaaatgtgtatgtataacaatatctattaggatttaatataataatgtgtttaagttaaaatgttttttttctctttctgactcaggaagaaatagataaaatggtagagaccacagagttaatgactgggaatattcagagcctaaagaacaaaattcagattctggcaagtgaggtggaagaagaagaggagagagtaaaacag

SEQ ID NO: 38571 - DNA, 1033 bp, Homo sapiens
taaaatgttaacaactacatttaatactatctttcccacagaaagaaattttggcgctaattccaaaccagaatgctcttctaaaggacttggatattcttcataattcatcacagatgaagagcatgtcaaccttcattgaagaagcctataagaaactggatgcatcttaaagagtgttttttttttagattgttccatattaatttaatgttcgtgaatttgtaaaactgttaacctatgattatatgtacagaggctaaggcttctgcaggatttattatctcctgatatgcactttaaaattagtctttgtagttctatcattagcatctaatgtagttctgaagactgtttttagcagttgccaaatctaggaaactaacatttatattgctgtatctataagtatttgcctaaaaccataaaataggaattgccttaaggatctagtagtttataatgcctgaatggaactcatttattggttaacagctcatatcaggagctgtgataagtaagtgtttacatacactgtctagtgcataaaaaccttagtgtttgctatcattcattctgtagccaatggcttacagtttctgtctggtcatctggaacttgaaaaatcctcaaatgccttcactcttttacctaactccctagtctttttgggaagtagttaagatatgcctgctatctttaactttggaggtagtatcaaaattttacttctttggttgtttagtgaattaatgttgaatattttctactgtcatcaaaacatattcccaaaaagtattaaaaaggaaccttagcacatttattttattaaaacaagaaaacccaaaatatataaaccttttcttattatgataataagcttatatatgtgaataagttataacctagtgtataaaaaattatttctaacaaactacagtatactgtcttgggtttttttttttttttttagtctgtaaaataaaatgactgcaattacttttttatgtgacctataatatcagttaatttg

SEQ ID NO: 38572 - DNA, 1050 bp, Homo sapiens
ctgctttctttttttagcctgttgctcaggctggagtgcaatggcacgatctgagctcactgcaaccacctgcctcccgggttcaagctattctcctgcctcagcctcctgagtagctgggattacaggcgcctgcaaccacacccagctaatttttgtacttttagtagagatggggttttgccatgttggccaggctggtctcgaactcttgacctcaggtgatctgcctgcctcagcctcccaaagtgctgggattacaggcttgagccaccgagcctggcctctactttttattactgtcatgtagttagtgataaaatgcttctatctgaaaaaaaatttgttgttctaaattctaaaaaattctcgtgattattgcttaaattttaataaagcagatgtgattttcaaattaccacatttttatttttctttattttttctgtgtggaaggtcattgaaaagcctctatgttgtcctcctaatatctctgtctctccatcaccgtctctctctctctctctctctctctctgtctgtctcacacataaactcaactaaatgcattcattgtgagagtaattttttttttttttgagacagagtctttctctgtcgcccaggctagagttaagtggcacgatatcagctcactgcaacctctgcctcctgggttcaagcgattctcgtgcctcagcctaccaggtagctgagattacgggtgcgtgcagccaaacctggctaattcttgtatttttagtagagacggagtttttactatgttggccaggctggtctcaaactcctgacctcaggtgatccccctgccttggcctcccaaagtgctgggatcacaggcatgagccaccgcgcctggccaggttcagaatctttagagctcgctttgagtgtaccttgtgtcttcaatccttatatataaatacctgcacttcaagaacagatttaacacaaacaataccacagcaattgtggtgtctgaggaagagaacttgagttacttctatcctgccattatatatgacttat

SEQ ID NO: 38573 - DNA, 1090 bp, Homo sapiens
ttccccatgctgttctcatgatagtgagtgagttctctcgagatctgatggttttttaaggggcttctcccattgcttggcactcattctctctcctgagagaaagatttttcttttctcaatgtcttggagggtataggcttccaaaccatctgggtggcaaataaactgttcatattttcctatgtgaggaatattcaataccatatcagagcaatattttttgaatgagcaaataataattatgataaatgttaatatacaatggaggtaataggtgacttcaaaatttcaagacaagtacacctagggaagacccaaggctggttcacctctctttccagggtgacctggttcctgactttaatcaaccctcagttcctagggctgtaagaatttgagaaagaccagagctagggttattgatttaagagctttttgttgattttgagacacagctaacagtagaggtggtgacatttatccttttcaggtccaagattaaaaggagcaaagaagaagaaaaaaatctctattctcaaagaatagagaattgagtactttccaacaatattgtgaaactctgtatttgccctgtccttaacacctgctcttttgactccaagagaataccaaaaggttcaaaataaatccgtagtcaggaaactggaggtgagctacaaaaccaggcgaagatggacataaaatatacatactctgctgaataatgtctatggatcataattttgggagaaatgactgttggtgaaaactataaagagaatttggtaaatctgtataaaatatggaagagcagatagtatatagtcagtgatggagtttaatggctctcaaattagaaaatttatattttccatggtgaattcattccagaaatcccatcttagcttttttattcctgcacttaagcaagataaagtcattactattattcccttgagttgtcagagaccctgagtactttagaaagtggaattagtttcatgggctaatactcaattgcctgcagtgctaaaatgttacccagataggttcaagaatgtcactgaaaccaggtggcatttcaaga

SEQ ID NO: 38574 - DNA, 1060 bp, Homo sapiens
gaagtctcaactgaatattggatatggggtgaggaaaagcaggaagaaaaacccatataggttagacaaaatattagattagccaagtatttttaaagtattttctaaaaattagataagatttagagcttacccccaccccattaattgtatacttttgtctagtgatgcgtatgtaaaaatcatacttaagctgaaatcacttctggcttactgttgttctttattttctgcatctttttggatgtcatataaaaagaggccccccaaatcatcatttgcttgttatttgggaatgcgaaagtaattgaattctctggagggatgagtggtggttgaggctgaaatagcaagttgggaatgaatgcaacttttcagtagatactataatcctttgtcaaagggagtgctggggtgatggaaatgaaactgcaagtgctgaccttgaatttctggtaacattgagtgcttgtctcttcccagcccatgtgatctatggacttgcccaaatagcttcttgctggtactgtatcctctgttttctaaaggcaccttagggacttcaaaaggcacacttttgctttaaaatgcatcgtattttaatgttaactcgatggtaaacttatataatattggctgttagacactgaataagcttaaaatggaaaagtgacactttctcgacctgcattcatcttactccttgtaattgcattcattttttttcaactttaattcagaaatcttaagtagttggcctttattattattttcagtttacggcattattggtaccagaaggattgtggtttattttaagtatatgattcatttaatctgatgggactcaggcttggactgtctgctttccagcccactttgcctccaagatcaatgcaacctcaaagaaggaaagttttaagttttttaatggtgtttatgattgatgtaccttgttgatattaataactgtatctgctacattatagctttgattaatcacagtcttcaagtaaactgacttgctgacatattccactttagagaaaaaaatatcaaa

SEQ ID NO: 38575 - DNA, 1025 bp, Homo sapiens
tttcatgtttgatattacataaccaatgggtggtataacatttttgtttgtttctcatttatctttatgtttttgcaatgtgagtttcctcatttccatctattgacattaccacatcattcttgtttttccttgtcaatgagcctcctcttttcactaaagtgaagtagccctagccctgaccatgtagcagaatcactggcgagatttttaagaaagttacgttattccaaccctcatcagttctaatttccagatgagctttatgtgtaactggttctgagaagtactgatcagttttgataagttagctttcttaatttactcttagtctgtttcttttcttgtcttaatttttattttattattcctgttaaatgtctataacattttcatccagccagccaacttttattgagtacctgttgtaagctagaggctggggaggagctatgccatttacatgatagtcacttatttttaaacaatttcagtctctcaactagaatctgtatcatttcctcttccccacttaactcatttatagggacacattcacatatgcattcataggccgaacctaaacatccactaaacagtatgatttatataattggatgtatcttttccttttgcttgtttcttttgtttatttgtggctttgacagacattgcaaaatcagcagagaagggagagggctgaaaatacaagagagaagtgggataggcactaaataattaccaagatatgaatcctggtatgtttaatttttactgaaaagaatagtaagtaactgttataaagtagaaggtgataaagtgatatatgtcgtaagaaagtattagtaaaattcagaggagaaattgcgcttgagtaggaaataggcttcctattttttgttttctatgttattttacactaattgttgttacttaatttgtacttatttaatattcataattcatttctttaaggatagtgcacataaaaatattatttttattttccaattcattttacttgg

SEQ ID NO: 38576 - DNA, 1048 bp, Homo sapiens
ctaaaatatgtaactaattcatttacttattttcatcctcactattaccataaatttattttccacagagcagccaggcttattttttgaaaatcagattatgtcacatactgactgaaacacttccatggcttccctatcatctataaagatccaactctacaggttcctcacagccctactggagctggccctccctgctctctccccagcctcatcttgggtcctttttctcacctatcatgtttcaatacattggatttatttttactgatttccttgaaatggcagcatttgaaaattccaattcagggcctttttgtacatggcatttctcctatctgaaatagcttccccaccatccttaagtggctgactccatctttcctttcagtgaggcttttcctggccactctgctatggcagttcctcctcatttttctatatcacttccctctcttttttttttttcccctttgcagcactatattataatttgtgttgctgatttgtttagtgtttatctgtcccacctgagtgtatacttcatgaaggtaaggacttatatagtttattatatatttagtgctcaataaatatcagttctaaaatgacatgaataattaacaaaatttatttcttgtctgtgtcactgctgaaaattggcaagtcaaacacgtaccatatatgcttataataatgtaaaattaaaaatgtgacttggctttttataattgtgtgtgatatgaaaatatttatgcagcatttccccccttcatcttgaagtaaatacaaatatttttatgtttattgtggcattctgagcacttcctgggagttagaagacctggattctaattctgggtctcctaccagctaacattgtgaccttgtagtcacaatctctaatttcctcgtctataaactcagaaggttagaatacatgataatcaggagcccagcctgctataaaattccatgaaaagtatatttttaaacacagtatttaaatataatttttcttttctttctacgtaacaatcaagtt

SEQ ID NO: 38577 - DNA, 1051 bp, Homo sapiens
tgatggatggaaggacacatactactgaactaggaaggtaaataaccaaaacagagcatactacataatatacagaaaaaaatttgagattggacatggtggagaaggggatgtgcaagcacatatggagggcaaatctcacaagtaagatgggacaggtgaatgcttctaaaccaatcaaaaatacctttgtttccccaaaagacaccaatgctcagtcaaaaatagcagctgctgaattagcatgggcataccaggcaaataagcctgcattgtcatagcgttcccttgattgctctatgaaactgagtaaagtttcatttcctgattcaagaattgcagctaaaatatcctctggacaaagaagaagggaaattttttgataacagatgtgttggctccttacagtataaagccaatttctgtcatatctcaccaacaatcctggtttctacagtacatcaattttaagtaatatgccaaatcatggcagcaaaaatatgttccctctagctgttaggtactttgacttgaaaacaggagtttcaaatcatcttcttcatttctgtgaggattttaatgaaactgctgaaatcataaaatattgttgatattttgtctaaatacaaactagacttagctcatctatctgtgtattcgtcagacagtatagatgtaaaattttggcaaattgcattcagtctacaaacttcttaccaaagaaaatgaaaagatcttatccattcaatgccttgtacatcttatatacaacactgctaaaaagggatgtgagttgcttaaatgtgacattgagactttcataatgaaagcttttggttacttttcaatttcctcaaaaagtgcaaaagcacttatggagatttttgacttcacagaaatggaaggtaacctctttagacgtgtgcctgcaagatggctgtcattgtaagtgagccatagaaacgatgctaaaatgttggcctgccataagatcatattttcaaaggacaagaataatgtcctttgacattgtttgaaatctgaaaggaga

SEQ ID NO: 38578 - DNA, 1329 bp, Homo sapiens
agagaaggactgaactgggggagtgagggaagaatgcgagagtgagactcagagagtaaaggggagggaaaaaaaagaagagagaaagggcgaggaagggggcgaccgcaggagggagacagacctggagtccactcggaggcctggagccgcacaaagcgccaggtcagcggtcccggctgggtgagaccagcaggcggctctagcgcgcgggagctgggcgaggctccgggacgacctcaccaatggagactgcagtatttagcatgccccacccatctgcaaggcattctggatagtgtcaaaacagccggaaatcaagtccgtttatctcaaactttagcattttgggaataaatgatatttgctatgctggttaaattagattttagttaaatttcctgctgaagctctagtacgataagcaacttgacctaagtgtaaagttgagacttccttcaggtttatatagcttgtgcgccgcttgggtacctcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccaaatgaggcgctgcatgtggcagtctgcctttcttttgacccattacccatctaagttagatgcttttttaaatgttttttaatttttaaatttttaatttttttcattatttattttttatttttgagacggatctcggctcactgtaacctccacctcccgggttcaagcgattctcctgactcagcctcccgagtagctgggattacaggcgcgcgccaccatgcccggctaatttttctatttttagtaaagacggggtttcgccatgttgaccagggtggtcttgaactcctgacgtcaggtgatcctcctgcctcgtgctgggattgcaggcgtgagccaccgctcccggcccttagatgctttttaatcagcaagtacgcaatgctttcctgacaggaatgtcaagtccgtcaggaaatccacataagggtgttaagcaggcaaagtaccacatacagattaaaatcaaaagcactgtcaacgcttatttaatttatacagtagaccctaacttttctaattttgtgtatac

SEQ ID NO: 38579 - DNA, 1025 bp, Homo sapiens
tgcataaggagactctgtcccaagaaagcaataactatttgctgaactccataggacaactaaatgttactattttctgaaacaaagttgttatttttagccacctaacaatacattttaacctagaacccagtggatttgtttattctacagtatcaaaaaaaattcaagtatcaagttatatctgattggtatcattaaacttacctgtgaagaagataactataaagaagcaatgttgtatttcattaacatgaaacattagagtattttctgttttgggacttgtagaagtttatggacactaaaattatttgggctttttgccttagactcaattatgtttggaacatctgtcacagcaccttgtcaactgcattctagaacatttctcctcctgatggaaaatacaacatgacctatgaggcagtcttgcaaaagaaaaaagaaatagcagaatctaatctagcctttcaagatcctgccacaatttataggaaataagagtaagaggtcaaaggaacatatttattgacacctcagcaaaatctagcttctacagaaaaacgacccagtttcatcccaaataaattacaagaaaaaagagtgaggattacaaaagacttgagacatatcaagcaattacaatgtggactttatttgaatcttgatttcacaaactgtgaaatatatgtattttacatatgacatcttgagaaatatgaatactgtgacttgatatttgatctaaggaattacattgataattattgaagttgggtcatgagtacttagggattaattctctttaagtgtttttctcataaaaagttttaaagtcttgtagaactaaaaaaataccaaagatgttctaattttatttcatttttttctaagaagaataatatttttcttttcttttttcctttttttttttttttttttttttatgatggggtctctgtcatccaggctggagtgcaatggtgcagtctcggctcactgcaacctccatctctcaggct

SEQ ID NO: 38580 - DNA, 1046 bp, Homo sapiens
cagctgtttgctcatttattttactgttattgcaaaagataagttatactctgtgctttttcagcatccttcaccaatttatcactttccctcttaaaaaatgtccaagtgttttccagtagaaggaaatactaggcttagagataggagataataattttacatcccatctatgtaatgttggttacatagtagttttacctccctggatcttcattttttaagctagtaaatagaaataatgcaatcatatttaacacatgaggttattatgatgattaactgagatgatgatgatggggaaaaaaatctgatatttttagagtatttaacagtttttaaagcactcatacattcttgtgatagtcaaaacgactctttactgcatgcaaatattatgttacttttagtgtcactgttgcatactatttctgtaaacatagaagtgaggtaaggtttcattataacttatgcatcttttcttttgcagaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaagtaggtgaatgcaataaaaataacaaggttacactataaatgtatacttcgtatccagcttaagaatttcagatatgtttctaatttctcagagttaacactacattacaaactaaaaccagtactactacaaactactacaaaccaagaaaatggcccaaacgaaaaagactaagcatgcttgaggaagcagagcatctggaacactcatatagtacccattggaatgtgaattggtaccaccaccactttggaaatgaaagtagcattccatgggaagaatggtacttagtcagctgtgagctgtccatgtatgacttaaagccattttaaaataccagatcatttttcttttcccacagttaccattttttgctttatttccatttgttttatcctcaggg

SEQ ID NO: 38581 - DNA, 1050 bp, Homo sapiens
gagccatgattgtgccactgaattccagcctgggtgacagagcaagaccccatccccgctttgccccccctacacaaaaaaatcttaaatatagtagctgtttaaacacccaaactaacactgtcctcctcttgctcctcaggatgtctggagtttaattcccttattactctcccttccattcattcttagtctgcagctgcctagatggttctcctttctagcctctgattcctacccctctccttttttcccattttgtgtctttttaaaaagtcttaatgctttgagataaaatatattattaaaccagagtgtccctctcaccctctactgtactattttaatggaaagtattattttagaatacattttttataatgttcattattatatattttctgttaatatctgtacctgcttttgtcagtgttcaagatttttttgttttgttttgtttgtggacttaatcagcttctgttactattatagcattgtggatactgattgtttactgaataaaatgccactttgatcttgaaattgactgattcttattaggtcactttgtgaaattaaatgaaaaagagagagttttctattcttggttgttagtaattttgtcaccatagcaagaaactgtgatttcttcttcctgcatgctcaagtaatggcctgttctcacataccagaaagaaacaatcaaagaacaaattcttccttggagaagattgggcatacctggtgtccaagaccttttggaaaatgcacttgaaacagtgaattgttgaggaaatctcatatatgcataagtgtactacatttaaagcaaattatttgaaacttggaagctttccttgtggcaaggcttcattcatttctgaaaggattcccaaatagtttctttagagcatttagcacatttagttaaccaatatttagtaaccagtacaacttcttggagatggaattgttttgcatagaagacatacctgtttaatattccacaaaatttgaaagaacatggaatggccatttgattgcttgatt

SEQ ID NO: 38582 - DNA, 1074 bp, Homo sapiens
taccataggttaattgatataaacaagagttaagttactgtggcatatttctgatcagaaaaacatcaaacttccaagcaaaaacccaaaacacttctagtatcaaacattgacataaatatgagctatacatacatttaagaaaggttaataaatacaggtataattatttacctaatttttggagaaccagtgagggatggcagttataatggtggtgggttaaatcaaggaataaatgtttgcaaagcaaaaattttaaggagcacttcctatggtgcagttcaaagacaatcatgaatagggtaggctcgctgattatttttgtactgcatcatttatttttgtgcatttgtatgattttcatacactttgttaatttttattttacagtaatttgtattcattcattcattttccatcccgcttattccagttcaggtgaatgttaaaattttttacctgccttgtctctttccaaactggctggggtgtttcatttaatgattgaaattttacatctttcatcatgccttccccaatgattgacaggtgaaatagatcccagacttgcaggttgtactccccacacaataagcactttagtcctttgtctttacacagaagtgtagttgttcattgtttaattttatgtatataactggtgtatgtactgggatcagcttgtactctgatactacaggaaccttggttgtccagttctctttgtgtctgtacctaccctggcattgttctcacataccaaacaaatacacgtgacaaggtacagagtattgcctcctttattccacttgcttccaacatcacatcataggcagtcaagctcaggttctggaagatttatgctaggaccactttagcctgttcctgcattgtcacttttttggcctaatgcggctgtactcaatttctagaaaaagttgtttacaagaagcaactattaaaaaaaaacagcttctgttgctctaaaaccttccaagaaaaaataattattgtctattaatactgcttaatatttctgatgtaatattagggagacaataaatttatttt

SEQ ID NO: 38583 - DNA, 1028 bp, Homo sapiens
atactgaaggaaagtgaaagttcccttatacttaaggcaagcatttaaaaaatggaagataaacagacgtgactaacataggctccctttttgaatcactgaatctgtctcatgatctcctccttgggtgagctaacctgcaggcaattaatacctagtgaaagttgacctgagcagaggtttgctcaataatctgcagaacctattttcttgagatgggttaaatcagtgcataacagctaaggagagtatcattttgaattaagagagacacaaaatggctggacaaagattctcagctatattccataattctcagagaatccaagtccaaccccttgtattctgggaaggtgctattatgtggtttaagggaagcttaaaaatatcagcttcctacataactggtaataagttatttaaacagtgactctgcttcccagaacttctaagtgatacattttatcctgattaccactgagaaacctgtaaactctgcctcctgaacccaaaagagaaagccaaaatatatatgaatgatgtgtataatgtcagtcttcattattattaatacaaaatgtcactgcgatacatcgttagggagatgggttttttaagacattcgggtaagttcaggaaagagactgccagcatcagtacagttctaagaacatagtaggtattcaggtgttgattgtactcatcatttggatctgaggtttttatttcctggaaaaaaaaatagctaccacatttatttggcaacagcaaaaggccagtttctatgataggcgccaaattatatatgtggtttcatttaagttaatcattattgttacttttggttaaagtaacatatccaaaaccacaaaacatatgactgagcctaaattctagcccaggtctgtatggtctcaaagcatccgctccctccatcataccgcatctccctctgacgtctataatgaactatatcttttcagttatgggtttgaatgcttaataatcttttctaaaaaccaaaggtt

SEQ ID NO: 38584 - DNA, 1024 bp, Homo sapiens
agtcacccatttggtgaccataaggactgacagcactcaggcatctgggcttctattcttttttatttatttatttttattattttactttaagttctagggacttgtgcacaacgtgcaggtttgttacatatgtatacatgtgccatgttggtgtgctgcacccgttaactggtcatttacattaggcatatctcctaatgctatccctcccccttccccctgccgcacggcaggccccagtgtgtgatgttccccaccctgtgtccctgtgttctcattgttcaattcccacctatgagtgagaacatgcggtgtctggttttctgtccttgtgatagtttgctgagaatgatggtttccagcttcatccatgtccctgcaaaggacatgaactcatccttttttatggctgcatagtattccatggtgtatatgtgccacattttcttaatccagtctatcactgttggacatttgggttggttccaagtctttgctattgtgcatagtgcatctggacttctattctatgattattgtatcatgttgcttctctagtgggtaggagaaatacatttgttaatgacaccagtaacagctaatgtttaatgctatgtgccaggcagtgtttgaagcattttatatatactgatgtattaacacatttatcttcacaacagttctctaacgtagatacctttattgccctttttttagaggtgaggaataaaaaaataattttttctaggcttcagaagtagaaaatgacaggtctggtatttgagcctgggtcatgggctcagacagaccctgcttgggcttaccattatggtgtattacctctgatagaccactccaggcaggctccatgcaaaccagctgaacattcacaaccatgcttttgttccagtattattgcatttgattcctggttatctgccacatggactccaactcataagcatggagtatatgatgaggctttgtgctttatctcctgcctccctcaattacttccact

SEQ ID NO: 38585 - DNA, 1033 bp, Homo sapiens
attttgagttcctctgcctgctggaggacaaagctggggctagatcagcagcaggaagtgcctgtgagaacaagaaatttgtagtcccaacaacatgcaatggttaaccagagataaaccattaaagatgctatgaggcttcttttattgtgcctgccttctattttagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaaggtaaactttgagaaaattgacattttagataaaagggaaagtatatgatcagtggaaagtattgcaaattagctgtcaagaatgaagaagaaaatccacacctctgggagctcaaaaaatcacagttttagaaaaaatcactgattatataatttaaatacaaaagcactctattgaaggatctagcttatggcttgaaaatttttagattctcctacaaaatactaaatattatattcatttaatagtttttaagagattatttattgagcatttaatatacacgactcacagtgctaagccctagagacaaaagattattaagacagagcaaatatgataagttactcatgatgtacttaggtcacccctgtctgctagggaaatctctagaaaatggagcttattgtgattcttcatgaaatcactggaattagagtccatatagtacattttcatttttttctgttgggaagagtgtcttgggaaaataataaaaataatagcattccactggaaacatataaagaagaaagatcatcacaaaatactccagtggctggaaaaaaaatgaaaaaaggagaaagacagcataagcaaattaaaaactacttggcttaatgcctttttgtaggatcctatgtgatgttcatgtgtttattttttcaaaaattatgctttccatt

SEQ ID NO: 38586 - DNA, 1031 bp, Homo sapiens
tttgagacagtagttttcaagccttagtaagtataaacaggcagattcctgggccccactgcagacctaccgaatcagaatttccaggcgggggcctaggaatcttcattttcagacaagtgcagggacataaggatttctgagcacactttggacagaatgggtttctaaagcagaagggagtgttttatgatatattttggggtgattttcatccataattgttggagttttagaaaggctttgcgtaaagtggtatctcagctcgccaggcagaaaacagttctgtccccaactcgtcttttggaatgccgtagttagttgcagtttggtattcaggctgtagaatttttctttaatggagtgtctgtctaatgtttctgtgttttttagtttttgtaggtttagggcgactttgtaagtcacttgttttttaaattaaaatttcctccctaaacattgttttgttaacatcgttgtttgtttttcgtgttttgtgtataagttctttaccctgtcactttctggacatatttcccaattaatagtgtgtgtatattttgttcctgacatttggaacctttctaaatattgatgataccaagggagattgtatgctgactctgccttcactgttgttatggagtaagcaacgtaacttgaaatcaaagagcaatggtttctgtttttgtaacgagaaacatttgggaagaggagttcatgggtctttaggaaaaataattttggtttcctcttaactggtataaaaacaggaatgattgggacagatgatcttgatgagttttttgtgcatctgtatgtagaagtgacacacgtctgattgatgatccatgtgccattgagaaagtatgtagaagtgacatacgtctgattcatgatccatgtgccgttgagaaacacagatgggatgtacaaaattaagtttggaaaagtaaataggtatagatttgtgtaatatcctgaggaataaatcattatattttaaattgtgagttaatatataggctgtg

SEQ ID NO: 38587 - DNA, 1018 bp, Homo sapiens
cccaggctggcctcgaactccctggttcaagtgatccacccgccttagcctcccagaatgccgatattacaggtgtgagccaccgcgcccatctcatgcagcttttaaaatctctgcgtgtgttataacagtttcagctagatgagaaaaaaaaaacattttctgtcacaataaatggcactccagctaagttaggttaaaaaaaattagatttcattagaattttaaaacaaacttgatgtttctgttatttcttcattccactaaatgatatggtttgaaaatatttatgctcagatttttaaatggtctctacaacaaattgtcacttgttgggttcaattaagtgctcattgtataagtgcacatggtacaaatcaacaccagcttataggattgtggaaagaattaagagatgaatttagtgatcttatataccctgtcagttggtcatattgtggaagagctctacaaaacttactgtactgttaactccaagattttcttccaataacagggatgctagccagatatttaataatcaaagaccaaaaatggcagtttaatttttctacccaatatcctatggcatatgaatgatccaaatttgaagctccaaggataggaaaaagcttacttgtgcctgtcctagacaagtactagagtttatattgaaatcaaaacttctaaaaataaaaatcagtaagattaattttactcatttttctaacacgagtcagtatgcttgaagttttcattgtatttgatgtcatgtaaatttactgtaaaaaataagaaaaaattttaaaatgctttattgattaaatttagggttgcttttcagtatactcagtaactccgaagtcagtgttaacagtactgagcttacataagatttattgaatttacctaacttaggcaaatgttttcaaacttatatgcttttggtccaaagtcaaatcaattattttgaaaaagatgaatgggatttttttcagtgtggatatgaaaaataaaa

SEQ ID NO: 38588 - DNA, 1055 bp, Homo sapiens
gcaggctcaattaagggacctaatgcaaactgttgtttcccataacccatggttcccggaagaagttacgctagatgtagagctctgggaatgagaggggagaaatcttaaacatcatgcacaagggcagtgggtcccagtaacatctctaacattatgggctttagttatggctactttggtcccactctacacagaagagcctaaaaagggaaggaaggaggaaccatcacctaccttaccgcctccttctccctcagccccgccattaatgggcagaaataccaaagaggagacagttttttcctgagccccctcctccaataaataggaaaaaaagacaagggatacgctacagctatgggaccctgtcttaggcaagcggcattagaaggggagctcttagcctacccggtaatgcaagatcaacaaggcaatcaggtgtatgaacccattacttttgacgcttataaagagataagaaaaagcattagaaaaaacggagccactagcccatttacgaaagggttaattgaggtcactctgcagacctctttctaataatggccactgttattcctcccctacccctaatgtggctctctcaaaatcctatttgggtagaacagtagcctttaaagggagagaaattacaaagagctcattaattagttgaggagcaattaaaagccggccatatagaaccatcaaatagcccttggaaatcgcccattttcatcattcccaaaaggtctggtaaatggagactttttgcatgacttacaggctatcatgctaatttgcaacctatggagccccttcaacagggcctcccttcccctgcagcgattcctcaagattagcctatagtcgttattgacttaaaagactgcttttatactattacccttgcagaacaggacagagacaaatttgcatttacaataccagctatcaataatgaaaggccagcttgccaatttcattggaaagtacttcctcaaagaatgctgaacagttctaccatgtgtcagtatcatgtgaatcaggctttg

SEQ ID NO: 38589 - DNA, 1046 bp, Homo sapiens
ccaggttgtagtgcggtggtgagattaggttcactgaagccttgacctcttgggctcaagtgatcctcccactccagcctcctgagcagttgggaccacacacatgtaccaccacacctggctaattttaaatttttttgcagagacagggtctcactatgttacctaggctggtcttgaacccctgggctcaagcattcctcctgcctcccaaagtgctgggattataagtgtgaaccaccacccccagcctggattttcttgtaaacacatagtccagctgcccagaaaaaaaataaattactattcctgtttaagtaggttttctctttcagggatgcttttcttgatggcttgacatgtgatatggtttggatttgtgtcctcacccaaattccatgtggaattgtaatccccaatattgggggaggggcctggtgggaggtgattggatcatgggggcggatttcccccttgctgttctctaataatgagtgagttctcacgagatctagttgttaaaaagtgtgtagcacctccctgctttgctttcttcctcctctgcccatgtaaagaggttcctccttcctcttcaccttctgccacaattttaagtttcccaaggcctccccagccatgcttcctgtacagcctgtggaactgtgagccaattaaacctctttcttttataaattacgcagtttcaggtagttctttatagcagtgcaagaacgaatacaacatggttctaattatcctatatatttcttgaatttttgaaaaatatgctttgagaaatgttaggtaaacattttcagtggagataaaacactgtaatgttatctttatagcatacataccaaaatttaaacattacattccccaattattagacatttagatattttccagtttttgctgttataaaaaaacctgtgatgtatcttcaggaaaatccctgcaactacagttactgagttgtatggtgtgagaagtttttgggtctagccacatactgcttgttttccaagaattttacccattaa

SEQ ID NO: 38590 - DNA, 2038 bp, Homo sapiens
tatctaaccttgttcttagccatgataacacaacttatatttgataagtggatgtgtttacttggttagaataagcaaggacatttttaaaaagcagtaaatttgctgacacttttatctttttttaaaagaatgaatgacagcttccttatcagtataattacatttaaacttttttttttaaaccgtgtggcagcttctttatcaatcagtataattccatttatttacttagccctcaaaatgacattttgaagggagcataaactctttcaggctacttggacagtatttagtattctatattagtactacactaataatttactgagtgctacctaagtgacctgattgataatgtccttaaggacctgatacatccaggataacctctcaggtactgtaaacaaggaggttgaaaaagacacattccggaatccctttgtctggtaaaattggatactgatgtggatggacatgacattcattattcttgaagatataactagttgactgggattctgatgaaggtttgaaattatggattagatctttgtagaagtagtttaaagattgcaataagtgaaatcttttttttttttttttttttgagacagtttcgctcttgttgcccaggctggagtgcaatggcacgatcttggctgactgcaaccgccacctcccgggttcaagcaattctgtctcagcctcccgagtagctgggattacaggcatgtgtcaccatgacctgctaattttgtatttttagtagagacggggtctctccatgttggtcaggctggtctcaaactcctgacctcaagtgatccgcccgccttggcctcccaaagtgctgggattataggcgtgagccaccgcgcctggctgtgaaattttttttttttttttttttatgtgaggcatattttgccacagtctcgcactgtttaggttctcttgtcttttggaatctatcattctgtatttaatgttagtggctagtccaataattgattgtctcatctgtatgcatcttatgcatgtgattcaatagactagatcgattctgtgtggtttatcatagtagatacacaaaccagtctttattttttacttaagaaaatatataagtggaagttatcagtaaactggtgattattgtattgaatgcaaatctttttattatttttccagatatattgagttttataaaccattaaaatattattttatgaaatttcccttcctggatgaacagaatattgttttattaaatcttctcttattagtggaatattttttacttctttgtcttttcatttacttgttttttgttataatgaaaactttactagtgtttggtaccattgagataacttattactggaaattttgtttgcttcctgtgggatatatctggaagtggtcatagtccaaccatgtccttttgatgttgttagcatatcagttattctatgtattgatcttttcttctcctgtattcaacacctctttctgaaaggatgtctgatcttcccataatcgctttgatgtagatgatatttttattctatcagtgtatactagacaggattttgatgtggctttgtatttgtatatttaaataccatgtctttaaagcattattagaagagatattctagtttcttctaatgtcccttttaaaaaaaatatagccagtccaatatctcaaactactttgatttttgaacttaaatcaacttttagtgctaccttgtttaatggtagtagtattttctcatttctacatgttcacacaagtttattatatatagtttatggtcatatgtatcttataaaaattttgaagcccatccccatggatttattataatacagctctgatatatcttaaagttaacccgttttccgtagatgttaagggctttactggttgaggtaacctatttcaaatggtctgttgggttttgtggtaccttgtcaagaattcaataagaattctcaggctgtctgtattttcttttaggactttgga

SEQ ID NO: 38591 - DNA, 1058 bp, Homo sapiens
agaggaccttatctctaaaggaaaacaaaacaaaaaaaaaaaaaatgaagaaactttctcctcacagggaagaagtaagcccaaagtcaattctaagatgccttttgttttcagcattagggcttgtgggtcttttcagcccttcagtgttgtgaaagagaataaacagatcagcagaattagtagagaataacagaggcaatttattgagacataaccatatacaagttgagtgtcctttatctgaaatgcttggaatcagaagtgtttgggttttagatatttttggattttggaatatttgtgttacagctgttggttgagcatccctgatgtgaaaatctgaaatctgaaatgctccaaggaatgtttcctttgagcttcatacgggcactcaaaaagttttggattttagagcattttttttttttccagatttttggattagggaagctcaacttgtagttaaataaaatatgtaggctactaatagctaaatataagaaaaacaattgtagtaaataatgacaatcccaacaggttttaaggcctccaagatggtaggctagtgattaattttagagtgaagttgaagagatctaaattaatgtttaaatggctaaacaacttatcttcctagtgtcgtgagtatgttttgatagcacgtgagtataatttgaagggagtgaagttttaagaatatacttatgtgactagtgaattactgaaattttttcctactgaatatataattgctgtgtttctgaatttaattttcattgacctttgcatcaagagtatatgcaaaggtcagtgaaaagtattgcatcagattcatttagtatgctttaaagtaaacattaagaagaataaatattatgtaaagctttcctgaatgactataacttcaaaagtaacttaaaatggttttattatggcctagaacaaagtaaaatgatagtggaaacatcaattcaaggatagttcttcccgagttaggattacctaaatttatccaaaacatggccttcttcctgtccctagaatattcacattgt

SEQ ID NO: 38592 - DNA, 1088 bp, Homo sapiens
caattccttccttttttttagagaccctgaagagactgagtggcattagaatggcagtattgttcagaatggattcaaagatgtggacaaagagaccagtttagatgacttttacagtaatttagctctgagatgagagaattgtttgacttaggtaatggcattcagaatgaagaccttaaagtgaaaccaaaagacatattgaagaaagaaatgatagggttatccatttccatgacaaatggaagatttggggaaggaagggaaaaagggtgaaagagaactgcattccgtactttagggtttgcagtaggttactgatgttctgcattttccagaattagagttctttcaggacatgtttccctattcatatactgagtgttttctctactataatgagtatatatgtctgttttctttagtaaatttgagtaggtagtttaaaatgaattttttcacttatttttttccccaaatttcattaatttgttttttcttttttctcggaatcacacattccatgctgttttgcactcctttttgccgtctctctaggaagtagatttatgaccttcagcgttctgaaaagcagtatggtaacatagaaagggcaaaggctttggtatcagacagacctgggttccactgttactattatttgcttcatattcttaacaggttactgaatctgtgagtttagtttcttcatccctaaaatggtatcgttatgcttatgtacgagattgttaagagaaaatgtaatactctatttcaggcctgacctgtaaccttcaatgattgcttattccttgacatttgtgtcaccacaaggactctaaagaaaactagtatgcatggggggttgtaattgcctcttttaaatcaacaagaagaggtcactagaagattgtataagcctcgctgttttttataggtatgaattctgttttgtaaagaggcagtccccaatggaaaaaagtcaaattattcacaatttgcattgttttccttgctcccctcccccattttctttcatcttcaatttcttcactctagactaggccttctcaaacttaaatgtacac

SEQ ID NO: 38593 - DNA, 1048 bp, Homo sapiens
aagttccataattcacactcagggaagaacatctttcatgttaaaaattgatacaggatattgcgaataaacaacaaataggaaattttgaaagtttttttcaagaacttgagtgtttattttagttttccataatacagctttgtcttatattttaggaagccacagatgatggacataacaacaaccttcttcctcagattattcagtgttttgcatgtccaaattgcttccttctttttagcagaaaggaggagtgttcaaagcatatgtctggaaagaatcatttccatcagagtttcaaactgggtggtatgttaatactctcttctgctgaaaattaaactacttgaatctttgctgatttatcatacttctcagatcattcttgagattacatatcctcatcttagttttagaactatgaaagtaaaagattatctcaattcctacttaaaaacaaagattcttaatatttatttgtacgtatgagtaaggcttactaactttgaagactgaagaaatcctgggaagcaaatatttattcaggataatgttatgttatatcatgatatcttggaagttttctgtttctcggcatttaagactcaaattttaatttgagtataagtaaggcattctttgtatttaaggctagaaagtggcttcccttagatttttattgccaaaataactgtcttcttttacttactccaactaatgttgagaagggctgaggggaggaaggttgggttactctgtactcaaataactttgcaaattatagtttattttgtctttcagataacaaaggaattgcacatccaatatctttcccatcttttgcaaagaaacttttgatctctctgtgcaaagatgttccctttcaagttaagtgtgtggcctgccacaagacactgcgttcccacatggagctcactgcccatttcaggtttgtattggtctggagctgtaaaggaatacggatgagtgtttgccagtgagaagattcaacaaatacattttctttccatgtttctctcctttt

SEQ ID NO: 38594 - DNA, 1032 bp, Homo sapiens
tattgtttgacctataggtttattagaaatgtgttgcttggctgggcgtggtggctcacacctgtaatcctaacactttgggaggcttaggcaggtggattgcctgagctcaggagttcgagaccagcctggctaacatggcgaaaccccatctctactaaaaatacaaaaaattaaccgggtgtggtggtgagcgcctgtaatcccagctacttggtggctgaggcaagagaatcgcttgaacctgggaggcagaggttgcagtgatccaagattgtgccactgcactccagcctgggtgacagaaggattttctgtctccaaacacacaaaaaagatatgtgtggcttaacttctaaaggtttatagatgttacatttaggtatttaatttataaacatttagggatttgtattattttttgtttccaatttaattccacaataattagagaacatattttgtacagtttttttcttttgaaatatattaaatgtataaaatggtagcaggtctgttctctctggagtttagtagtgaagacacagttgttctatttttttattttcctagggaagttgatttattttgagttaatttgtggaatagtatgtggttttattgagcctagttcttcagtgcaaaagcaactaggggcatgacatttgtctgacataaaattaatcagttctttatttttatttcttatagattcagggggtacgagtgcagttttgttacatgggtatattgtgaagctcagatatctgggcttttaatgtcactatcatccaaatagtgaacattgtacccaataggttattttccaaccctcacccatttcccaacctcccaccttttggagttttcaatatctgtttattattccactctatatgtccacgtgtacccattgtttaactcccacttagaaatgaaaatttgcagtatttgacattctgagttatttcacttaggataatggcctccagttccatacatgttgcttcaaaaggcatgatttcattcttt

SEQ ID NO: 38595 - DNA, 1051 bp, Homo sapiens
aaattggtgaaatgttcagattatttttatctgatttaagtgtaaatggtgtcatgtacagatttggatttcacaaaaaggtttagatagaaatgagtaacattcaaggttagtatttttgcatattaggcttctaatactttttggacttgaaatcagaatgattttagcaaattcttactgaactcatgttgatatttctctcttctcagaggaagaaattgttgagcttccagatttggattacctgcgaaccatgactcatatagtctttgtagattttgataactggtcaaacttttttggtcatctaccagggcatctaaaccaaggaacatttatttggggctttcaaggtacggttaataagaaaaacaaaagaaaactttttcccacctcttagaatatagttcagtttaaaaggctcctcttaaaccttcctggatagaacataggaacataattggaatattgttcttttgtattatagttactctgctagaatcgttttctttacatgcctctgtggtaaatgttagctctatctggtgactcaaagtttatggatcttttggccgggcgcggtggctcacgtctgtaatcccagaactttggaaggctgaggcggacggatcacgaggtcagaagatcgagaccatcctggctaacatggtgaaaccccgtctctactaaaaagaaaaaaaaaatacaaaaaattagctgggcgtggtggcgggcccctgtagtcccagctccttgggaggctgaggcaggagaatggtgtgaacccaggaggcgaagcttgcagtgagctgagatcgcaccactgctctccagcctgggcaacagagtgagactctgtcttaaaaaaaaaaaaaaaaaaaaaaaaaagtttatggatcttttgatacagattgaaaaagcctttattcaacacctaaaatgtgtcaggtgctttggctttgtactaacatggttactgattattatggttttatcccttttaaaatacaaagaagcagatgttttgtttttgtttttgttttttttc

SEQ ID NO: 38596 - DNA, 1048 bp, Homo sapiens
tgaaagaaaaaaaaggtgaactttttaattgaaaaaagtttattgaagtttattgtagtttattgaagactactatgtgccagccaccatgttaactgctttttatgtttgtagtgtttacagatgtttaaatatgttgaaagaacttcttccatatgctttttaatcccctttgcaagctacgaagtaggtgttggattaccccattttataagtgtggaaggaagcacaggttcagaaaggttaaataatctacctgcagtcacagagcaagtgctttgcttttcattagtatcaacgactgtggttgagactttcactgacacaaatacctgattccatgatgtagagctagccacccagtgtgaattactggctttaaccatgtccttgaagaatgaagataatgggaaatattctgccacagtatagggacattgcagagtttatataaagatatcaaacaagttttttatttttaaataacattcaggaagaatgcgcttttttttttttgtcagaagaaatgatttggttgtgagttctggtgctttaaaaagtaaagtgattatatgctgaatatagccaaggaaagcaattagcattctaatttctttaggatcttttgtctcataattaaatgaataaacaccatctttacaggctcctcgagatgttggcactagaactacaagcactgcagtgagcttattggagtactgcaacatgtggtttcaaagaaattcactagaaacctgcctcccattgcttcctctacctttcacttaatcgatataaatgttccagggcacacagaagttagtattttcagtgttttcttatttgggccagtatctgctcccttgagaattacatgtaatgaaaaagatgttactacaagataatttttgttgaatctgtatgctccttagatggtcttgtttataagcctgagactgtcatatccatttagttgtggcttcattgtggatgagtgggttagaagcagtaagtagggttggcatctatgagtcataccaattacaca

SEQ ID NO: 38597 - DNA, 1018 bp, Homo sapiens
ggaattaacttgcaagttctaagttcatatataaaattcaattcaagatcatgtctagattttcatatttcaaaatactcaattttttagtagagaaactgccaagttatcctgtgtttttccattttgattttactttccttcttgaaaagaatacagtcgatgaaacttaaataaatacagcacatgttgagttttctgccctaagtgttaaaattctatgttttttaatgcagatgtggaattagaagaagctattagaagaagtcttgaggaaatgtaattaaagatattaccacacaacatcaagtggccttgaagagactgagataacgaattcttgagtttgttttctaaaggagaccagaaatccactattacaaatgtatttgaaaacatgtttttgctttcatatgttcaaaatctgatctttgttttgtatttttgtgctaatgtgcaaacatgtacagaagaaatagaatacatgttcatgcaaatataaattatgtattctaatataggtgtaacagtttcccagttaactttgaatttatatatttagatttaaaggattaaaaaaaaggaaagctcttgacagttgtttcccaaatagcattagttctttaattttatttgtactgtacaaatgatgctagtttatttttttagcagtgaaaatgaatataaaaaaggtgacataggtcaagttttccataaattctacttctcatgtggcactattatataatacctttgagatctttgtttatgtttattagaagagggtaatggaaactgatcatggaaacatttaaaattttatcagcaatgttctttgtgggtgccatgcatatgtaaattattgctttaattagagcagcacattgctaaaataaaaaatacaccttaatttttaagaaataatttaaatgaaacaatttccattccttttacctgcttagacttttatgtgacttgtatggtctcctggttaaagggaatggtgtcagaatatttg

SEQ ID NO: 38598 - DNA, 1043 bp, Homo sapiens
agctgtgattgaccactactctccagtctgggtggtagagcaagaccccatctctaaaaaaagaaatgtttttgaaacttactttaccattggcttaggctggctcagtatttccttacacctcttaccattctaatgcatttattttattcatgtgtcattatttttaaggaaaacttagaagatgaatatgaaccacgaagaagagatcatatttctcattttattttgcggcttgcttattgccagtcgtaagtatatgtttatattctcacagtcaaatctggtgtcatgggttataaattggtgtgtggtaagttgatgtgttgtgctaaacataggaaaacccagaataacatcaggagccggttgatcatggggttgaacactgacagtaaattgtttggaagaaattgtttacttaaaaatattgaaaaaaattctatcgcagaattttgcctgatgaaacacttcttaagtttgtgagatagactcttcatttgggattttaaattggaaaggattttattgggaagaaggacttttgatatttttcctgcaaaaaaatggtaatatttataagaaacaattaatgaaacccacacttgaatttgatacaggtttttggaatttgagctctatgggccagttaaatcgaagatatttttgtttggtagttggtttcttttaagttaatagtgccacccagaggtagtaaagttagttgcttttttaaaaattgtttttccctcacatgttaattttggtcacataatttagttatggctgtctttttttaaaattaataagcttatcaagtgagactctggaattgcttactatcccaagataataattgagaaattacttaccagttttggttctagagtttttcttctgtaaaaaagcatatgtagtttgtgaaatttatataataaatatgttgctgacaatctgtgaaaatctcctaaaaatgtgaaatcatattttgcatccagtagggtaattattttattatataacgataatgcccattagtatct

SEQ ID NO: 38599 - DNA, 1035 bp, Homo sapiens
aaatatttttcccccatatttttggtataccctcattgttcctggactccaactagcctatgagttgaggaagataatactttgtttcgttctgagtgtttctgagttcgcttttttgacaaagaacatcactgatgtggtatttgaaacaccaatgcacacaccgtgtcagtttgcattggtaggtgggttattcccgatgtttttgctgatgggtatggtatctaactacttgatcatgtagtctagggcactgtgtctgatcaattatgtatgccactatttttttgttttaaatttttaaatattttatatatatttagttatggaattctattgatattaaaaaattgtgaattttatttttggatagtaatacaagtattgcaacatattttaagtattaaaatatttaaagaagcattgggtctgatcaggttgttaaccactagttccacccaaggtgtgtttctttgctttgcagattctcaggtatgattctgttacattcttgcgtgtagtattattagccctgactgtagcatatttcttattttttttgtctttttggaagatttaaagtagttttggcttacagttctacttttcttttttaacacttttctctttttaaaaaaagatattgtttgccttgctaatactaaagtagctttcactgcagtcacattgttttcataactcaagttatatctggatattttcctattttttgtaaaaacaaaaaaaatcttcttaaaccttcaatatgacttactttcagtacccttaagaacttattagcaaagcagatgaaggaaagagcccaaagcaaaaataataataataacttcttcttggaccccttcatatacagagttcaaagctcttcatttcttgtgaatgcagagcttcccagaatccctgtggaacagggcaagctaacctctcagataggaaggattaagactgattgtctgtttacagattttttggtggggatattcagttctttctatttcccttggagagttcttc

SEQ ID NO: 38600 - DNA, 1049 bp, Homo sapiens
ctctgttgcccaggctggagtgtagtggtgcaatctcagctcactgcaacctcggcctcctgggttcaagtgattctcctgcctcagcctcccaagtagctgggactacaggcgcacaccaccatgcccagctcatttttgtagctttagtagagacagggtttcaccatgatggccaagctggtcttgaactcctgactttgtgatccccccacattggcctcccaaagtgctgggattacaggagtgagccaccgtgccggcctatccaatccattctttaccctgaagcaagagtgcagatatttacagatgtctatgctacagcccctccccaactcttcagcaatttcctattaatataatgttaatcttcaaaatttgtaataagttacctcaagctctcatccctgtttacctccctagcctcatctcttaccactaatctgtaaactctatggaccagccatgtgaacttcctttagttgtgaaaacatgttttttccccttgactttggatactcttccctacatttcgtctaattctgactcatctgtcatgtatcagcttaaacagttttctttctgggacatttccttaagtttagcgtagaaacccatcctctgtggcttttttttttttttttgagacagtttcgctcttgttgcccaggctggagtgcagtggtgcgatctcggctcactgaaacctctgccttctgtatgttcaagagattctcctccctcagcctcctgagtagctaggattacaggtgcctgccaccactcctggctaatgtttgtatttttagtagagatggggtttcaccatgttggtgaagctggtatcggattcctgacctcgtgatccacccgccttggcctcccaaagtgctggggttacaggcatgagccaccgcacccggcttcctctgtcagagcacttgtacttgagggttatcacccgcctgtcttgaaatgggctctaagtctcctgaaagcaaaggaccctgaatatggtgtttattacctaacacaatgtctagcct

SEQ ID NO: 38601 - DNA, 1028 bp, Homo sapiens
tgatatcttaaaactatacacatttttatatgtaaaacacatattttacagttgttgtctcttaatctgagtcagtttttaatactttttttgtacctaatgcagaagaagacttcaaaggtttgtgacatggctgttttaaactgtactgattatagtgtaagcatatgccaagctttccttctcagttaaaaattgtagtattttctgatataaataaatttttattgactctctggggttacctaaatatgtataatttagctatgtcagcacttgggaagactaaaatactaactctgtgtttattaaatgaaggaatttatgagaacacctagcataacaggtatttagtaactgttaatattctttctccattcctaatcctgttatttctttatcctcatgaaagttgatgcttttaaattttttctttacttgtctgtcactaccctagattatattctagttacagctaagaatagtgtctttcaccactgtggaagacactgatacttgtctactgtttggccattgctcttttattattcttagttttattcacccatattctctctgttgacattttagaccacacttctttgtgtgaaatagacaaatattttccagcatattggatagttttagctgtcatctattaaatgctggtggtggaccccagtctccatgacaaccaaaaatatcaccgtgcatttcagaaaacttctggcatgttaatgctactattaatctgatcatagtcatttccttcttaccaaatttttaatttatgcctgtgacaatgtcattgtggctaaaaagtatgagttctttgggggctcctgaaaaaagtttttcttgctaaaaaaaaaaaaaaaaaaaggcatgtgggatgaagtagtctttttttcccccctctggatattgttgtaactgaatgtgatgcctggaagagctacagccatctagagatgaggcaggtaacttcgggacaacccaatttgctgcatagacatgtagaaagatgg

SEQ ID NO: 38602 - DNA, 1049 bp, Homo sapiens
tcaggctttatttctatatagcatactatctgaaagagtttctttgtccctgggcagaagtttgaaatcaaggtgtcggcatggccatgcttcctctgaaggtgctggggaaagatctattccacatctgtcttctggcttctggtagttctttgacttgtggcaacataactcaagtcttcacatggcattcaccctgcatgtcccaaattctgctttttctaaggatatcagtcatattggggtatcatttttctaaggatatcagtcacctctcaactccagtgtgacctcattgtaactaagtacatctgcaacaatcctatttctaaataaggtcacattctgaggtactgggggttagtacctcaacatatgattttcttgggacagagtttaacccatatcacatgtctatcactaaagcagctattgtggtttaagggatagcctagcctaagatcatgtgtctgcccctttagatggggtatcatgggagctgagagtcagtgtgttcctgaaaccacaatatcccaaacaaaaatggatgattgttaggaatggggagaggggagaatgaagatggggaggcagacaacaattgtctactacctagaaaagacactgaatatgaattaaatgtacaaagtttttcactttgtaatttctttcaagccaagctgcccagtgcccaaaaacctaactatgaaaatgcatctgaaattcttttacttttgggtttaaagctacttctgattttgtgtattgcaaagtttaaataaatttttaataagttttgactgttttataaatttgccttgaaagcaactttaaaaatgtaaaaaaaattttacatttgccacacatttttattttagataagtcaagatattctatgtatatttgtgatttatcatcccaatattccagtgtagaaagaaggatatgtggcagatttttgcaaaattttacaatttttttctactttctgggtagaagtgggggatctatactgagagaaaagacagaacttgggttcctaagtttgt

SEQ ID NO: 38603 - DNA, 1051 bp, Homo sapiens
ggtctcccttgctgctgatctgtgggaaacaaaacgttgcagttgaaagccatgagactattaggatggtgcaaaagtaatgtggtttttttctttacttttaatggcaaagactgcaattacttttgcgccaacctaataacagaaaaaaaatcatttttcgggggaaaataagcatatgctctttctagtttgacaggtttgttgactgaggatgctcagctgaacttgattgttgttctatttgtgagatactggtttgttaacctttttctaagatgcagtttacaatctgttgtctattcaacacatatttctttttttttaacttttaggtttgggggtacatgcgaaggtttgttacataggtaaactcatgtcatgggggcttgttgtacagattatttcatcacccaggtattaaactcagtacccaatagttaccttttctgctcctctccttcctcccaacctccaccctcaggtagaccccagtgtctgttgttcttttctgtgtgtgcaagagttctcatcatttagctctcactaagtgagaacatgtggtattaggttttctattcttgggttagtttgctagttagtagcctcaggctccatccatgttcccacaaaagacatgatctcattcttttttatggctacatagtattccataatgtatgtgtaccacactttctttatctagtctgtcactgaaggacatttaggttgattccatgtctttgctattgtaaatggtgctgcaatgaacattggtgtacatatgtcttgatggtagaatgatttatattcctctgggtatatacccagtaacgggattgcaaggttgaatgatagttctgcttttagctctttgaggaatcagtatactgctttccacattggttgaactaatttacactccctccaacagtgtataagtgttccctcctcttcgcaacttcatcagcatctgttattttttgacttcttagtaatagccattctgactggtatgagatggtatctcattgtggttttgatttgcatt

SEQ ID NO: 38604 - DNA, 1028 bp, Homo sapiens
tgtatatttaaattccttatagatgttgaatattagacctttgtcagatgcatagtttgcaagtattttcttccattctgtaggttgtctgtgtactctgttgataatttcttttgctgtgcagaagctgttaagtttagttagatcccatttgccaatttttgcttttggtgtctttgtcatgaaatttttgcccattcctatgtccagatggtattgcctaagttgtcttccagggttttcattgctttggattttacatttaagtctttaatccattttgagttgatttttatatatggtataaggaaaagtccagcttcaatcttctgcatatggctagccagttatccagcaccatttattgaataggggttcttttccccattgcttgtttttgtcagctttgttgaagatcatatggttgtaggtgtgtgggcttattgctgggctctctgttctgttccattggtctatgtgcttgtttttgtacctgtaccatgctgttttggttactgtatcctgtgctgtagtttgaaattggtagtgtgatgcctcaagcgttgttctttctgcttaggattgccttggctattcggactcttttttagtttcatatgaactttaaaatagtttttatttatttattttttagttctgtgaagaatgtcattgatagtttgataggaataggactgaattatataaattgctttgggcagtatgaccattttaatgatattgacttttcctgtccatgagcatgggatgtttttccatttatttgtgtatctctgatttctttgagcagtattttgtaattcttattgttgcgatctttcacctccctggttagctgtattcctaggtattttattctttttgtggcaattgtgaatgggattgccttgttgatttggctctcagcttggcttttgttggtgtataggaatgctagcgatttcgttcattgattttgtatcctggaactgctgaaggtctttatcagctgaaggagcttttggact

SEQ ID NO: 38605 - DNA, 1060 bp, Homo sapiens
gagcttcagagacgtcaggtctgagctggattttgcaaggctctctcttagatgtaagcattcccttgaccttgtcttttttagggagtagggagtggggagtaagaccactgctttttttttccttcttaaattttttaagttctctcatttcttccttgtccatacccttgctgataatgaggcttgacatctatcttcctgcctgctccattcagacagatgagtaccgtccatggtttctaattctgtaccttcaattttcactgcttgtctgtttaattgcacatatacgtttaggaatttgtcaaggagtacagaatccatcttctgatttacatgcattgagagtcttgtgtctcagaaatgaaaatcttaataaggcttttccatctttatccgagtgacagagagaaccctgtgaacttaagtaggcagtatatatactaaaattggagtggtgcagaaaatgttacccaacaagttctaggagagtaatgtgtaagttcaaataaaaaataaaaacaaaaaatgaaaatcgtctgagactagttgattggaaataaccaaggaatgagagaattgagaataacaagcttggtttcccttaaaattttaaaggggtactaagagtagaaggaaatgttttatgagactcttgctgttttgtataaaatcttatttttaataattttatatttttcatgcctacattttaaaagagagacctaacatacagttatgagacttcagaaatatcatggaaagtacttatgctctggttgcggttgtcccttgtggcactatgattttgttcatgtataagattgtatttgttgagttgcaaaacagccaggtgaacagtgtcattgagtttactaaattgaggtgtgaataaggtaatgatctagaaaacagataactgaacctggaaaaagatatagaagacagattacttgcttataaatttgaaacaaaagaatggtaaacaagattggtaacccgaatgttatcttctttaactgtgtcatcaaaaactccacagttataacattgacta

SEQ ID NO: 38606 - DNA, 1039 bp, Homo sapiens
accacaaaaacatgtatgtatgctttgataattaattgaaggaaaattctgtatttgggatgcataaccttttgtttttggtattatcctaatagagagaaaaatattcccaggcttccaagagtaaatttgagggtagttcattttggagtgtttatgagtatttgctttatttacttctggaaaatgaaataaccaaatcaacactcagtttttgaaagtaaatttgaaagaatataaaaatattgccttcaaatgtgtagcatgcactttctccagtgccgatctttatttattaagacaatgttgtatagaacattttccagagaaatgttattaaggcatgttcctgacaagtgattttaatcaaaatagattaatttaaaatgcaaccatttttataagatattttaattttcaaatcagcaaggatttcacagtaatgtaatgaaaatggaatattcctttaaagtttgtaggttttttgaggcatcaacatagtttttgagggtgagagtaggattggcagggggaggcagttcaaaggaatgcattgttaatggaataccaaactctgtaatacattttaaagagctttattcagagccaatatgagtgagcatggcccagggaagcacagtctcaagaggtcctaagaaagtgcacgcagggcagtcagattatagtttgagtttttacattttagggagacaggagttaataagcaaattcataaattgatacatggaggttatacattggtttggcccaaaaggtgggatatcttgaagcagggacttacaggtcataggtgggttcagagatttttaaatttgcaatcagttaaagagtaaagctttgtctaaaaatttggagttggcagaaaggaatgtttaagataaaaaagttgttaaccattacactcggtcagcatgacttataggggtgcataacttagcccttgtctggtgtgacattaggtcctatttataatttggtatcttattgccacaaagagtctgtattgtcagtcttatga

SEQ ID NO: 38607 - DNA, 1073 bp, Homo sapiens
cccggtgtgtgatgttcccctccctgtgtccatgtgttctcattgttcagttaccacttatgagtgagaacatgaggtgtttggttttctgttcctgtgttagtttgttgaggatgatggtttccagcttcatccatctccctgcaaagcacatgaactcatccttttctatggctgcatagtattccatggtgtatatgtgccacattttctttatcaagtctatcattgatggacatttgggttggttccaagtctttgctattgtgaacagtgctgcaataaacatacatgtgcatgtgtctttatagtagaatgatttataatcctttgggtatatacccagtaatgggattgctgggtcaaatggtatttctggttctagatccataaggaattgccacactgtcttcgacaatggttgaactactttacactcccacaaacagtgtaaaagcattcctatttctccacatcctctccagcatctgttgtttcctgactttttaaggattgtcattctaactggtgtgagatggtatcccattgtggttttgatttgcatttctctaatgaccagtgctgatgagcttttttcatatgtatgttggctgcataaatgcctttgagaagtgtctgttcatatcctttgcccactttttgatgggattgtgtttttcttctaaatttgtttaagttctttgtagattctggatattagctgtttgtcagagggatagattgcaaacattttctcccattctgtaggttgcctcttcactctgatgatagtttcttttgctgtgcagaagctctttagtttaattagatcccatttgttggctgggcacggtggctgaccagcctgaccaaatggagaaacgctgtctctacctaaaatacaaaattagccaggcatggtggcacatgcgtataatcccagctactaggagaatcgcttgaacctgggaagtggaggttgcagtgagccaagattgtgccattgcactctagcctgggcaacaagagtgaaactccatctcaaaaaaaaaaaaaaaaaagaagaaaagatc

SEQ ID NO: 38608 - DNA, 1079 bp, Homo sapiens
tttttcgttgtgtctctgccaggttttggtatcaggatgatgttggcctcataatatggcccaggggtttggggcccttgttctaagtacttactatttttagcaaatattttgtctaattaaatttattagttggtgtatgtcactgacaacttagaaccctgactaatatatacagctcatacttagtgaataactatgtgtgggatatagtataatcatgggtttccttttaggaggggatttatagaaccatttcttcatgtatgttcagggccaaggctaatgttatttttattaaatgcccaagtcatttgctctctagtttatttcgggttgatttatttcattgaagaccttaggccttgactccaggcttgttgcaatttttgtttgtaagccctgaaacagagattctattctccctgagggagaaatggttatgaagagagcttctcatgttaggatgtagtggctggtgtcaggcagtgatttccttatcatcaccgttgtgattatcttggcatacatatattgctgataattgatattctctatgaagagcctgtttaactcacgtctcatcccaagtgaagggccatcttgagcctgagtttccctctggaactctctttatgttgctgagaagcacagtgcctcctggcacattagctttcagtctgtgaaagcagatactttcaaatgggaaaatgccatgcaaggtgaactgttggtattttcacagcaggcaaattcttagcaccctcagtataaaaacactagtgaatcacatttatggttttgtaaccattacaatgagaacagacagtgacattcaaatctcagaaaattgaacccttgatattgattgttaatgtggaaaacttgaagaagcaggtagaacactgtgaccttacgatgtgaattctctaatcagaccatacagatcagtcaaatatttgacttattgatttttggagaaacaagctattttgtatgcaagatatgaaaatactagaagttttcgcccttgattcagaataagcaatgagagtcaaggtcttatgcagtaaatttga

SEQ ID NO: 38609 - DNA, 1049 bp, Homo sapiens
aaacatgagtcattattggaattattgtagttttaactaataaatagtaaaattttattggactcttgaaggtcatgggtcatcatggacttaaaaattttagtgtcagtacccagttgtccagaatttagaattggtaaaatacattcagctaccaaaattgcgcagtaatatcatcctgtttaattcagctggaatttaagttaatggcagatttaatggatgggacactttgtagcttctgcagaccctgataagctttacataaataccaagttgcagctacttgagtgaactacagttccacaagagaaattcactttaggatattttgaaataccattcatctgcttcagttagatattttaggtaccatgtcattcttccctatttattaatgttatataatattataccatgtaaaaagtattaacaacgtaaccatcattgtatttgcattgtagcgtaatcagctgtgaaagatgaattttcagatgtatacttatagtactctttgctaaaaattctgtaggccaccctgactcattggttataatattgtgtagtataagtaatttcatgatgtgattatttttatatttatttatttatttttgagatggagttcactcttgtttcccaggctggagtgcaatggtgcgatctcggctcactgcaacctccgccttccgggttcaagtggttctcctgcctcagcctcccaagtagctgggattacaggcatgagccaccatgcccagcctcattatgtgatttaaaactttataataaactgtaagaaaccaaaaacagattttactcatgaattttatgaatgagttggattttaagagatttatttattgggcctcactctgtcaccaaggctggattgcagtagtgtgaccacagctcactccagcttcaacctcctgggcttcattgatcctcccactgcagcctcctgaatagctgggaccccaggtgcttgccaccatgcccagctgatttttaatttttgttttatagaaacagagtctcctatgttg

SEQ ID NO: 38610 - DNA, 1977 bp, Homo sapiens
tctaaaatagccttttagtcccaaccttcccttattactccccactcccttaccagattgttttcattatagcagttaattatatctgacagtcaattttgtatttgtttccaccattagaagacagggactttgccttgttcatgtctctgtccttagcatctagaatagtgactgtcagggagtaatctagtcaaagtactcaaataagtactgttgaatggatgcaggcttgcctaattaagttgtaaggacaagttacgatgaagccattatttaggagatatttgaatatgggttagttaggtgggatgataagtagagggatgaatatccatggtagagattgagattccatgaacatgtgacagactgggaaatcatactttcacatccttctggccaccgtggttagtctagggcagcttgacccaaattgaacttaacccaaattgagctaggcagagtacctagctttattctatgaggccctgcccttgccctgtttaccttaactcttccttagatcctgtgagctgctgcaacctggaatccttttgatactgctgttttcccctctttgggtagttagaatttagtttctattctttgtccatgtaagagttctgcctaatatcaaggggtagagataggtcatgtgaattaggtcggagttagatgtatgtttgtaactattaacattagacctgagcaagtattggtttatgcaaagggctgatatatgcagtactgcattttcttgtccttttaattttaggtctctaagacagagtagaagctacggaaaaaaaatgtgtgtctatatgttaggagtttttaggttataggaaatctgagcatctgtagtagtccacatatcattatcaatggctagagaatctatccacttatctggttggcatttaacgagtgtgtaccatgtgtaggacattttccttacatacaaaggttaattaattcattttacagagacatttattgaatgaaaactccatgctgtgttttgcagggtcacagttaaacaagccctggcttcccccttaaaggagcttacagtccaagagagtgagcatgacaagcaaacagatttgtgcaaagcgccataggagtgtgtgttgcagggatgccaagaagggagtcatcagttctaaggttaagataggagaaatttcttggaaggttcttaagagatggaaaagttaaataggtgtttggcagagagaggtattgggtgtttgtggaaggagaattggaattccaaagagtaaaggtgtggaagtgctggaccagtggaggagatgttgttcagaatgtctggagagtatagcctaaagggaagaagtgtcaggtgaggaatgggacagaagaggaggctgaaagagggagaacaggctaaagagttgggactgtatatggagggtagtaaggagtcatttaacccatttatgcctagtgttccattattggaacgctaagcttgtgtagtaaggagtcatttaacccatttatgcctagtgttccattattgaaacgctaagcttgtgggggttatttatatcctgctcatggtcatcaccaaggtctgatttttcacaaaacaatttgcaacctatggcatgaatgggttaagagacttattcaaggaaatagtggaacatatttgtattttggcaagtaccctgccatgacaaagtaaagaatgggctggaggcaggaagaccacggaaagcagataatctgaagccttatgttcttagtcacagatccgtccttagggaaagtgaggccttgcctgagcagaggctctagatgggcggattgaacttcatgaggatgctgagaacagtgaacacattcctgatgtgtccagtatatatggcatgttcaactcccccaacagttatatcatctttatagctcagccagtcatatttcacattaaatggcaaacctagg

SEQ ID NO: 38611 - DNA, 1023 bp, Homo sapiens
atcaaaagctttgagttcccactgcactgctgacttgctttctgatcctaacaagtttctaactcctccaagcctccattcatcaaatgatatacagaaatgctctttcagggggttgcaaggatctaattagaggctattgaagactctttgtacactgtaaaatgctattcagatattatttattttaataaacagtgattgctttatgtcaggctctttaacaaaaattcttacaattcagacctcctatcaacactgcaaagcaggcattattatcgccattagtcaataaggcaactggcatacagaaagtaactaagtaacttgctcacatgctacttttaagtgatgattcccaatttaagttccagctgcttttttgctatgttgtcgtgctgttaataaaggataaatggtagaggtttgaactttaacaacaacttggattatgcttctaaaaaaatggaagtggcgctctagactaggagtcaggaggttcagactgttactatatttttctattattttggggtaagttacttaaattaatttcattaaatatgtttaaaacacttggctatgtttctgctaaggtttacatgtaaaatgctttcttattttaatcattttcagaatttaaaaaatttccttcgaagggatcaaaagtattttatgaatctgttttaatatttttttttctttttttaaagtcattcctacactagccaagattacagtacccagggaaatgttgggaagatttctttagatcagattgatttggtaagtagaacattcttttaaacttagaactgtatcaatggagggaacatagattttcttaaatcaaagacttttgggtgaggagatagaatattatttcactgcttgctgattaattttaaagaaaatcccatgtcctacttagatgatttttaaaaaatcataggaaaatcatttaatcagaaaattatctgtacttttatgaaaacagaatttaatcaacgattccaaacagga

SEQ ID NO: 38612 - DNA, 1053 bp, Homo sapiens
ctaatgaaaggacttgggtgttgaacccagctcgaatgatttgaaataacagcttctgtttggacagcttatgtcctaacagtgtaagaaaaatgatgtggtaacagtcaatttcaactggaatttttctgtactattgtttcccaaatgatcataatgtctgatttctttctcttaatatttgtgtcctcatggtgacttatttgagatacattgctatgtgagtctgagcaaatattttgggtacttagccagtacttttgagttagcagagactggtataatatctccagcacttttgagctctaactctgcagctacaactacctttcctagatatactgcctggaaccaaatatttctttaccctaacttctagcgcagctctgttcttgaattgactgcctgatcggtatctgtctcttcctcccatctttacttacttgtgcttgttgcaggcattttttttttaacactttgcttttaaaactaatgttatacttaatgttggaggggaatgtgttgtctgtattctgaaataatttacacctgtattagtgttgtttgtaactgtcatccaaagtataaatattaaagtattgtgtctctagataccttttattaaggttaagcagtttttgtgttataatgcacataatttctgttataaacatttttgagtagtaataatggattgtggaagcagcttaaagttctgatgctcactgttatttttttattaggaatttgatgttgtaagagttaaagaaggaggaaagaaacacgaaaagcagctcaacagtcaaagacaggtttattttggagaataaacctgagtggggcttctggccgagtttggtcagtaatgctgtctcttacagactgagagtatttattggtgagagagcttggaatgtttctgtgtgggggagaagtttatggcagggttggaatgtctctggttggagaggagagtatgttggggctgacatctctccagctggaggggaggatatctcgggactggcatgtctctggtcagggaggggtttg

SEQ ID NO: 38613 - DNA, 1031 bp, Homo sapiens
atccaatccaccaagccaaggggattatcatggtaagtgcctccactggatatgttggccaagtacagaaatccaagagctctgttggaaacactgaaacaatgttgtggctttttgcattcctgtcaagacctagtttgtagcttatgtcagtcgtcactgtcaagctagagctccattactcttagaacaatttgtcttattactgaactaggtcaggcaagagaaattcattcagctgcacttcagtttgtgctggattaggcttttcagttctcactttcttccttcccgctgttctctgtctccctcatcttctgcagtgttctgcgagtgtcttagagggcgatgtaagttttacaaagctttttgaaattagaatgttctaagtttggaatagtagattcattaattttccaaaggctaactactaaggaaaagtgtgaggtttttttcttatcaccatcatctgattaaccaacaaagattaagtgggcaatttaacatgtcgtgatatctgccataactatcagttttcctgagttatttaaaaagaaaaacaaaacatctcatttgtctggtacgtccaagaatgaattaatagtttatatcagtaaattttctggattatcaaagcttactacagtatgtgtcaaaacttatttttgttttagaatcttcaacactttttaaaagactgcacacttttggactgctaaagatcaaataatcataaacaatatttttagaaagacattctatgtgaccaaatcactaaaaaatgcccatacattcattagttaatagatgaagaagtggccagcactcgttatatagatagacagataagatagatctatatatagacatagattttttttttttgagacagagtttcattcttgttgcccaggctggagtgcaatggcgtgatctcggctcactgcaggtctccacctcctgggttcaagcaattctcctgcctcagcctcctgtgtagctaggattacaggcacctgccaccctgcccg

SEQ ID NO: 38614 - DNA, 1050 bp, Homo sapiens
aaaacaaaaaaccaaagtacgcaggcaaccaagagcatgatgaatgcaaaggtacctcacatttcaatactaacattgaatgtaaataggctaaatgctccacctaaaaggtacagaactgcagaatgcataagaactcatcaaccaacaatctgctgccttcaggagactaacctaactcataaggactcacataaacttaaagtaaaggtgtggaaaaaggcatttcatgcaaatggacactgaaagcaggcaggggtagctgttcttatatcagatgaaacaaactttaaagcaacagcattacaggcaggagctgccatgccaggcattttgctcattgctttcaatgatgtcatgtcttttttgtccctcggtttctccattagtaccttcttttgcattaattttttttttggtagtgtacttagtcagttttgtgctgctataacaggatatacagatcagctaatttataaatgaaagaaatttatttctcacagttatagaggctgagaagtccgaggttgaggagcctatctctgatctgatgaagactttcttgttcagtcttcacattgcagaaggacaagagaacaagctagccaaatgccacctgaagctgctgctgctttttttctttataagggccttagttctattaatgaggaatgagccctgatggcctcatcatgtcttaaaggttccacctcttaatactagcagatttgcagcacctgaactttggaggggacacattcagaccacagtaccatagtaccatttttattcccatcactttttttttgatgtatttttttctcattatttgcttagtggttatcctggggactgtaaccttttatatgtataacaatttttaatatcaacttagcatctattatatacaaaaactccacttctgtatagctctgtccctcccccttatattgttgtcacaaattacatcttcatacattgtgtgcccattaacttataattactgttttatgcatctgtcttttaaatcatttgagaaaaaagaagagt

SEQ ID NO: 38615 - DNA, 1011 bp, Homo sapiens
cctgtaatcccagaactttgggaggccgaggcgggcagatcatgaggtcaagagattgagaccatcctggccaacatggtgaaacctcgtctctactaaaaatacaaaaattagctgggtgtggtggtgtgtgcctgtaatcccagctacccgggaggctgaggcaggagaatcgcttgaaccagggagccggaggttgcagtgagctgagattgcgccactgcactccagcctggcgacagagcaagactctgtctcaaaaaaaaaaaaaaaaaaaaaaaaaagagataggaacttcagaaacagagacagtatatacagaaaacagtatatacatgaattaaatatagaaagtaaatataaatgtgtatattaaattgctgtgaacaggatagataaaacggttttggaaaaactggataattttggaaaaaatagagtccatattcatagtatgcatttaaataaactccaaatggatcatcaattttaatgaactcatgactttaatagattctctttcctagctctgtccactgaaagggccaggatgcagtgacacgttgcaaacaaggttatattagtttccaaatactgttcccatcaaaagggcaggactccctggagtattacatgattccaggtcttgcattagatgaacatgaaacatcttgtgccagaaagcaaggaattgctgaaagagtgatgggaagatgtcaaaagaacataggaacgaccacctgactggctaaatttgagacaatgtgaaaataaaaaaaacgacaatgatagattatagaacattgaatatccagaaaataatgacaaggaccctcagactaatccagattgtaggacatttcctaagacaattgatctgaactcttcaaaaaatgtcaacgtcatgaaacactgaaatgacagtcactgaaatgacagtcactgaaatgacaaaaaggcaggacactgtttaagttaaaggcaggacactgtttaagttaaagaggaata

SEQ ID NO: 38616 - DNA, 1119 bp, Homo sapiens
cagagttaaaggacttttatttccaagggactagttccctttacaggaactgaacaccagtgcatggtggtgaatgcatggaattttaattccttgactagaagacaatatggccttcattgcaaatcccacaggggatccaaagcaggcagttcgagtgtatgaataattttgctttcttttaaagctgattgctgttttcttttaaaaacaatctgtcaagggagtttctaaggccatacttattttttaagtcttttcctaggtaccattaacatggctggctgtttaagacaagagtgctctaaaaagctttcctttaaatacagccaattcattcatttactaagtgaactagttcaagtatatttttgtcctgttaatccaatttggggaaagaaaaaagacaaggctcttaccaccctcatttgacctggggtcctaagcagagatctgggagaactgacttggtaaaaaaaattcttattttctttgttggctttgtgtcagttgtcccaagatcccatctgtaggctccagaataaagtttcctacagtgggtaatattaactagtaaatttgttaacctattcactgcatcaaaactgtagggaagtttaaattttccccctgaagagtgaagaatttgagtctgtaaaacaaactgataatagacagattaaaggggaaaaaaggcatatgaattttattacatgtacttgtttgcacgggaattatatgaagtataaaaacttaaggaaaggtaacatagttgatgcttttatatcatcttgaaattatagaaagaacagggacttggaatgtgacagattatgggggcaaaatgggttatgaaagggagagaaaagaaagacttggctagcaaaggtggtcttaccatgcaatgaaaaccttgaaggtagaatccatcagagagaatagatgctaaatgttttgtcagacctttaaaagcatgagactctcagtaaatctttcctagattcagacaaggggtggtgtggttcagagagagcctgtttgcatctgttgcacccttcactttatttcttctacagatgcaaatctccacaaaagtcagcttttcaattattcttgtat

SEQ ID NO: 38617 - DNA, 1059 bp, Homo sapiens
ccttttgatagagcagttttgaaacactgtttttgtagtatttccaagcggatatttggaacgccttgaagcgtatggtagaaaaggaaatatcttctcataaaacctagacagaaccaatctcagaaacgactttgtgatgtctgcattcaactcacagagttgaacatttctcttgatagagcagttttgaaaccctctttctgaaggatctgcaagtggatatttggacctcctttgggtcttcgttggaaacgggatttcttcgtataaatctagacagaagaattctccgaaatttctttggttgtgtgcactcaagtcacagagtggaaccttcctttggatagagcagtttgaaacgctgtggttgtagtatttccaagcggatattagagcgccttgaagcctatggtagaaaaggaaatatcttcccataaaacctagacggaagcaatctcagaaactactgtgtgatggctgcattccacacacacggtggaacatttctcttgatagagcagttttgaaacactctttctgtagaatctgcaagtggataattggaccgccttgaggccttcgttggaaacgggatttcttcatgttactctagatagaagaattctcaaacactactatgtgatgtttgcattcaagtcacagagtgcaacattcctcttgacagagcagttgggaaacactccttttgtagaatttgcaatgggatatttggacttctttgaggccttcgttggaaacgggatttcttcgtataaatctagacagaagaattctcagaaacttctttgtgatgtgtgcattcaactcagcgagtggcaccttcctttggatacagcagttttgaaacactgtttttgtagtatttccaagcagatatttagagcgccttgaagcctatgctagaaatggaaatatctccccataaaaccaagagagtagcaatctcagaaactaatgtgtgatggctgcattccacacacacggtggaccatttctcttgatagagcagttttgaaacactctttctgtagaatc

SEQ ID NO: 38618 - DNA, 1051 bp, Homo sapiens
taccttataaactatttggaagaagactgattattaacatcagtgtcttccatgtacatattttaaaaatatgctgtgactattggtttaatgtttgatattggcataaaaatggtttagttcttaagggggaacttagagaaaatataaatacattcatatttgtttatatttattggttacagtagttaccttgcttttgagacctgccacttccaccttcaacatccctttgtccgccttctctgagttggatttcagttttgagttgtatatgtgaaattttggttttaaaatacaaaagaacattattaaaattatgaatattttctttacagttataaatgagagttgtttcctttttagattcataagcatacattcttatgatatttcacataacaagttgattttcagagactcattttcctcgtcttcagtttaatgggaatgataacagattgttaaggataaagtgagattctaaatataggacttaaatcagtctaagaaaaggatataaaagcataaagttggaaaagaacttagatgtttcagtttatgagttaagtaaattatgcaagactaataacttcagagttatctggagtttgtattaatgtgtaaaaatgtttttgttagttggaaaaatcaacataaagtgtatgtaattacaatgtaaagaaaacaactatcgaaagggataattattagaatcatataattatatattatatatagatagtatatatacagagaatataactagatagaatatatatgaatatatatatgaatttcacaaaaatgtaacaatgggtttggtttttttttctgaggaatcttggtaatagatcatggatttcagtttaatctatctgactgcttgttttatgctgattgatttaatctgtactcaccccttgagttttgcaattcaagtaaaagtcgatgaagcggctcaggccctgctttagaaaaatagttgtgtacttaaatagtgtaaaaccctaatgtatttcttttgaattggaaaataacttattctctc

SEQ ID NO: 38619 - DNA, 1035 bp, Homo sapiens
acatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgt

SEQ ID NO: 38620 - DNA, 1371 bp, Homo sapiens
tatatcatagtagttaagaactgaccttagtgtaatgcagagtggatctgagtcctggctctgtcacttatttattttgtaatattgggtgtaactttgctaaactttagcccctctcttgtaaattggggatgatagtacctgcctaatggtttggttgtgaggattaaatggcatgatgcatttaatttgtttagcacaatgccttgcacacagtaaatatccagtgagtttaaccttacaaacacatagggcagttgtaagcacattgactcttaaatgaaattttctgggttcagattttagctctgttcttcctgtaggagatagcttaaacaaacaaacaaacaaaaccaaacaacttttagttccatcacctactatggcaaattatttaaactctttgatcctaatttcattttatttcaatttttatataatcaggataataatataaggttgttttgaggattaaatgaattaaaaaatgtagagcagaatttcttaaacttgactgttgacatttttggctggataattttttgtgtgtgtgtggggctgtcctagtgcattatagtatgtttactagatgcaaatagtaccctttccagttgtgatggccaaaaatgtctctagacatggcaaatgttctctgcatgggcatactcacctctgattgagaattatagatacaaagcatgtagaacaatgcctgtcttgaagtttgagcacaagaagttttgttttatcattactggtggtagtttgttcttctactgctactgcctattaggaatttgtttttggtaagcatgcctgatgaaattgcttattttaaacgatggtatgggggctgaaggcatcaagtgtgctccacttttaagacctttgtacttctgggtctttgtctggattgctctttggcatttatgcattgatcactacctcacttgagattttggttcaaatgttacgctgtgaggccttcacttactatcatacatagaccaatcccccatcaccaccaccatcactattgccttgtataacttttcttgagcgatattagtctcctgataaatttttgctcccctcacaccacccccctacacacacacccacagacacaaatgtagactacgtgagagacaacttcatcttagtatataacctctttggcctttgatagctttagtgatttattgttaggtgtgtatgtgtgtgtgtgtgtgtgtgtgtgtgtgtgtgtgtgtgtgttttaggaaataataggatagaattcataggtttactttgaaggtgttttaaagtgagtttttgtaaagtgtaatttttttttttcgagacggagttttgtttttgtcttccagg

SEQ ID NO: 38621 - DNA, 1029 bp, Homo sapiens
attgtttcctttgctgtccagagctttttagtttgatctaatcccaattgtctgcttctgcttttattgcctgtgcttttgaggtctccataaaatttttgcacagaccaatgtcctaaagcatttctcccattttcttctggtagtttcttagttttggatcttacatttaagtctttaatccattttgagttgatttttgtatatggagagagatggggtttagtttcgtttttctgcacatagatatccagttttcctagcaccatttgttgaagagattattccttcccaaatgattgttttggtgcctttgttgaaaatcagttggttataaatatgtggattcatttctgggtttctttttctgttccattggtgtgtatgtctgttcttaggccagtaccatgctgtattggttatcatagctttgtagtatattttgaagtccagtagtgtgataactccagctttattattattattattttttgctcaggattatgttggctagttttttttttttttgtggttctgtgtatttttttttgtgtgtgtggttttggggatttttttttctatttctgtaaataatgttactggtattttggtaggcattgcattttttgctcaggattatgttggctagttttttttttttgtggttctgtgtattgttttttttgtgtggttttggggatttttttttctatttctgtaaatattgttactggtattttggtaggcattgcattgaatctatacactgcttttggtaggtaatgtggtcattttcacaatattcttctaaccacgaacgttggatgtctttccattttttgatgtgtgttctctttaatttctgttattagttttttttgtagttgtccttgcagagatctttaacctcttgcttaaatttataccaaagtgttctacatttttcggtgagtaggattgctttcttgatttttttccccactagtttattttggtatatagaaatgctgctgacttttgtatgtttat

SEQ ID NO: 38622 - DNA, 1028 bp, Homo sapiens
gtgtttttgtctggttttggtatcagggtactgttagccacacagaatgggttaggaagaattccctcctcttcaattttctggaagaatttgagaattggtatttgttctttaaatgtttgatagaattctgcagtgaagactgggtcctgggcttttctttgatgggagacttattattacagagacaatcatggttgaacatgaaaaatacaaatttaatacgtgtagccatgcagatgagatggaaatacattggttaagacaaagtatatactttttatcaaatgttgaacaagatgaactgatgaaccttgtaagcacatacataccctttaagaataaaaatttctgtaagattgatgattaagattacatatcattttgagttttacgtagagaggttcagatgaatgtggagtatgttttgaagagagcaaaagataaaagagaggtaaacacttcatagaattagagctgtaacttagggaagaagaggaaatgccaaaagatcgaaagagtatgacctagtagctgccatagatatttggaagtttatcatattgataagagatttgacttctttatgaataaaagggaaagacctaggtcccttaggcagcagttagagggaggcagagtttaagtggctaaaagggggaacttgtggttctccaaaatggaataataggttccctggctgggcatataggattttcgcttttgctggttatgacccgttgactgaggtgtttcagtggggattcaggcatcagatagttatttgtattaggtgaccttttttttttttttttttttcgagatggggctctcactgtgttgcccaggctggagtgcagtggtacaatctcagctcactgcaacgtccacttcccaggctcaagtgatcctcccacctcagcctgcctagttgttgggactacaggtgtgtgctgccacgccctgctaattattattattattatttttgagacagagtttcactcttgttgctcaggctgtagtgc

SEQ ID NO: 38623 - DNA, 1047 bp, Homo sapiens
gaaggcagggattgcagctatgtatgttattcataccggcactagaatagtaggcatttagtaaattttgactggaaaaacgcacaagaaaaaagtgggaccagataatgagactagaagttaagaaaataaaatgtttgatgcaggtggggtacaactttgcctatcagatttatagcaattactattgaagaggaaacattccaaggtgaagaatacaatgtcctgaatgtaaaaacaaatttagtatctaggaaaaggaaaataatttttgacactaaaactggaaagaaatttcaaccagtgtgatataaaaaaatctttaacataatttcaatgaacatagggctttttcttatatccctcaatatatattccagtatgagcagtattacaggggctaacatcatggtctgactgatccaatcccaggtagattttaagttatctttcaaacagcctaccttggatatcagttctcactagattttttaatatattgataagaagatgagttatatgatactatctgagaactgttgagaatgtaattagccttttgttttcttttgccctatacataagttttattgatcaccagagctgggtatgagattgcataaatttaggctctgataggagtgtttcttagaataggaggctgttctgctgtccttgttgtagagcaggggtccccagactgtgggccatggactagtaccagtttggggcctgttaggaacccagctgcacagcaacaggtgagctgcgggccagtgagcattaccgcttgagttccacctcctgtcagatcagcggtggcattagattttcataggagcgcgaaccctattgtgaactctgcatgtgagggatctaggttgtgctctgcttatgagaatctgatgtgtgatgatctgaggtggaacaattttatcacaaaaccaccccctcatccgtggaaaaattgtcttccatgaaactggtcccgggtgccaaaaaggttgggggccactgctgtagaggacagggccaaaattttcctca

SEQ ID NO: 38624 - DNA, 1066 bp, Homo sapiens
atatataagacatttgagtgcacaccagtatttttacgtgtatttatattacttgtcttactgttttactgtattaatgtattttgtataacaaatacagtagatattaaatattttaaaatgttgagccatagataaaatatttatacttttcaaattattaactaaaattattagttgtataagaacttacttggaatgcattatgattgcacatgcttaattagttttggaaatttcatcttattttgataaaattttttacatatctggttccaagttgagcttgatactgggttttaatggctatcatagctgaaaaagataactcgattatacatacatttaaatggaagaaatttattgtagttattgtacaataactacaataatagaaatttattgtaagttataatcttagttttttttgttttaaatacagaaaagcttttattttagttaattagaacatttctgccatctttcagtgtgcttgttttttaaaactactaggaagtggttacattaaataattattactatatgagatcaaaattcactgaacttttttatttgggaaaatttttaaatgtccagattaaaaacattttttaagtgccacatttcattttttagccagataatacgtaacaatgaaaacatacctaaacatcaattttcttagcccgagttttttctttttaaagtaagaaaaagagtttctttcttatcactaaaatatcattttatctagaagggacagattaaaggtgtgtattttctcatatgacttatcacatctacttagaaaaggccagcacgtttctaacacttgtctcatttgtagaacatttattttgtaaaccaaaaatgtgtaatttattaagtataatagctcttttaagtcctttgctatgaattaatggataatttttttgtggcataaagattttaataatcacttcctgtttcattaaaattactgtttcgctttgtggtttttttttgttttttttttttttttttgagacagagtcttgctctgttgcccaggatggactgcagt

SEQ ID NO: 38625 - DNA, 1033 bp, Homo sapiens
tgtctttattaagatactaatggcgttttaaacagtttttgtctcctttcatagtttctgacttctcaatgttgcattattttaaaaaaaatgtttaaaaaggttttggcctccatctttcctagatgctctcctgaaatgtctgacccttgattattgctcatgtttaagggtagggaactaaaattatgaaacttctaagtgtggggattgggttttaccagctatgagcgtcagtgtatagcaatctggctgtactgttgtttggcagaacccttcctatcagaatttaggttattttccataacttattagattgctagcatattatggaagcctgtaagggaaactgactggggtttctcagatttcagtatatacaaattcacttaatcttacaaatttcaatgtactttacagccagtctcaactgtgcctcatgttctttagcctagaaaccttgctttactatctccagagaataagctacgagttttggctcaggactagggaagggcagttgcccaacaaatggagtaggggaaagagggatctagaaatctaactgctacttttaaagagctttcagcccttctaagtgttaagcatctgtcttcattcccactttagaatcatctgggaccaccaagtcttaagacttttgaggtgttaatggtgttagtttttgccaacactgccagcctagtgttttattaattacttttgggtctcttatgtcaaatacttggtaatcatctcttgtttggtttccaaaatttgctgctggtttttcctctctcgttcttccttgccttttggacttttcaaaaaatgtcccgctgttatagcttcagtagggttttgagaagtgaataaatttagatccatgtatttatttcatcatcttttcttgatctatgtttttaatacattttcaaaatcagttatttggtatatacgtgtggctttgagaaatgaaaagaatagaataaacattgtaggaaaataaaacttttttgcctatagaatcagg

SEQ ID NO: 38626 - DNA, 1489 bp, Homo sapiens
tctttagcactggaatatatttggttttatatatttagaaatatttaatgtttaaaaatccatgatggtcttgctttaatatgggcattaatggtaaaggaagctcattttacttacgtcactcctaggttactttttatggaaaagagatttgatgaaaacatttcttttaataaggtataatattagtctgaattttttagaggcttttccccctgctagaattcagagaactttgataaatataaaatttgacatatgttaaattatatatatgtgtatatatatcatgtcaccattatgagtactgttcaatacatttttgttgagcaaattatagctcagaataaagaagtgatatattctaaattgtattgaaataaaagcacatgacaaaatagctaagtatttttatttattttttccccctgtgatagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgta

SEQ ID NO: 38627 - DNA, 1031 bp, Homo sapiens
gaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtgtgtgtgtatgtgtgtatgagtgatgtgtacattgaaaataaattgcttttttgggggtgggattaatgtgagaattgttttaaagacattatttgatacacagagacctgtgcaaaaacaaaaagcttcatcagtcttggataaatgatagaaagatggatctactgaatttacaaatatatcatcctagaacatttaaaaaagcatagtctggccaacagctgacatacatggaaatattttgtcattgtcacaggttagacagtgtaatttagccactgcatctgcaaaaaagccaaacacttcctggtaattggaaaattgttatactgctttgggtctgtaagttatatattaattcatttggtgtgagaagaactagtaataaagtatgaaggtcataatggaaattctatttttcttttgaagtttttttttttcttaaaatgaaacatattaaagaacaccatttcataactatcaaactttatcttgcagtgaaatttgacagctaaacaattgttagattacccaggtcaacatgaaatagagtgaaaaacgtatttctttttttgaatgttttaaataattttttgtgaattctagtctttttaaaatttgagatgattttagcactgactttcatcattctttctagtattc

SEQ ID NO: 38628 - DNA, 1016 bp, Homo sapiens
ctagatttttattgcttccttttattttcctgattcaaacttacatcaaaggtgtatgattttaaagaccagattatttaatcctctgatttttaaaattaatgcaacttttgaacttcttttaaacgtaagtcagttggcattttgtaaggaggaagtcttagttttttcatgttatttaccttgtggtttctgtttttctacttctccagaagatgcttgagtttttagtttgcattacactttcttggccccaattgtagaagactagtatatcagataatatttaaaaaacaaacagacttagaaaatggatttatagctttcaaacaagaaaacttctgagaagaaattttcttctagaacaaatgattctatttttctctgcagattgttagtaacaaaaatgatttaatgtttatgtgacatagaattctctgatcttagaagagtgagtcttttctctctctcaaaaactcttaaaactgcattttttaacctaaaatataaactattaagatacatctgtagatggcactagagttttgctttttatagcctctcaagtttgaatgagacatttccaacttgaaatgaggcttattgaaagaattgcttgataaatttcacgatcatcaaaccactcttccctggttgtgaaataaaaatgtgaaaattccttaatatgtgctttatattttgacctttaggtttggatttggaacaatagcattatttgtactgtaggtttttaagtcatgtctcactgaaactatcccagacttgctttgaagaaatcttaatatacctttgattgtggaagtaaagggaaatcattagctttccttcagcatttcagaaacattcatgttagacagttgctttcaagaaatagcagttagcccattgttaggaaagctacaatgctcattacaaataatcatttttaatattttagctttgcaactcgaagtgggagaacttttaaacacctgcatttcaagctttattccact

SEQ ID NO: 38629 - DNA, 1023 bp, Homo sapiens
aggtcttaaaggtatcattttaatagaatattattttctttgaaaacttgctgtatgttgaacttatggaacggatagagatggaaaacatgcaaagtttcagaaaatcagatattgaaaatttaatttagcctcatttttgacatagattttcttgttaaaaaaagggataaaagttttttggtgttctgttttccaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggtgagctcttcattaatgcattattttgtttatttaagagctttttgtatggactgactgcaataattttgaaatttctctttagaagttttaatgttcttttacattttcaaatttagttttccatgaaagtgaataggtttttatttaaaattttttgtcagtcttggtgaaatcagatggtgacttttagaatatgcaggccttatctcttacagtcttttttgccatttctagcccctagtttggtacttgaattttctgttgtaggatgtgtgtggatcttgtggccattaagtgtaaattgtgcttgctaagttgttttaaaaaagcttttcagtccataaatatctaccagccctttgaccatttggcattatttttttgactaccttctgaaagtattttctaaatagaaatttcaagatatttaggctttaataggagaaatgtataaaggacacggcattttatctgattaaattttctttcctcattgtctacctttttattacct

SEQ ID NO: 38630 - DNA, 1050 bp, Homo sapiens
tatgtggttaggcaagtataatccaaaacgcaaagaacatgaatcttagagttggagctttagaaatcttttggtccaatcattttgatttattaatatgccttacaacatttctaggaagtgatgatctagtttctgtttgaaatccattgcaaggggatacatcttcatttttaagcatctaattgtcagaaagttgatcagtttgagctgaaatttgcatccctgaattgaagcctccttattaaaacttaatttctctgcaacacgatatggaagttaatttagattgaagagcatgaggatgtgttctccagaatcttacctattaacaaatccgtttctttcaggcattccttgtacgacaaatctggattaagttctagtttgtcatatccttgtggcatctaatattttttgtctgtcaagactttttgaaaatcagattctgtccttctgatacgtgttattactttgttgatttgatcatcaaagtaattgataatatggatctgagagccacaatgagaacagtttatagcatgtctttggaaaacttctatttattattaactagtattaataatcacctcttacgtacagcttcttggccatatacatatgcagtacaatgagaaatatagctcattgtattgaccatagctgagttgtctctgtcttgcttaaaaagacatcataaaggctgagtgcagtggctcacacctgtaatcctagcactttgggaggctgaggtgggcggatcgcctgaggccaggagtttgagaccagcctgggcaacatggtgaaaccccgtctctactaaaatacaaaaattagccgagcatggtggtgcatgcctgtaatcccagctgcttgggaggctgaggcaggagaatcgcttgaacctgacggaggttgtagtgagctgggattgtgccactttattccagcttgggcaaaagagtgaaactccgtctcataaataaatgaaaagacatcataaaacgttaacaattttaacattttgagaacctctttatccagtctgta

SEQ ID NO: 38631 - DNA, 1033 bp, Homo sapiens
ctcccaaggatctcagaattccagttttactggtaattctttgtggattataattagaaccagagtagcaggtactctgatggtttattctacctcatgggaattaaaattgccaataggcatactgagaacttaattgatacacttgctagtatataagtgaacttaatttcatttgttttagaatatagatacttgtttctttacaatttcctcctttttccatatccagagccaaataagagaattcttactaccttatttttaattttctttctactaatggtattgggaacatgatctctatgtcctttgtttctcctttataagctattatgtgttctacacaaaataggtgcagaatagatttcgaatgaaagagtgaatctcattttactaataatcaagagttatttttgtacgtcttaaaaaacaaagattgtttagttattttcattctaatgaattaagtactcattttccaggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtagtgagatgaacagaaaaaattatatactaatatatttatatcttatttaagatacaattaattagtatacttagggaatttttacaaatttaacattattaaatgttgtattgccattaaggcaatacaaatgggttaggtgattggccttacttgtaattaaaaacttgctctaaattctggggaagcgctagtgaaattaagataagacccctcttctcatggcacttaaatactaatggaagaaggcagtaagtttgcaagtaagaaaattgcatgttattttacagcttgagaagaaaaagtggagtaatgggatggatagtcacaggtgggaagagtaatgggacttctgttttac

SEQ ID NO: 38632 - DNA, 1008 bp, Homo sapiens
ctaaaggctgtgcatgtgtgtgcgtgtatgtgtcagtgttagctctcaacaccaaaagtaggtctctgataagtacaataagcaaaaatcatgccagcgaacattttaaaggttcagaacatgactgatctcttgtgtgtgacatttacctaggtccaccagcagttttttgctatagattactctaggtaacagaatgtgattagatgcaacctttttgcataaaaggttttcacacaactgatataaatttgtataaggatatttgctacagtaggtgatttgaggtattttcttgaagtacactaacagagacttaaaattgtacattctgccatcatggtcccgaggatcagatgcttctggaattacataatctggaagcttttcttcagcaattaaataaagatttatttccctcaggtttttttatcttttttttggagacagagtcttgccctgtcgcccaggttggagtgcagtggcgccatctcagctcactgcagcctccactcccgggttcagatgattgtcctgcctcagcctcccgagtagctgggattacaggcacacgccgccacgcccagctaatttttgtatttttagtagagacggggtttcaccattttggccaggctggtcccaaactcctgaccttgtgatcctcctgacttgccctcccaaagtgctggcattacaggcgtgagctgcggcacccggcctccctcaggtttctttcaggtttctttcttgcaggtggttttttgctctgcagtttcctccaagcctgtcaggatttaaatatgtaaaatcttaaaactatgaagaccattacattgagtaaagctctttgatgcagtacctcgctatactatagattgcttattgttatggttatattgtgtccctgggtagacttaatacaacttttgggtaggtattgtaatggttctactgtacatgcttctccatatatgttgatttttatatgaaatgtgtgttttgctg

SEQ ID NO: 38633 - DNA, 1045 bp, Homo sapiens
cgcccacctcagcctcccaaagtgtggggattacaggcatgagccacctacatgcttcttttaattacttgttctccattcctctagttcttaaattctgttggtttctctgatcttgtcaggtttttttctcattttctccagttactaggttacagaattaccttgtgttttattatagtttgtaaatgagaaggatgggaaaagaattaacatcttttcataattacatctgtatttttcagcagcacagtttgaaggtattatgaatattggtaatttgtagagccagatgaattaagtcagaataaaaatgtgtacaggcttatctcttatccaaagtttcaaatgccaaaagccctgaaaaataaagttattttcgcataactaatttattgataaagcttaacctgaattgccatgtatgaatgttcatattcacagaaatattgtatatttaattacgtgtctcagacctaactggaatgttatgtaatatagagtgtgtgcaccatatttcatgtttaaatttaaaaattctgaaactcacagatagcaagaatttttgtttggagattgtgaacttaaaggtatttaaagtacctttaaaaattaagtatgttacttagagccattgtgacagtgagatagccatgttatccaatttttgtattacaatggcatcagaatgttagccccttattctagaaaatactggttgtagttcatattaactctacatgatttatctgattcttttgttcataatatttagttacatctcaggcactaaacctccatatagacctatgccagatctagtttgaagctcatctagaggccttgatttgacatatcatacttcttcatacattcctttaccttcaccgtatgtaatttctcctcctcttatattttgaaaataatatcacctcctcttccttccctccatatctcaaatatgcacatgccactcttctgctttgaaactggctgcgagtaacatctgtatcagaaaatgccagcttgttctttcttaaggcca

SEQ ID NO: 38634 - DNA, 1032 bp, Homo sapiens
acgttaggaaccagccgccaataagtcattggagaagccagaaggatctgaaaaacaaaaagaggaggttgactctatgtctaaagataccactagtcaacacagacagcatctttttgatctcaactgcaaaatctgcataggtaattggaagtttttcttcgtaaaattttgcattcattatgaaagaaggatacttagatactagtatatgtaatttaagtaggttttgttttcccaatattggtggtgaggcactcactcacagtctttaagctttcgtgtgactggttttctgggttgaggtatagtttgatactgtggtatagtctactgtctagacctaattatactatatatgatttgaacttaaaaactgttcttgctggagtcaaatgacaagaatttaaccattagaatgaacatcaaacattgtgggcagttgtgatgatactgtcatttactaaagtaaaggagtaaaatagcatttatattttattatatataacataagacaaatcagaaactgaaattacttttttgtaaaaaagctttttatttttaagagcacttttaggttcatagcaaaattgggaggaagttacagagatttctcacatacctgctgcctccctacgtgcatagtctccactgttagcaacatcccacaccagagtggtgcagttactacagttgacaaacctacattgaaaaataatgaccccaaatccatagtttacattggcgttcactcttagagttgttcattctgtgggtatggacaaatgtgtaaagacgtgaatctagcattatagtattatacagagtattttcactgccctaaaaatcctctttactctgtctattcatcccttcccccaacacccccaccagcccctggaaaccactgatcttttcattgtctctgtagttttgcttttttcagaatattgtgtaattggaatcatctagtatgtaacattttcagattggctactttcacttagtaatatgcatttaagcttcccctat

SEQ ID NO: 38635 - DNA, 1025 bp, Homo sapiens
tatctggctccccagaatacctgacagaggtactgtgaacttttctgcttttctgtgcatgaattgataatgtgtgtttctgaaagtaattgacagggaaataagacagagttagtaatagaaatatttattaacaatgatttttaaacagtccaagtaatataattatgaattaacaaatggatctttagaattgtaaaataaactattctctgaaagttttaaactcctatgtcctgcacttttcccaagatgtactgcctcactgtgtcagataattcaaaatcaatgagagtctacatggatatccaagtttttctttgaatacacacttaaataaaagatttacatacttttggtctttaatgttaacacattaagaattttttgttaaacagatcttctgatttccccactgcttatgtttccccatcttcatgactactgttcttacctgcctatttctgtgaatgtggtttatgtagactgggagttgaagctttacagctagttgaaaaccagtgagactagtgactgtagttgctgcaagtgatacccttggttggttctacacctgagggaaatagaaagaaactattatgtggtatttatggaaaataagcagcagtaacattataatattgtgataaatgagacagtgacatttttgaattattttgaaggaaatgtatttttatatgtgtatagaaggaaaataaatcagtacatatatactgtatttatgttgagatcatattttgctatcttgttcgtatctgacctttttcatttattctctatctgctgattttaaagaattaaaagattgtaaaaaaattccttttattatttgaaaaagcctaaatcatttgcctgtcttttttttttttttaaggctaacataaacttcacttttctttggattaggctgcaattagtttaattcaatgtaatactgtttatgtaatattgatcagtttatttggttagcagttgtgggtttgtttttgtttttgtttttgttt

SEQ ID NO: 38636 - DNA, 1031 bp, Homo sapiens
atcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattc

SEQ ID NO: 38637 - DNA, 1046 bp, Homo sapiens
taaagtcttagtgacctttgtgtaaggttgtgggttttgtaggcttttgtgattcttcttcttatcaggcatttatgcatcagaatcctgtcttcatcgctttcccccactctattgtcaggtttttgccttccttcctttctctgtctctttctttctttctttctttctttctttctttctttctttctttctttctttctttctttctttctttccttctctctctttctttccttcacgcaggtgactccatttcgatttagacaactttcacaatatgtaagtgaataggtgtggctgcatgccaataaaacttacaagagttgggtatatggctctggattcaccctgtataccaacattattaaatgctgagaaagtaggagtggcctgagaggaagccgagggagtcctcaatggagagcactgaagtctagcaaagagcccttgagcaaaaggcaaaaatgtgccccactacccagagatgcccaggctttgaaatgactgatggacaaaaaaaaaaaaaaaaaaaaaaaaaaaaaaaaaacaaacaagaatttgaagttgatgagtcacaaataatttacaagtttatttaccatttctatgctaaaaggaatatgcaaaatagctaagtaaagtttctatatacatattacattattaaaaactaacaagttcaaaaatgaacacataaaatgctacatagttactttcttgactggccttttagtctgtgtacttttgagtatcaaagaatctttctctttaaaaattaagtataaactcctaaggtgaagaatgtttcccatctaaagctctgtgtgaggatacttctggaacttggagatcttaacctatgtaatggtgatggtggagatcgagctgttagaactctctcgggcactgtggtccttggagatgccctcctaagctgctttgtttccagggaagtgatggctacatgttactctccagcaatcctattctttttctctgtcctgaacatttcaatcccagccttttgggaaagagataataat

SEQ ID NO: 38638 - DNA, 1114 bp, Homo sapiens
gagatagcgccactgcactccatcctggtcgacagagtgagactctagctcaaaaaaaaaaaaaaaaaagcagtgttcccattttttcttgtttattcacacttctgtattatttttgttttattcttgtccagtgttactttacctttttttgttaactggtgttctttttcccaacctgatatacttgatattcctttgtcagatgtattggcaaagtaggatgtgtacaggggggctgaggggaactagtaacaaggaaacaaagagcctttatttttttaagaagccttttttaaaaaatgcaaaatgcctaaaggctcttgttttgattcgtttatgaaaggaaaacaaaccagttctgtatctatggtatattgttgctctttatcttccccaactctaaccttgaggaaagaactgccatgagctttgtcactatttgtaaagaaaattatttttcttaacgtatgttggagaagactgctaaatagaacttgtatcagactagacagattttaatcgtgactttacatgcaataatgataataatttcatgtatgataattctgaagatatgaagaaataggaaaaccaaagcaggaaaaatggacaagtgatatgttacaatttctcaggagacaccacttgctcccgttctctttttatctcactcactatgtgatctcatctctcctgtggttttgagaggtgaagccaactggacttcctgggtcaagtggggacttggagaacttttctgtctagctaaaggatgataaatgcaccaatcagcactctgtaaaaatgcactaatctgcgctctatgtctagctaaaggattgtaaacgcaccaatcagcactctgtaaaaatgtaccaatcagcgctgtgtctagctaaaggactgtaaatgcaccaatcagcgctctgtgtctagctaaaggattgtaaatacaccaatcagctatctgtaaaaacgcaccaatcagcgctctgtgtctaaaggattgtaaacacaccaatcagcactctgtaaaatggaccaatcagcactctgtaaaatggaccaatcagcaggatgtgggtggggaaaaataagggaataaaagctg

SEQ ID NO: 38639 - DNA, 1043 bp, Homo sapiens
aaagcaatcaccactggcatgaataagtactgcatgaaaagggagtatcaaattccagttttgtatgagttctgcaaaaaaagcctaatattctgtggtcccctcactcagtctctcatttggtaaacagaaagctgttttccctacaaggtgcttggtggtgaagccaccaagctgtctttggtactcttaaagcttcagtggcctagcaagatctttgggcccttgtatccattatccttatgacctcatcaccctcagactttaagacaagaagccaccatcaaaacaaaggatgggatacgtatagaatggactcacttgtcctagaagatgaatgtgtagtgtcagcaaatgcatgttaagaaggtgaagcccaaaagctcttaaggagaattgtatttctccagaagctgcagcaagaggtacagctcaacaaaggaaaaccacaggactggatatgcaactagtgctcagaccaaagagttcacacccactctaaaaccatgtcctctgaaaagaaacaaaaatacagtgatcatcaaatgcctaaacagtctttctgttggttagctgtacattcattgaggaactgttgattggcaggcactgattctctagaacactgggcatgaggatgttgcagaaatctagatggtgggtcccacagatgtgagaacatgctgcaagagcctgccagccacagcaatcaggactcacagctcttcaaggagcagtgcagatttcaatttggctaaaacaggatgattgcttttgtctgtttactgaaaaatgagtttagaaaggctagcccactgacattggaaaaagctgtgaacagagttgtgtctgaggaatgtgcctaatttaaggcagggtttgttccaatgcatccgtgatttgaaccggttttcattatagattaatgaactgctggtcaggtactgtctacaatggctgtgcatacctataacattttaggtatttcatattgaattatgctgtatatttcaattccaagtttatttattttccaaggttat

SEQ ID NO: 38640 - DNA, 1617 bp, Homo sapiens
tgttgtttctaatgagtctttaggttggagcttggctgatgtcatcgaagcttgtccacgcgtttgtggtcagctgtggactgattggtctaagatggccttggttgggacttctcagctctcctccacataatctctcatcctctaacaggctaggctgggcttaaacaactcttagctttaattgaattagaaaattgtatttttgcttagacttatcgggtgtaatagattattcaatgttaaaaaaagttattttaaaaaatctgtgcttgccttcagaaaggaataaacagattactaatgtatttacatgataattaatttttactataattacattgttttgccttaatggtaaacagaaagctcagatactaacaatctaaagaaaaactagttttattttaattttactctattctatcattttgtttaatagagtggatttttaaactctgaaaacgaagtcaaaattgtaaagcactgatcataaatatgatgctattaaatggaatgtggatgtatgtcttataaatgagtaatataaattatcttaagatttgtattatattaggagtatctaattacaagataatagacttcccaatgacttcattcaaaatacatttgtcaagaggactccaaaggagaaggaaatattgccctttaaatagacacagaaacattgctatttgaacacctgttctcattggcataaaggataagaggatggaattaaattatggttgtagtaaatttcagttaggttttaaagtgggggaaatttttctttgtttggagatgattgcaaaattgttgaagtatctttttctagaatgctttaggtcagtgctattctcagtagcttgtctgcagatggtttgtgactggttcaggatgaagcactgttgccagaatggaaatgaatgctgctttcttcattaaattttgctaccaaaaaaaagttagttaaaatagtgtgctttgcaatatagttgatttactttattttactgcagattggtaacaaccatttcacaaaaatgcacccgtctgtgtaccatatttgaagtagtacagctttagaatattagcaatggcatcttgagtggagttgggtttcattcattttgaaaagcggcaaatatttagaagacatttagaagaactttgacaaagtgctatgctttaatcttttatcagactttgcaagtgaaatgttatcagtttgatttgtttccacatatcgttggaacagtcaataatccagcatgctactactaataaattaagtagtgaggaaaatattgttggagtcagaagttgaaagtagtactttgttctttatttatctggattactgtagaacagttaattgaatacctgtagctactattacttttcttaatcatatactgccaccatttccttgtcataagataaactactacaaagaacatattatgatttggaaatggaggaaagtaaggatatagatttagaaattatatatatacgtgtgtgtgtgtgtgtgtgtatatatatatatatatatatatatatatttttttttttttttagatggagtctcactcttgcccaggctggagggca

SEQ ID NO: 38641 - DNA, 1050 bp, Homo sapiens
tccatatggggttgtgccatttttgatctcactagtgctgtggtagaattcctgtttgcccacatgcttgccatcatattacacccatgtgccatttaactacattttggtcagtgacagaccgcaaatatgacagtagtccaataagattataatggagctggaaaattcccatcacctcgtgatggtagtagctttggtaacctcctagtgcaatacattactttttctatgtttagatacacagatacctattatcgtgttataattgcctgcagtatgcagtacagtacaatatggtgcagatctgtaacttagcagcaatgagctatgtggtatagtctacgtgtgtagtataaccagcaggtttgtgtaagtacactacattgttcgcacagtggcgaaatcaatctaaggatgcctttctcagaatgtattcctgttgttgaatgaagagtgactatattttgttagattgttggatttctgtcagtctgatagttgagaatggatatatttttgtagtgaaaatttatagtttttaaaattataagtgaaagtgaactctttttgcatatttagagtcatttgcatttctttttctgtaaactgtttaatcataccttttttttcatctttctattggttgattggtctttttcatctcaattttcttcttaattaaggtttgctggaatatatcaacagatggcctcagaacaaaagcagcttaattgctttgcctaattcactatgattttgccttcctttaaattttccttggtaattccatactatcttgtcagctcttcagtaattttacagatatactttttatactttatctgacattgtcttttagcaagagattgttctgaataacctagcccaccacaactcttaaaatggaagtgttttctttgatttttgaatttttttatcgcttacttcatattttgtttttaaaaataggtaacttatccacattttaaatttttgggctgggtgcggtggctcacgcctgtaatcctagtgctttgggagggaagc

SEQ ID NO: 38642 - DNA, 1051 bp, Homo sapiens
tatatagtagttctatttttattatttttattttttgagacagggtctcgttctgtcatccaggctggagtgcaggggtgcaatcaaggctcactgccctcgacctcttgagcttaagtagtcctcctacctcagccccatgagtcacatatgttttgtacatatggagcctaactttgttgcccaggctaatcttgaactcctggactcaactgttcctcctgcctcggcctcctaaagtgctaagataacaggcgtgagccacacactgtgtgtggccagtcgttctatttttaattttttgaggaacccccatagtattttgcacagcagctatactgtttcacgttttcaccaacagtacacaagagtttcagtttctccacatccataagtgctgatcatgttcataatactaacatgaagtaagaaataaatgagacaaggtccttgccttcgagaaatctccatttcttcctcctgaaaggctcttcccttttatcttcatttgactaactctttttcatggtgtttcaactcaaatgctatgttgtcaacaaagcctctcctggtttcacagcctaagttcacccccatattgtaagatgtcatagcactctgtcttctgtacacttagtgtagatgtaatttacagaattaggtgaggtcagggaaaatggttggtttttttgttcagtccacttagctgagaaaatccatggcacaaagcagctatatagtgaatgtgtaactttgcattatgaaatatattgcacattttttgacgattacataacacagtattttattaaataataaaatgaacacccaggtacccaacctttcatttaagaaatagaacattactagtactgtaaaatcctcctgtatacccctcttgacgtttgtgttattcttttgctttctttatagttttatcattatgagtgcattttgtcagtataactatattccaaggaaatatctggttgagtttgaaaaaaattgagtggcaagcacaaacccagctgtgtaagatagcataaatatc

SEQ ID NO: 38643 - DNA, 1038 bp, Homo sapiens
tagtcccaactgctagggagcctgaggcaggtgaatcgcttgagcacagaaggttgaggctgcagtgagctgcaatcatgtcacttcactccagcctgggtgacaaactgagaccctatatctaaaaaaaagaaaattaaaaaaaaaaaaagagtggtacaagtacagctattattataaaagaaaaggggacatactataaaagctgaatgtctgtccttcagtctaaatgttatataaataccatgctatcaaaaataataatttaatctacttgttataaaaacccactgtaacagaaattactagggccacatttcatgtttaaatttattgtataaacaactctcaaatattaccacattttttatatgtattagaataaatttagttgacagatggttaagtattttttctttatttttccaagtttcacatgtaacattttgtattactgacactctgtatcctacatctgttttttgtttagggttgtagcttcatcattgcagactccttcctacatcatgcgtatcgttttcattatacactttgtgccactttgctgctagccttcaagggattgcacagctacttcattacagtaacagaagagattccttcttgtcagaaactagaactgggtatgttaaaagtagcgagacttattctacagttcaaatcattctcttcagtcttatattgctagctatcagctttgccatagtttttctatactaaaactacagtgtttgtgtgcttcacttctctatcaattccatctttttctaccttgataatcactttttgcaatttaaaagtgtttttcagaatactaaaaaataacttcttggtgctaaatgtgaaatgagtcttttaaaaaaaacatgtcagtaatctgttcctcttaaaatataacccaaaaacatgttagaaagcaaatgtaattatctgcagaatcataggaaggtaaattaaagccatacttccaaatattttacagtctaatcagattgtaggtacttagggcatttttgt

SEQ ID NO: 38644 - DNA, 1023 bp, Homo sapiens
actactcaactctgttataacatgaaagcagccatggatggtatatgaataagtgaatgtggctgtgtttcaataaagttttatttacaaaaacaggtgttgggccagatttggttctcaggctgtagtttgccaacgcctacattataaagctaagaggagagttgatacctcttccacaaaataaaagtctgtttgaaggttatttttagtgaccagtagaagtaaaggccagtagcaagaaatagttttacatgggaaaggtaatcttcagggtatttttttctcttttttttttattttgttttttctttttttttttttaatttttatgtttttatttagttcccgcaagcagacagggtatttttttaaaaactatgttttactagagaaaaatattatagttccattaaattgttctgtttgtgtcacctgaatggaagttctgggaagagaatggtcgcaaggattagaggcaactttatagcttgatattcaatgggaaggaagctattctgggtggactaggaacaagaaggtaaacttaaaagagcagctggtgaacacaactttgagaagaagggacaaagaaaggggactaagacaaaaatcaggtttgtggaaaattagaataccaaagataaactttggaattttacctagcgcttcccttttctcaccccattccagataccaagatagggcctattttaattgctaaatgaatcatggaaggataataaagacaaaataagaaaatgtcctaatgttactcaagcaggaataagctttgcccttccctgcagtgtatcacaaaaactgtggacatggtagcatactgtgttatctggctcccatttatgcaattcaagaggaaccttgctaataaaatatcttgttcttctgagaatacagtgctaagcctacaggaactgaagtagtctaaaggtcattcagtgtttgtacagggacagacttagctacaataaagtatataggctgtctgataacgaattcaga

SEQ ID NO: 38645 - DNA, 1035 bp, Homo sapiens
attgtttggtgtcgtcagtctttaactactatagtaggggtaaagtggaatttcattatggctttattttgcttttctctgctgactcctgatattgagggtttttgttatgactttagttttgtaaaatgttaaattaggttgcctttttattactgacttattaagattatttatatatattctagttatggatccattgtcaaatatatttattaaattctcctagcctgaggtttatattttcgttttctcagtgatgtattttgatgagactaagtacaatttatctttttttcttttatgtttagtacttttgtgtcctaagaaatctttgcccaagtcatgaaaaatattattctgtatttgctttagagagcattagaattatagatcttacatttaggaccatgggtcatcttgaattaattttttaatttggtgtgaggtgtatgggtcaagattctttcttttttttttctgttcaggtttttgacatcatttattgaaaacacttttctgactctatggaattgccttaaaatctttgttgaaaatcaattgactaataagcatgagtctatttcttgaccttttttcctgttgcattggcctgttatacatctctatgttaataaataccacactaactttattgttataatattatactaagtcttgcagccaggtaatagcataagtcctccaaggttttcttcttttttgagattgttttggctattctagatctcttgcaattctatataaattttaaatcaagtgttaacagctcttttagaatttgtctagcaggttttctggtttttattggaaaaccttcctccacagaaaattttaaatcatgtcaatttcttttttttttttttttttaatcctcttgggatttcagtttacattaagtaaaatctatagatcaatttagggacaattacctccttaaccatattgattcggacaatttgtgggcatgatatagcttcctatctagctccccttttatttagaccttcaatt

SEQ ID NO: 38646 - DNA, 1029 bp, Homo sapiens
aggagtttcactcttgtcgcccaggctggagtgcaagggcgccatcttggctcactgcaacccctgcctcctgggttcaggcgattctcctgcctcagcctcctgagtagctgggattacaagcacctgccaccatgccccactaatttttgtgtttttagtagagacagggtttcaccatgttggccaggctggtctcgaactcttgacctcaggtaatccacccacctcagcctcccagagttctgggattacaggtgtgaggcaccacgcctggcccatagcttctcttctaaagaacattacactttaggaggggagatgatttattttaagacaaaaggtggtaaaggctatggtggtaatcataatagtttatatttatatatgctttccagatttatttcatgcagtacaaaaatacattggcaacactgaagagggagaagggaagtttaattctgacgggtgattgtggaaggcgtaatggaggcagtttctctccttaccataagatgccggattgactttttaaatacgtcatgttattaatactctcctttggaattttttaggtacgcagattttctgaggcattcttttgttttgagcatccaagagaagctgccattgcataccaggaacttcagtgagtagtataaattcaaaattaaaatgatattacttccttttacataagatacctgtctcagaatttatcagtgacagaatatacagtattaacaatataagaaattaggagaatttgaatttcagaaatcccatctataatcaaattgtttcatcttattagttacttcattaaagttccatactttacatataaagaagcataatgcactgtattcctccctccttttttatcagatctaccataatcttggtagtctcatacagctttggctgtagccttccatttagccatattctgtctttattttcacaggccagaatttcttatgttcatccttttttattacagattttcatatatactgtcttctgtaa

SEQ ID NO: 38647 - DNA, 1020 bp, Homo sapiens
actctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatg

SEQ ID NO: 38648 - DNA, 1128 bp, Homo sapiens
tactcctcctctctcctagctgcattcatgactcagtgggagtttaaagcagctcttgttggttattagttggtggcactttagggagcagtgaggactgggaatgccttgccagcttcaagtttagttttcagtatttaaagtgttatctacaggtaattctagctttgatttttgtttttttttttcacttctctattctttcacatgctctgaatagggcatcttgtgttggacatcaggagtagcctgaacttggctgagtagggctcctagaaaacatcgctgggcttggcaggtaccacattgacatgtcccatgcttgttaatgtatatttctgagattttaaaagtgcattcaagaccagcctggccaacatagtgaaaccccgtctccactaaaaatacaaaaaccattagccaggcatggtggcaggcacctgtaatccctacgtgggaggcggaggcaagagaattgcttgaacctgggaggcggagaggcggaggttgcagtgagccgagatcgcgccactgtactccagcctgggtgacagaacaagactccgtctcagggaaaaacaaaaacaaaaacaaaacatatagataaaattcacattgagcggtttcttcccactatcccctctccccagcccttggcagacactattgcatgttctatctctgtaggtttggctgttctggatatttaatataatacaacatatgaacttttgtttctgactttgacttcatatgttttcaaagttcattcattttgtagcatgtgtcggtacctcactccttttatggctgaataatattccattgtatggatagaccacaatttatccgtctattgatgaacatttggtctgtttccatcttttgctaggtttgattttgagcatgtttaaattggtatgaaagtgagtctcttgcccattcaattttgggtagtcagaaacataaggttttttaactctagagattgttttgtttagcctgtctgatattgagagggtaagctcattgctgagatcaaacactcgtttctttgttccgcagatcttgacttgaagacacactgttagatattgtattaggtaagagagctaaaaaaatttgtaa

SEQ ID NO: 38649 - DNA, 1052 bp, Homo sapiens
ttttttttgaggtggagtgccagtggctcgatctcggctcattgcaaactctgcctgccgggttgatgccattcttctgcctcagcctcccgaggagctggtactacaggcgcccgccaccgcgcccagctaattttttgtatttttagtagagacggggtttcgccgcataccttgtgacttctatgtcagtgtttactattattattaaaaaattatattattgagagtttattttttgagtcctattgagatatggattgtcatcaaacttttatagtttttatttaaagcttttcactgatgatttaggtcttgctgagcaaatttacctagtattatctttaattatcccaagctatatcacacaactcatacaactcttccccacaggttgaggagtccttttgtttaaaattgtttcactgtaatgctttcttactattaatgtcagtatttctacctcagatgttaggtagaactgtgtttaacttggagtggcatttagttactcagatgttaggtagaactgtgtttaacttggagtggcatttagttacagtatcatatagaagtgatttttaaaattatttcacttaaaacagagcttagataaagtgctcttggaaacatgctaatttgatgtttacatatattttgagtgataaatgtgaggaccttgagggtccgaaggaaagagaattaaaagtaattctaataatcttccattctctgtggcccctataccccagcaatttttggtctccatttgactagagatccaagtgattgatggtagaccttcagatgtctcttattgatcttttataaagcgtgcctttcattgagcagtgatgagctcaagcctaaacttaagaaaataaggggaattctgtgggaaataatatttgggatagctttatcttccattataggaaaaattcataaaaattatgtttagcctagggcgttatttagttcatgcatttctactcttggaagttgcttttggtgtagggtgatgatggtgcacagtgacaaaaaaattaaca

SEQ ID NO: 38650 - DNA, 1019 bp, Homo sapiens
acatgaaggaaatcaagaggataatttcattggattgctacacttttacctgatttatggctttattttactttattttattttattattattttttgagacggagtctctgttgcccaggctggagtgcagtggcatgatctcggctcactgcaacctctgcctcctggactcaaacgattctcctgcctcagcctcctgagtagctgggattacaggcgtgtgccaccacgcctggctaatttttgtatttttagtagagacggggtttcaccatgttggtcaggctggtctcaaactcctgacctcatgatccacccgcctcggcctcccaaagtgctgggattacaggcatgagccaccatgtctggctgattaattttttttttaactgtaagagtttgatcttttcaaatgtgttcagaaactaatttggattctttgattctagtatctcaacgtgtttatttttagattctgataagtgaaatggatgtccttgtggagctctggcctccccagcttatctatcagtcctgctgtcctcacctccttgcctctttccatgcttacccttaagccaccatctttctcagctagcgtgtgtgtttctagtgtagttggccctccatattcaggggtccagcatctgtggattcaaccaaccgcagattgaaaatatttgttggaaaaaatggatggttacatctctactaaatatgtgcagtccttttatttgtcattattctctaaacaatacagtataacaactattgacatagcatttatattgtatgtattaggtattgtaagtaatttagagatgatttaaagtattttacataagggacttgagcattcctagattttggtaactgcagagggtcctggaaccaaccccctacagatatcaagggaccactatacacattaggatgatctatattgaaatctacatggaacagagtgggacttctaattgtatgacttcaagattttgctttgtttaaattaataac

SEQ ID NO: 38651 - DNA, 1031 bp, Homo sapiens
cttttagataagattattaaaataaattattattaaatacataattttgaatacatattttgcttttttatgataacatatttatagataagtcctatgttcgaccaaaataaatacactttacatctcttgatactattatttattactatagagaatagagaattatttacaatacaattttattaaaatataagacaaatatgtacgtataaaatgagagataaattatgtccactaatgctacattcataggttatatgtcaaccacttggcaaatcgtaatgaacgttggcatttcatttctcatcagctttatttactcattcagaagtttctaccaatttctaaatgaagtaaatatggcatcagatttggatatagtgaatgttcataagaatttcagcgttaggtgacttttattgttggacactggtagccaggaaaatattctaaagttaatgacaatttatacaattcaactttggatatcttctatcagggccatagttgattattttgaaaataacattgtaatgcagaacgtaaattattccttaagagagttatccagtacattcaaataaattgaaaagcttttagttgccctcttgtttcccacagcatatatgtgtacacagacacacaatttttagagaaccatttctccataatttaacagtaagcattctcagtttttctcaagtgataccatagatttatttggaattaacatgaaggtacttttatctaagaatattttctagaggccgggcgaggtggctcacgcctgtaatcccagcactttgggaggccgaggcgggcggatcatgaggtcaggagatcgagaccatcctggctaacacagtgaaaccccgtctctgctaaaaatacaaaaaaattagctgggcgcggtggcaggcgcctgtagtcccagctattcgggaggctcaggcaggagaatggcgtgaacccgggaggcggagcttgcagtgagccgacatcgcgccactgcactccagcctaggcga

SEQ ID NO: 38652 - DNA, 1108 bp, Homo sapiens
ctctgccaggatgagttaggtgccccttctttcaggttccatggcactctaccaatgtcattataatggtgcttcccccattgtactgtcatcgtgggctacttggtctgtctctcccacatgacagcaagcttccatacagtgaaatttctacttatttctaaatattaagtgcctaacaaggtgccttgtgtctagtagaccctccataaatgcatgcttaactgagtaagtaaataatttttcttataagccttccacagaggagcttcagggtgagccgaagctgaaagaactaccaagtcttttcagttttcttagacgtaagatactgacgattcatttaaaagaaaaaagatatgggactagaagtaggagattagtgctttgcttgtagctttgccactaattaattctgtaagtcatttcacacatctgggtctccaaatcttcatctgtgatatgggcacaatcgtgtctgtgatccgagatggtggaggatactgtagagagtctaaaatgctatcattaaagagaaagagtatttggaataagaagcaatctgatccttttatcatttcctttcctcttctctgagcttgagggttgcctcttaactagttgctttaacttaattcctaaatccccaaggtctctgtgctacatagtagccaaagttatctttctttctttctttttgttagtttgagatggagcctcactccgttgcccaggctggagtgcagtggtgtgatctcagctcactccaacctcagcttcccaagttcaagcgattttgctgcctcagcctcctgagtagctgggattacagacgtgcgccaccatacctggctaattgtttttgtatttttagtagagatggggtttcgctatgttggccaggctggtctcattctcctgacctcaagtggtctgcccacctcagcctcccaaagtgctgggattacaggcatgagccaccacacctggcccaaagtgatcttcctaaagacttaacagaacacatcactcctcctctgcttggaggaggatctgtttattgcttgtctctcccctcaaccccaattctttaaaggcaggggtttct

SEQ ID NO: 38653 - DNA, 1033 bp, Homo sapiens
tataggaatgagctgctgtgcttggccctgaataataatttcttaatgtaatttcctataaacattaaattcccaatttatacagtcatcatggaatacctaagattcactacaaaatagcatcattgctttgtttaagtctcataatggctgaatatagaacatgtttactccaaactgattttttgatttttttcttctctttaaaataataaatactcattttctttacactagtgtgaatacatttcattcagcttccatgcttttctctctccccttccacatttacattttccctggatgtttcttactttccctttccccttggtcttattgtatttttcttccagttaaattgctcctagttttttttttttttttttttttttcctttctctctgtgcttctacctttctggaatggtgtttctccccatttctttgtacaaaatgttgctttcttttcctctgaaagctgtctgttcttaagagatgcattgaatttctaattacatgctctaagagtgtactgcctacgtagactgggtacctaatttacatattgctctatggtaattaatagagacttctagaaaatgtggattttagaaatataaggggagaaccctatttttcttagggttttagttatgctcaaatttcttagaaaataaggagtgaagccttaaaatcgctgaagttttctaatatctatatattatttctgaaatttgggaatagtcagatattcagtgaataattttaaaagtttttaccttctgttttggaagttgactactttgaaagttgactatatactttggaagtatatagttaagaaataaattagaaattagtttttatgccatgtggaattattatataaaaatgcacaataaagaagtccaaatatatttgtaacatagttaaatatcagttaaaaatatttaccccagtggctgttataatcattaggagtttctttactcagtgagccaagaatagatctataatctggcatcacagagctg

SEQ ID NO: 38654 - DNA, 1035 bp, Homo sapiens
agctattcacaataaatctgttatgtttttgtacttgtttcaagggtgacatgtaaagttagtggttgctctacagtaagcatctggtagtggagcggcagtgcagcatgacaaggacctggactgcagtgtcagccctgggaatgtgcagaaacggagaataggagaaaattcaaagggaggactggagttcttagctctccattggcttctggttggcaaaagagatgaaagaatcaaaatgttcttggttccaagcaagtgtgactgtgaccacgcagaagttactcaattctgttttaggtaaagaacaagcacaagtagacatgtggcctgtttgggctttgggaaagacaggggatcatcagttaccaatgtagagtgatggagaagaaataaggtccttggagaagagtgtatggaaaaagatttagggaatactggcatcttgggaaatgagaagagaaagatttgcaaaagggacaaagaagagaaaaactaggaaaatacaacatccacaggaagactgtctctcaaaggattgcaatgggataaaagtattacaaagaaaagaagtgaaaatgtgtgatgatgtagaaagccaggatagaaggcgaggggccagaacctagaagaaaactttgccatctaggagtggacagcatgtgcagtgccatgtgttaggaggacatccaatttcacaggaaacatgatgtcctggaaaaaaaggccagaacaacccagcaactaggtggtgtgcagacatagcaatcagtttttcaaaagggaccatgcagggtgaggggtgtccctgaaagtatcactgtataactaggatggggactccagaagagagggtgatatttagagagcctcgaatgaaaccagggatatctggttggaaagcaatcttgcagtctctaagagagatgctgataagtgcaaagcagttctaaagagcttgagataatgcaccaaacggtgcttgcaggggagaagggagacagattagggtgcataattgataaataaatg

SEQ ID NO: 38655 - DNA, 1050 bp, Homo sapiens
ttgctcctagtggaaatacagggttaggtcctatgagcctttggtcataacattttcatcaatggatcaatacataaccttattttatgtgtgtttctgtttaaagatacattatttaatatatattgttgattcattaacactgaactcacagtttgtaagtcatacctgaatgttgtttatcttacacatattttctccgtaaggcacatcacagccttcctgtgcttaggaatgctagatcacccttcagtctggttcagtgttagctgggaacatatgtgagaggagaggttcaaatttttggctggtctgcacatgtctgcaaatgacctcaaaagtgctgtattaacttagaggttacaaatcaattttgagtagataaattctcaaatatgaaatccacaaataatgaggatcagcaatacatagacagcatgtatgcatgtatataaatggaaagtttctggaaggattaaactactagatgaaagttatctttagcgaatagggctgtggggaaggaatgagacaaggtgcaccttttatcataaccctctttgccctacatgacttttttactgtgtgcatcccgtagtccttcttattctctgtctcctccttttctcccaccatcactatcatcgtcattctctcagcaagccagtgcattttctgaagaactctagggacaaggttttatttgagccaaattgctcatagtgaatattctctgaatcaggctcctggaaaagttggtctacataattttgcaaattaggagtattttacaaatgctaagtatgacacttagaacatgagttctcagggtaatttgtgtcacataatattaccccatatcccagcatgctgggatggcctggactttgggtaccttttgtctgtcaaatactcttacttaggggtcatgcacagtggctcatgcctgtaatcttagcactgtgagaggctgaggtgagtggattgtgttggagcctggattttaagatcaatctgggctatatagtgagaccttgtcaccaaaaaaaa

SEQ ID NO: 38656 - DNA, 1043 bp, Homo sapiens
tgtatggacctctaaaaataaaaatactaaaatttcttatatgtttattttccttaccaaatatgacagttatccacaagtggaacagattgtagttattgctgatcttatgtctgaaaaaccacatggatttgggggaaaaaaaagcatatggttatctattggtctacatagtttactgttgcatgggtagacagaagctttcagtaaaactaaagggaccttttctgatcaaaccctgtgtatggctgatatatgttctgccaatccagccttgtttgagtttaagggtgccttctggcctggggtcaatttctctgtgattggtttaatgtcatttgcccataagcatacattgcagggtgctgcccaagggcaagtgcacagcttaggtacatcatctcatttacaaatcaccatccggccatgtctatgagcactgagatatgaatcatcattatttatacactttagtcatatttgaagttcttcttactaaccctataaaactctcaaatgaattagaatcctcaaattcacataactatcctatccatttcctgtaggcagagccatatgcaaaactaacccattattgagaggtgcttggtaaacataggcacagaacagactctaatcacgtcttgtaaatctggggtccattataaataataaataaagttttattgaaacaccattatgcatattcattcatttactgtctgtgactattcttacattacaacaatagagttgagtggtaacaacagtgatctacagctgaaaaagctgaaaatgtttactatctggcctaggccagaaaactatactttctatcatgtgtccttgccgtgtaggcaggtgacttatggagaaatgggatgaaaaaaatggacatggtgagtcaatcatcagtagagttgaattgaaagaatgccattagttggagtcagagtcatggcaagagagagagagtgtaaggtaaagttgtgaggaagaagaaaccatgcattaagaagagaaacctggtcaggagacagaag

SEQ ID NO: 38657 - DNA, 1046 bp, Homo sapiens
acgaaaaaaaaagaaaaaaaaaaagagatgccataagatgagagaaagaaagagagaggcagagacagagactgagagactgatcatctggcatatggccctgaggcagagattagcttgttcctcaacttccctaggtttctgatagctgttcagttcacagacacatgcatgtaatgcccctgacctccaggacccccatctatggacagcaaggagctctttttgcaatcaaaagagagggaccaaaacagatcattatgtattgcgccataatgaggcaaatttatttctcttatttgtaagttcctatgggaatgactcccccattagatcacagtattgacgataagcatgaataagctaatttgggtagaaaagtcacttcatgtagtagaatgtaatgttgactgttaagatatctcatacatcatgaaattaaataagatttcccttttatttcatttgttcagccactcagtaaatattgaagacctattaagtataaagaagtgcaagacagcttgatggattagaacatgtatgtaacaaacccactcccagggaacatgtacaatcttgtatgaaagttgagacagatacactgatgactaccacacagagaaacctatggtaattaagtttgataattatttatagcagtcacattatgtactaaaacataaagaacataaggccattcaccatggctattgagatggatgaggctgagcctttgacgttggaagaacagtagcactgtacacaagaactgaggatcacttcttgccatcaagaccagggaagccatcatggaacatcgtgcagtgggcacaagagatagaatgcccattgcaacatcattggtaatagaaaaaaatgaaaatgtccataaggataataatgagtaaataactggcagtgtcattgtataggaaaataccatacagtaattgaaaggaatgaattagagctacatgaatctatattgatatatctaaagcctaatgttgagccaaaaataaaggtgcaaaaacatttttata

SEQ ID NO: 38658 - DNA, 1439 bp, Homo sapiens
aatattcctagccttcacgtggttttagtctaaagggagaacactcaggaaaaacagtgtgcatcaacctagagatgccatgagaatgaaatgtgcagtaactaatccatggaggagaggatggtcagagggggtcgtgtttaaattgggtcgattaaggttgcaaagggtcagcctattttaagagggcaggtgggaaggaataggaacagaggccaaatgcaggagataatattttgtaaactgttttgtaaatgataaattgtaccttctgtgtggaggtaaagtatgaggggagatttctgccttcttcctatcttgttcttatatatttgttcatatatttaacatagctacccccttatggtattataattacctgattaccttttaatctcatctgtgaagtccctaagtgtaggagcagtactttatccatctcttttccctagtgcctaacaggtccagacagctggtagatacaaaatgaagactcttttagttgaactgagtgaatgaaaggatggacagatggatgcatagatagatactctgtaattacaaagaaatgtacttgggctatgactccttcagtggaaaaaacaacatagcagaaaaaatgcaatacatggggtgtggtagaattgtaaaaatatttttactagaaatactcttggactttatgacaaattagaaattatttccttctatgcctggcccttccaaaatttcacattcatgcatacactagtatacttgttaaattgttggacaaaaatctccttcgatttagaagtctattatttcgttgagatgacagtttttaactagtaatgaaagttttccaatgaaaacactctaattttgcaatgtgtacctcaattttgtgaaaataaacggctgagtatactggaacaatcttaattctgttgaactccttaaaatgatattacatatcaaagagtacacctttaaactactaatggaggaaaatagaataactcaaggagagcaagcagacagctggaatttttgggaaatgtctgtggtatttgggtttatttttaagggaaagaaaaatttcccattaaattttataacacaataacacttttaaaacttatactcaaaaagaatctttataatgctgttgtaaaactcagattatattttattcatgaattacagatttcttttttgatgacggtggttagggtaagaagcggcttttataagctttatttatctcttttaattacctccttctcctgtctcaatgctcacacttacactcactttaaaaaatttttatctttcatgggatctatatctaaataacaccacatcatatgtaaattaagaaacattccaaatattctccgggacattgaaaggaaatcaagcaaaacattctgtaatgtgtaggcaactttaaaagt

SEQ ID NO: 38659 - DNA, 1030 bp, Homo sapiens
aatttatgctatgtccaaaagatcccaaatacaagttcccaaaaaaggaaattaaagtttaggaacatgacctaagtatagtgctttcccattaaagtttggagcttttaaaatgcattcttcaattccaaaataagactctttcaaaggcacttctttttcaaattttatggtgtgaaacacaaaatatattctttaaaaaaaaaagtacttctagtgttctcaaccattctttatatgtgcgttgacagtgtgtcctccgctttaaatcttcaagtatattatctgtactcactttggctacctattttcagaccatccagtttcagattttgtttggaaatacttctctggaccatcaccctactccccagagtttctaattctaactcatgaccttgtttccttcctccctcttcaacctgttacaatttcctaaatactttgcacatttacctgtaaaagctactgacttcaaaaggactttaaacattattccaaagtgctagtggacatggaatacaggagtgaacagaaagtgttaggaggggatgtagataatgaatcctatgtgatagggaagtgcaagaaaggagtgagagttggagtctaaagttaatacaaaaaaggaaaagttcacacagttaaatttattcctgaaatctctcaaaacgtcgggttccttgacaaataacaaaatgtattctaacaacacagtttgtattaatgaaatataattttagtaaatattatttggaaatcaggccgggtgcggtggctcatccctgtaatcccagcacgttgggaggctgaggcaggcaggtcacttgaggtcaggagtttgaaaccagcctggccaacatggtaaagccctgtctctactagaaaaaacaaaaattaactgggtatggtggcacatgtctgaaatcccagctactcaggaggctgaggcaggagagtcccttgaacctgggaggcagagcttgcaatgagctgagatcgtacccactgcactccagcctgggcaaca

SEQ ID NO: 38660 - DNA, 1984 bp, Homo sapiens
tttaaaaatgctgtcacttctccttgtttatatctatttttgcttttttccatacatttgacattttctttaaaatctgggcatataaaatgctgattaaaaatatttttatgtggagttgaaatcaatgtgtcaagattcttcattgtattttccttcaaaaaaggctgctgtaacataggaccaaatgttaagggtgcttgctggcataactccaaagcagtgtttttggataacaggagtctttaattcttaggtataattgatatttttagttagtacttttttcagctttgtttttggtttgatttggggtatatgtatgtatgtatgtttctataacaagttttgaatttttttgaagacttatcttcttaggccaccaaagcaaattagttcagtaattatagtctcagtttaccttgtttccctctcagtgggtcaaccaaaaccgcatggcgtactactctctgaagcctctactaccctgctcctccgtgttgacatgtggtcaggcaagccaggacttactcacatcagctacatcagttactggggtaagaaactctgggcttttcagatactgtcctccagaaacaccagcaccagcctttgggtttaagatcacctggtgagattgattatctttagggaatggtgcagatgggatagtttctagacaatttgggaacctcagaaatgggagtacttatattagaatgacataaaataactttttgccccagggatcttgcagtaaagattatcatcacagttggccataccatgaacttttctaagttatttaaatttaccttgaaatgttatcagtgtctgctgtcacagagaataaatgtatctggtattaacattttactcatgcttgccttgcctttactaaatcttatcttgtaattgaagaacttgactatttttaattctgaatacaatatgcctcagaataaggttttaagctttaggtaaggtaaagtttaactttagtttgtatctgtgacacctaacacaatactaaggaattcaactgaatgagaaatttattctaggcatccaccatgttcaaaacatactaagtacctaggaattacttatagaatagatgtaactctattgaactataaatcaaatatcaacatacaaagttgagtgagcagacttgtttgcctcttttcattttttgttacactgatggataccacatgtcttaggtgattgggggtgcggtggctagtaattactgccattattgtctgtgatacagcagtgttcagatagcagctattctgcttataatcagatgaacaagatattatgtttggctttgtttatggaaaaaaagaaattttattaaattgtggttagaggcctgttagcataaaggatgaatggtttcttggaattacaacttgaatattttgagagaaacaaatgaaaagtatctcactgtagggctgaattggtttgtgaccttgcttctctagctgaaatctattgactctctcagaagtattgctaggagaagaaataatcctataaaaggacattaagcaatgctaagaaaaagatgatgataataataatgctttcagctcaccatgtgccaaacatcatattaaacactttaagtgcattattacattgaattctcacaaccctacaccatatcctcattttacagatggagaaaattgaagcctagaaagatcaagaaactttctccaggccataaatagaggaatcaggattcaaatcagatagaccccagggcttgttctcttcaacaccacattaccctacattattattcaattattaaataaaaccttgcattagtggcatttccaaatgcataacaaaaaaataaaaaaaagtaacactggtcatatgtatcgtattttttataaaaattacattattccatttgtttttctggaaatttttattgcattgagttgctagaatacca

SEQ ID NO: 38661 - DNA, 1028 bp, Homo sapiens
aggatgttgacccccttatggggcttcatcttcatgacctcatcgaaacctgatttacctcccaaatgtctcacctcctaataatatcacattggggattagagcttcaacatatgaactttaatatgttgaaaattcagctcataacatgactgggtcaaactgtgtaaaattttggcagatttgctattgcttcacatagggtcctacccgtttccaatataagaaagagtaagactttgaaccttgccaacaaactgtattatcaaattttgtgatgttccctcgagctgataggtcaaaatgatagctcagtatagtttcaatttacatttcttttgttaatatatgaggctgatgaacatttcatatgttcatcatttagcactttagcactattagcactttatttttctaagaagtaggtattcacagtctacccacttttctgttggattgatgatccttttcttatgtgtatgtgaaaattgtcatttttctttgatataagctgtaaatacttttgccagtttgtcttgtgtcttgacttttgttaagggtgtttttatttttcataataactttttaaaaatttgtcttctattgcatctgtaagatgaaattataaattacttcactgcccatctttagtttgagaatctttatgggttgttttttttttttttttttttacttttaagtctttgatacatctgggactactgtggtacaggttatgagataagaatccaatatctttgtttgattttattgttttgttccttcttttaatgttactcaggtgttctgtatctgtttatttcttcagaaaaaaataggttaatctatcaaataagggaacatatctcaaaaagtcataaaagggctaaattatatgattctatatgattatctactgatttttgtcactgtaaacataatctggataattcagatttagaatgtgtgtgtgtaagtaaatatattttaggacagttcttaacttatcagttaattgtgtaactctt

SEQ ID NO: 38662 - DNA, 1028 bp, Homo sapiens
tacctgccctttacaattgctctgcggttgaccctttagtcgtattttgagttagcagatgaaaataaggtttcccttgaagtagtggttgctaagggcaactggtactgacgccgaagacgaatactctatctccttagtataatgcctactttgtgagctaaataaagagctaaattgtagagaagaaagttgtacaaatgtgaaatatcaagaaaggaatagaaacaggaatattagagatgggaaaataagaaaaagaattactataatcacttttttggtaactgcctggcattttggacagatgtccttatctcctgggcactctgcatttccacctttcatagctggaaaattaacattgttcactggggcaagactttcttttgtaatatgaattcatgtcattagttcttagtggattttgacaaaatggaggtgagactgtgatagaaatatttgtcaactttttaggcttggattttcaagcataaatattttgtgtcagtagaattgctttatgctatttggacaacttgtagtgtgcagggtcagttatctctaactccatgtcagtacagattgttttatgaacatgttggtttaatgagagagtcttcatatagaatgtgttataacagtgttcataatttcttcgaccaaattgcacttaatgtattcattgctgtgatttcagaaaggtttttaaaaacttcattgtatcctaggcaatgctgtttctaaagggtgagttcattactcctttatgagcatctgctcgatgccaggtgttttgcctgtctacaagaagcccacagactgggaagatggacataaaatcaagtaattacagatgagtacactgtaagctataatcaaggcataaatttgatgctataggagcacagagtgagaaacattcactgagtaagtcacatttagcttgcaggatggtttggagtttgcaggttgtgcgagaaacatctgcctgcagcagcattccttccatgattatcaaggttcat

SEQ ID NO: 38663 - DNA, 1026 bp, Homo sapiens
cctccaggcaaaggagccatcacatttttcaaaaaggaatgaggaggtggaattatttttataatttattttctgtaaattgttgggaaatggattattttttaaaaagaatatttctaatagcaatatagagaatggattgggcttaagttttcaggaaaaagactaactttgaagtatagatttatgtgttactaacttatagataataattaaagccataggaaatgggtgggagaacccaaaggaagcatgtggaataagaagacaagcaggaagaaggaaggaatcattaaaagcatatatgaatatgaaaaagaggagaaacgtgcacacgagacttggaaggagtgtttagagagttagaagataatcaggagagtgtgtttgggagcaagatgtggagagattttaagagagaagagttgataaggagtgccaaatcctgttagggctgtaggatgagacttgaaaaagtggatttggcaattaggccatttgaaccttagcgctggtaggttcacttcataaggtcttctttgttagaaaacaaaacataacaaagctgttagtgatgggattcaggattctttagcagggcaagggagtaaaagtttttctctggaggaaaaaaagggtaagattgcaggaaaatgaaataaatgttagggcccagtaaaggaagccctaatcatagaattgtaggactagctattactggttgtttaaattgtaccaccataggtcaaaactccacctaaaactattccggagaggtgaatattgtaattgcttatacagaatcctaattatgagctaataagaagaggcattaaaactagcaccccactgatttaatttggagagagacacttatattagctgtttctaagacttatcttttaattcttcccaaaaccagttatttcacagttggctcacagttttgaaagtagaactgctagagtaaagaaagaaatttacagcttcagatgtttagtttctgaaggtgtcagaatcccatat

SEQ ID NO: 38664 - DNA, 1078 bp, Homo sapiens
tgaggtatttaaataaactccatgttacatcttcatacatcattattagagagaatgctcaactaaattgttacattctttccacagcacaatagaattacagaataattcaaagcaaatacaaattattttcttagcccatcttcttaatttgtaatattgtcccagaatacccttccagaataaattaacatttacaaacaaatgagttttcaataaggatacattatgagtgtgaggttgagcaaagataaaatactaacatttgtgtagcaatgtgaagggctgctgagataacagtaggaaccaaatacacaatcaccaattcatgtggctcaagggaaataaatatgaacattcctgagttattggccaagattaaggaaatacaaggtttttttttcttaaggagtatgaaaaggtttaggaaacaggtaattttttgcaagtgataaaaaagtattaagtgcctggaatgttggaataaatagctatgatcgaagtagagaaagatgtgtttttaaggaacaaaagctccctttgttttgttccactctctgtggaaatgctttaagacttagccctgaggactgtgaagcatcagataagttgtgatgttctcccatgtcttcagcatgtgacccattcacacagaatattcagatacagatatgggttctaattgccaagtagtttacatttccctagacttcattgcaattgatttaaaaaaatggccactttacggtatgatttcacttcgtacaggtacacttttggcagattcagataaaaagaaatcattcatatttattatcattctgcatgttcagcctttttccttccttagaatcagtcttgattacttttaaagggactttactaatctttatcttcctctccatcctgccatcactgacctgcctcaatccctgttcaactctctcttattcagtctcctatgtggattgtcccactgccttctgtcctctgcgcagccacaaggcagtctatttaggatgcagatctgtttctgtcaccccactgctagacccccgcagtggctcctcacaaccag

SEQ ID NO: 38665 - DNA, 1010 bp, Homo sapiens
tgacattctggatacttccaccatggggcgtactaaataactgcttattcacttcagtctatatagtctagttgtgagaactgatatcctggatcattagaattcactgcgtgtctgtcagttatcaataggttaaaccgcagaaaataaagctagaatatgtctttgtattgaattcatttattcttttttcaatgtttgacatgtatgaataatacagatatactttgccaagatatagatgttagaattgtctctatagagtgaaagaaatacaagttgcttctttgtgaaagcttcatgctttcttaaaacaggaaactttaagtaggtgcagattgacatgttgaagcattttgatgcaactattcttaaaaatgcctagaggttttactgtccaaattttttttttgttttttgttgttgtttttgtttttttttttgttgttgttgttttgctaaagcacagctaatacaataaatcaaaatttgtaaaatgtaatctcttcccctgtaggattttgtggtccctttaaaaaataaggtaggaaagaaaatttcaaagcaattatcagacctaatttttaacacaaaagagctgtcagattttatacccttattactttaatctgggaggtaatttgttgtattgttataatgttgacaggctcaaattccctgaaataaattatcagaataagaagtgtagtataagatagaaaaatttatttttttgggtattgcttcttaccaaaaagaaatgagatttgtgtgtgtgtgtgaacatttaaacgaaagaaaaaataacaaactattaaaatgtagtattatgtttgcataaattgattttgcaataaatattggacaaatctttgctgcagagctgattattttggaattttgattaaatgaggcagcaaaagtcagaaatattaagcactataaaaatgaaatttggttaaaatgtcactcaaggtatagttatgtcttttctttttatcatgaattat

SEQ ID NO: 38666 - DNA, 1031 bp, Homo sapiens
tggaacttaaattatatattaacctgataatagttaacttaggacagaatgtaaactagatcccacttataaattttatgtgcacatgtttaaccattcatcagacacagaacttcttttattttgagacagtcttactctgccacccaggctggagtgcagtggtgcaatcatagctccctgcaacctctaaatcttgggtttaagagaccctcctacatcagccttctgagtagctgggaccacatatggtgccaccacaactggctaatttttttattttgcaggctgatctcgaactcctggcttcaaacaatcctcccaccttggcttccaaagtgttgggtttacaggcatgagccactgcctcaagccagaatgtcttgatgaaatctgaattaaaaagattttgtttccaccagctatccagggcaaaacagagtaggaccacattaatccttgatagtagctctctttactcttcctagatttactcttagatctgtacttctgaatagtctttactttcttaatcatatgacctcctacaataaggtttttgttttatttgggttttcgccaatgtatttgttgatatttaaattttaattgcaacaaaatgacaaaatttcatgacttttatttttttcaaataatttttcacattaagacatattttacatgtattaagatatgaaatgaaaacagggtggagaaatatttggaaaaatttgattatatgtattaagatgtgaaatggaaaagagggtggggaaaatttatggaaaaaattttgaagtataaaagggaaacttcttttagacgttcttaaagacatgaaatcacttcgaattttactctattgcaaagagaagaaaaagctacatttgagcttattaagcaaatacatttttgggttgggtggcagcggggacagggtctcactctgttgcccaggctggagtgcagtgctgcaatccacagctcactacaacctctgcctcatgggctcaagcaaccctcccacctca

SEQ ID NO: 38667 - DNA, 2328 bp, Homo sapiens
atagtttttattaagttacttctactttttgacaaattccaaaataatctaaatataatgttgatcagttttgttgaactcctgtcctcaactgatccacccaccttggccccacaaaggtgctgggattacaggcatgaggcaccatgcccagtgatcagttttccttccttttaagattctctaaaaatgaaacatgcataggaaatatatctactttcttaataatacttggtttgaactagaagttattctcaaagtgtgcttttattgccttgtttttaggacatttatttcaatccatacaaaacatccaaataatttggtcttggaatcccattcattagtgaactaaaggaccatccaaaaaaataacagtctggggttacacttgatccttggagaggaaatatttctagaaatataaattctgtcattctcttttctcctgtaatttacataacactctgatggcggttttatggcccctaacagagatttggcccagaaaagagatgcttaaactgagggtatacccctgctaagtcaaaatgaattgtgaaatcactagaaatggctacaacttctcttcatgttctgcaaattgtttcaagatgttttctataaactttcactacttttgctttatttttatttcatttaacaaatatttactaagaacacaccatgtgctagccactagatcttaagtgccaagtcactggtgagcataacagacattcttcctgtactacagagattaccctctggtggagaaaacagtaagaatcaaataaccatgcaaataaatacacccattaatttattaaaaaaatgtatattgagcgctccctgtgttatgaatctgtactagatttgtggaatatagtacctgaacccatgaatcttacattctggtgcacaaattaaacagtaagcaaataaacaaataagtaaatattatcatggtgggtggtgatatgaagaaaaataaagctatataagggcacagaaaatttgaggggttgaaataacatgtttagagaggaatggagtgagtgagggaaagaatggtaacagataaggtcagtgagataggaaaaggcctggtcttctacatggcaaacagtgcttgttattacaaatggtgaaagtgcactgtaacaaatacaagatgttaaaagaatggacaactggaagcctacccaagggaatcaggggaagcttctgttaagaactgaattgtgtccccccaaaatacaaaatttatttaactctcaatgtagcaatcagaaatcaattaataagctggcattggtaagttcttaccattcagtaattactttgaatgtaaatggattaaattatccaatcaaaaggcatagagtggatgactggattaaaaaaatttaaaaagcaaaacaaaacaagacccaactgtatgctgcctacaagagactaatttcaccttaaaatacactcagactgaaagtgcaggaatgggataaattattacatgccaatggaaataaaaagagaagaggggtagctatacttatttcagacaaaatagactttgggtcaaaaactgtaaaaagagacaaagaaggctattatgtggtgataaaagcgtcagttcattaagaaaatgtagcaattgtaaatacatatgcacccaacattggagcatctaaatatgtaaagcagacatgaagagatttgaagggagacatagactgcaacaaaataatagtgggggacatcaatacccccacttttaacattggacatatcattcagacataaagtcaataaggaaacattggacttgaattatactttgggccaaatggacctaacagacatatacagaacattctacccaacagcaacaggatatacattcttctgaagtatacacagagcattctgcagaacagatactaggttaggccacaaaacaagatcaaaattaagatccaaatcatattgaatatcttttctgaccatagtagtaggaagctagaaatcaataagagaaaggatcatggaaaattagcaaatatgtggaaattaattccccatgtgactgtgtttggaaatagggactttaaagaagtaactaaggtaaaatgaggttgtaagagtggggccttaatccaataggactggtgtcctccttatcagaagaagagacattaagaataaatgtacacagagaaaagaccatgtgagtacacagcaagaagtagccatttacaaaccaagcagagaggcctcaggagaaaccaaccctgccaacaccatgatcttggactcccagccttc

SEQ ID NO: 38668 - DNA, 1046 bp, Homo sapiens
ttataggcttggaagaagagaatgaacttacaaagaaatagcaaaggaattgtcacagacagaaattcatagagtccaaggtttaagaagccaggggaagaaggcgcttcaagaaggaaagagaatatacactctgaagtgagtagcatgcagcagcaagcctagcatatgaatgaacacttccgaatcctaaaagcaagaccagctttaaaatacttaaatctgtttgtcactgttgtcaatctttgaatctaataagatttaatttattttgtgtaagatttacctcagttaatagccgcttggaactacctttgaaagcacatctctgacacattctcagcctgggtggatatacgataacatcatcattctttgtattaaattatgaccataatgacagttggggaaaaatgtcagcaactaatagaacaccaataggttttcttgacaagctcacttggagtatcctctctggatgaaagctcaataattttttgctttactacctcctcctgttacttcactctgtactcccttatacttctgcataagaaaaactttattaacttcatgcataaccacataatttgagtcataattaagattcagatgagcagtaaaacaattttatatcaccacctgtatataccttctaaaaatagatgtttattagttacttagttttggtcagtcttcccttggaagataatctacgtggcaacaaaaactttctctctcctgtttgctgcattcccagacccaaaactgtgcctgatgtattttaggtgctcagtaatatgtacataataaataaatgaatacatgcttaaagtcgcacggcaggaggtagatataaaaatgctggttgggtttgcagcttagtcagagatgcaattcctaatatcaggttacacatttgaaatccaagcaaacatcttggcttgctaacatctctggctgacttttaagccccagccccatttcggatgtttccacatgaaagccaaacaggcattttgaactccaggcgtcccaaacgtgac

SEQ ID NO: 38669 - DNA, 1009 bp, Homo sapiens
tctatacacatatgaaatgccacttttatcatataccaaaatttcatttattttttgtgtctgtaactttatattttgcttcttaaatttacatctctattcatgcagtagcttcatatcattttaattactgaggctttatggtgttttatgtggtagagttactcattcttcattacacttttttcagaattttcctggctgctcttgtttgtttctttttccatataaactttagaatgagtttattttgttctgagaaaaaaaaaaagtattgacattcagggtgccattacatttacaaattagctgtgaaaggatgaatgtttttatggtacattttcttatccaagaacatagtacgcatttctatttatgtattttatgtcccttagaagcatcttaaaagctttcttcatatggttcttgcatatttctcattaagtgtttttctatttctgattctatttatggcttagcatatgtgatactaaaaaggaaggactccagctgttttaaccctggctctacctccaaattcccacagattagaagaaacagatagatgttataagtaagcagataaaagttttaagtgaaaatgagaggacaggtgggtagagatagcatattaggtgctaactagtttttgtcatcccatccaaggaaagccaccagatttgtctggcacacacaacatgggcaaagcacaatggagatagaaaggactcagaaggcagagcagttgtcatttagaagcagaaaagcagtggatccaagaatttttattaggcttggctccatataaaagctatcccaaataacagtgtctttcaacacaataaaggtttatttttctctcatgtaaatgagttatgggtataggcattccaacactgttatgggactaactaacgcatctgtgattcaggcttctttttttccctcattactatgtttagtgtgtgatctccatccccaagtttgcctcatggttcatgatggctgc

SEQ ID NO: 38670 - DNA, 1052 bp, Homo sapiens
ttttttcaaaacttaaagttttgaattagtgagtttcaagcacaacacaacttgtcattcctctagatttagaattcagattactattggtgactagtagttagaagggtcttctattaaacaaattggattgtttttatttttaagaattttataaatgtagtcattttagatgctttgaaaaatgaagaagctttcatctctcttctaatttgtataaaggctttgtttatataacaagtagaaatttaacatttttctagcattttaaaataaatttgaaaaactacttagacaatattatttttatctttttaagctaaaaacttaaaaacaaatttttatggcagaatgtgtatagctagtgtagcaatttcaaaactggatatttattttatttttgtttcttttttgttaatagtcttttttaagaaacatgaaactcacaatttaagattcatgcacatatgtgtgtacacatacacacacacacacacacacacacacggattccccaattcaaatttttaacataagatttgtgacactgacaatttttgtcagaacatatcaaaagctctaaaatatctcatccctttgacccttgaattctattcccaggagtataacccaagaaaacaagaaaaatggttctgtacaaataattttagcagtgttatgtatgatattaaaaagtggcagcaatctcaatgtccgataataaggggcataattgagtaaattatggttcaatagtagtagtgtggattacattgacaaaaaaagatgaatataaattgctaagaaaaaatatgataatctgcttatgaagtaatataaaatgagaaagtgtagaattaacataatataaattatgcttacatgtaaaaaaagatttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccacca

SEQ ID NO: 38671 - DNA, 1085 bp, Homo sapiens
ttgcccagtgaaaatgttctgaaaagaagctccatggttaaggtgtcaaagtgtcacatcagtgaatacaatgtttccttttctgtggcttttctaataataatgaatagccaggaagattttgtggtttacttgcagagatggcaccccatgactttctgtcacctttgggagccagcctgtaagagagtcccaaaggtgaagagactttctctcacctgggagagtaggggtcccaatgtctcgtagggcagtgtttctcaaacttacatgagcatatgaatcacctgggactcttactaagatgcagggtctgatgtagtaggttagagagttggaggaggtgaaaagaaaaatttgcatttcaaacaagtttccaagttattcaggtgcttctggtccataatcttcattttaagtaacaaaactttggagcattagaataggaaagacataccttagatgatgttattgtggccttgatatactataaagccacaaaatgagaggaaacatagcttaccccattagctgatgtatgaattaagaaaagaacgattcaggatcacttacagatctatgagaaaaaaacaaaacccaggcaaacaaatatgcttcctggtggtagtttctgtcttttcttaagaatatgttataaaagaacaggaaacctggcagttgctagaaaagcagacaaacctaactccattgtcccctaagtctgaaggacataatcttctgttttaagttttaggggtcacttaataccagatggttaagtaacttggtcatgctactaccaacaacctatccgcttcatgctctgccattgagcctatatctcccactggctgtcaactgccttcatacagtaatactggaagcaactgaaggtttattcgcttggggatgaattctatacttagttatcaagtattctagagtgacttgtggtcgggggaagggttaagaatctctctaggagtggactcacagtggagccctggttagaagatagcttcagtattctttattgtaaataggtcatttgaatttttaatgccatgcaattcaaggatcgccac

SEQ ID NO: 38672 - DNA, 1239 bp, Homo sapiens
gaggcagaggttgcagtgagccaagatcgttccactgcactccagactggtgacagagcgagactccgtctaaaaaaaaaaagaaaaagaaaaagaaaaaatggtaagaaaggcaacagaggtacaacagatttgctgagaaatcctatagttagaatggggaaggttttttgggaaacatgagttaaggactggatattgaagcctggaatggatatggatttatggacagggaaggatgatctataatacagagaagtataattcaacacagaaattctgatttctaggctattactggaatacactatttcaaggctattaatgactacatttatgttatttttcctaaaatatcaggaccttttaatctaatgactcagctcttctgtgtctctgtttttcttgcactttgtcttattgctttgccatttaaaaatccagccatgaaaggaattttggaaattgtgttcttttccatgtatgtaattgctccttaaaactgaaaagatcaattaggaaattattggctccttcgtacttcttttaccacctctatttattaattgattgaattgggttcgccaggtttagctctttaatatcagatcaataaaagattaaatgtttaaattaagtgagcacacatgtaactttcacactccttgcaatttctaggagccacatccaatcattcaggattgtcagtaacggcagcaatcaaggctagaatcagagtacttgcaacttttcattctttttcctaaacttcagcctacatttatgggaataataatgcagccatactttcctcaaactcagtttatatttttgtttgaaattaaagcagctttttgagacaagaattaagattgttgccctgatgctagtcatagtgaatttctaacccttctaacccttcttaaaaggagatggtcgtatttgtttcctttggatgccgtatcaaattaccacaagctgagtggttcaaaagaacagaaatgtactctctcacagtacttgatgccagaagtttgaagtcaaggtgtgtctgaaggtcatattctttctgaaggctccagggaagaagccttccttgcctcttcctaacatctagtggttcctagcaatccttgacctgtgttggcgtgtagccgcctcactccggtctctgcctctgtcatcacatggctttttgccctctgtctcccctgtatctctaactccaaatttctctct

SEQ ID NO: 38673 - DNA, 1050 bp, Homo sapiens
aacttgttaaacttttactttctttcagaaagcactgggaggcagttcagatgtaccagggtagacaggctagtgatcaagggtgagtcagggatttgctgacaggtactaatgggagtagtcattgaactaaacctgaagcaacagtgaaacaaaacaaggtttgcatcacttctaaagaagatacttagaattgttttcttcctcttgcttcaacaactacattggatatatttagctgaatgctttattttgactctaagcaaaatctcatagcaacatcttttctttcaaagtaccattaatgtaattttgagtacaggaataaggaaaaaagttagaaaatttcattgaggataataaattgagaccaaacactaccagataatacatcaagaacattaacattaacaacatccttttatgttatgctacattcttgtgttaaactaatgtataccatacattatagatactaatgtagtagttgcggaaaataatgacgctctttgattctatctagcagaactgcaaactcttaattataataacaaaagattatgtgttacactctaagtcttgcctagaatgatacaagatatggattttgagttattttaaggattataatccttatatttatgttctagttcaggggttgatgataacctaaggtccagaatttggataggaaaaaaaatgtatttgtttttcctaactctaactgatatttgatatctccttcaattattaatgtaagccacaaacctcaggggttatggcatcaatagaaatcctagattaattttaaattatatcacaggtattgaatatatctcaaatataatttatacttagcacttcttcagaattatgttagctacttagacctgctgtgataccttatttaatgcattaataaagaattcttttaatattttgataactatttctatatactcatttttccttggaatatttttattttatgcattttaaaacaattctgttgaaaatagttcctcgggcttcatgggactgccaaagtgg

SEQ ID NO: 38674 - DNA, 1045 bp, Homo sapiens
atactacaattttctttctttctcagtcagacaattcattaatcatctgatattttttataatactatacctaacatggggataaatgactgaaaaaacagggttgtaaaaatagaagcatagcatacattcctgtcctcaatgatattcagtctagttagttacatagcatatgaattgccattgtccatatcatatcttaaaataattcttatactgtatttttataatgcttaaaaaatgtactcaaaatgctgtcctctgtaagaactcattgaacaccttcaacagggttgttaaattggtaaagcaagatcctactaggtttataaataaagaaaaggctttcccttaagtagtgagagatgaagcaagaaaacactcagctctcccaaactgtagttcagtgggactttcatttcacatcatttccttagaaaaatcctacgtcagaaaatcttcagtctttttcgttgtataatctatacatctccgaaaagtgtaagatggcttgttaagaataaagtgtggtttggttgtgtaagaccaaccagaaaggggaaagggaagaggaatgatgttgagattgggagagtagttgctgtctgtgatcttttatacagttgatgtgtgatagttgtttgtttgtttgtttgtttttttaattccaacctgttcttaaatgcaaatacaaaaactagagaaagagatggaatcaagctaaggttaaactcaaaagtgacttcagtatcaacttgttggttgtatgtagcctttctgtcacagaactgtgccctgggttctttttactcaaaaagtattccataaaacaaccgcctattggtgcattacttcacagcctgttatgaatgagaatcttgagtcccaccccagacttaatgaatcagaatctgcatgttaacaaaattctcaagtgatttgaatatacagcaaaatttgagaaccacagatgactttcaattcacccataataactgagaaaagactgtaaattcctacaccttgttcttccataatttaagga

SEQ ID NO: 38675 - DNA, 1065 bp, Homo sapiens
ctgtggtttgcccatgactcaactttcttgaatgaggggagttaactcttggattctgaacaaactctaaattacatatttattttcttcctcctcatacttcttttcaccactcattgccatgatagaaccttacaattctgagaagtttgaattctcaacaccccaaaacattttcatttaaagttgaatccttgctaaaggtgaatccttgctctgatatttagattgagattctgttaaaagttcaaatagaataccaatttatccagctagttagagtgatttttggtttatattttaaagccacctggttatgaggtatctttacttactgcctattttgttggttgaggataggaattattaccagtcagaaatatgcttttgatgtcattggttagtcacttaattttcagctacctctgtttattggaataatgtggaaaaattaaaaaaaaatttctcagactttaattcaggtaatacctgctgttaaatgttactgtgaactacttcctccaactgctcacaagtagccaaagggaaggatttgaacttcattacattttatctctcctgccatgctctgccttccactctacagaaaagggacagggaaatagtccaatcataggtaggtggatggaaaaatacaaggcacaaatagcccacatagggaataatcataccttaaatagtcactgacaacatttaaaaaaatatatttttatttccatttatgtaatcaacttagggttgttattgacctgccactgaggcatttggtttttcttttcataggacctttttcatttatttcttcagaagcattatctaattaaaaacaaacatttaaattaacatggcctgtcaaggaagtacaaaccagtcttgagttaagctataattacaatgacaacaatgtcaaaaagaaaaagcaaaaaccttttttaaaacctgtaattacttcattgtttataatttttaattggaatgcaagtaacagggaattcaaatttcataaaaccgtggtctgtatatcttgttatcaaaatgctatcc

SEQ ID NO: 38676 - DNA, 1084 bp, Homo sapiens
aagctaatacctgaaggtaagtagaaattaatgagttaatggaaatgagagaagtttaggcaaagaaaacagcctaggtacagatttctgctttctttaggtaacaactatatctcaaggtaaacaagcttggaatgaaaagcagggtcctaaagaacatagtttcactctggctctgccccacccattgatatgagcaatcaatcatcttcaattatttctgtgagtctccaagttgtattcatacatgttcacaaccacagtccattaaacaatttggatcttcacagtctcctgaattgcctaaattccaaagtgtgtacagtttaggctaacaaacgagaacagccaatccatgtaaaataggggactagactaagttattttgaagctgtatttctgtcctaataacctatcatattgtgtttctgattttctacaagtattaatactataaaattaaatgtttggttttattagaaacagggcatagtggatatgtacagtaacaaaggacaggaagtgaagaatgaattgatcgaggttcttctagatagactctaaaagaatacttccaagagacaggaaatattgtatacccattgtcaatgtttgaatattattaatgaattaataattaaaatgtaaggcaagtttttacttgctaagaagacctgtgcattcatgtaacaaacaccatgatgaagctatagaatgcttccataacccccaaaatttctccatttctcttcccttggtactagtttctgacagtcactgatctgatttctggctctatagtttggccttttccagaatgtcacataacaggaatcatacagtatgtagctttttatgattggctttttttcacttggcataatgcttttaagatgaatccattttgttatgtgtatcattcccttatttcttatatttttgagttggatcccattttacaggtataccataaaaggataatttgtttattctttcattaattgttggatatttggtttggtgattatgaatgaaatttctataaacagtctcagataggtctttgtgtagggactttacttgg

SEQ ID NO: 38677 - DNA, 1098 bp, Homo sapiens
tggcttcatgcctgtcctccagcagcaggcagtcacctcctgcatgcctctgccacagcagggacctctctctcgtttcctgctcccagtctttctcataagcacctcacgcaggcctgtggaaaagtttataaataagtgtgggcttccctgtgggtggagttcctagatatttcaaactaataatagttcatacttgtcttttagaaatttgtgaaacttttagctaattttttcctactcacatttgtagggaggccacctatttttcccatgctttgccaaagattaaatactttgtatgtccctcttgaggggcatatcactctttgaacttaatttacttggctgccttgaacctcagctctctaatgggctcaaggaaagtagtaattttgtacatcttctggcttttggtcattgttagcaggaacaacgttctcttgtatctctctacaacatttaccaaagtggaactcctcttttcagcatcttaaacaaattttggatttgaaatggctcaaagcatttgggaactctattttacatacattttaaaatgaagcttctatagttctgtggtatcttatatgatcttaattgttaattagttggaaggatatgtgtcatctattagtaagttgtagagtttttgtttttagacattatttgtcataaccccaaagggtctatttctacataagtattgaaatcatttttcaaaaagcagcaacagaaaaagctgctataaatttcatggctaaagattgggagatatttgggggtgatggtatctgctgatattaaccttgtgatcagcctaaatttctatttattacatttttacttgtttttattcctataaatattatatataagattaatagtcaacttatggaacatttgtcactggaacatatttgtcattccctatttatatatatacaaatgaaatacacatacttgatcgaagtaaatgcattaaaaacaatcatctttaattcctttgaatctgtactacatacaaacgacatagttttaggattctctacaaattcttaagtataattaaatcagaattaaggtgatcatctacat

SEQ ID NO: 38678 - DNA, 1024 bp, Homo sapiens
acattcttgccagcatgatcccttgagtttatattctggttgtgggggaacagtgggcagggtggagggagaagaaatacaagcaataatcaataaataagaatctcagatcaagataaggaccatgcagaaagctaaaacagagcaatgagtcaaaatgaccaacgtctactttacactgggtggtcaggaaagtccatggtgatatttaagcagaagtcttaatgatcaaaaataagccaacactttgaagactgaaataagagtgttctgtgaagagggaccagatattatcaaaaaaggtcctaagacagaaatgatgtagagggtcttgaggatcagtatggctgaaacataccaataaggcagacgtgtggattcatgtactgagaaataggcaggaggcagctgatatcaaccttcctatatcacaggtaagctgtttagattatattataagcctgatgagttaccactgtggctttttaggcagaagaatgacttgatctgatttgtatgtatataaaacataatgctctatggtgattagactgtaggtaggaaacaagagtggaaactgggagacctgctaggagattattacagaagagacctagtggcttcaactaggatgacagtaacaaagacattaattcattcatctgtttatgccttcaacaaatattaactaatgatctactgtgtgccaagtcctctctagatatcaggcatgcaccaagggtcaaaagcaaagaaactgcctttatgtggcttatattcagtagaggatatagacaatcaaggggaattaagagtgatgggtctaattttagataggatggtcagggaagacttctgctcatacctaaatgaagagagggagcaagcattgcagttgtctgggacaaaagggactcagacagagagatagcaagaagaccctaggatgggagtgtgcttgaggagttgggataacagcactatggctggagcacagttcggtaggagacaaatggcaagagtt

SEQ ID NO: 38679 - DNA, 1085 bp, Homo sapiens
gtggccccagttatcatatcacaatctacttcatgagaattaatgggcttctttatagttaccttatttttaaaaccactgtgtgtgtgtgtgcgtgtgcattaatgtattaaatttattttcattgtaaaaaaatttattttcattgtaaaacccaatttttgtttccctttcatcgtgtcccaatctgggatcatccaacatggtttacatttaaaaatatttcactgcccacttcacaattggagctatctgtaaggctttagccaacaattcttgcagtggaggagagggaagcatttcatcatatggaaaaatagccactctgcaaatagtgagtctcccaatctttggccctagcccggaagtcctcaagtagtactctcctttcctcagatactttgcttttcctatttccacgtatgcaatgatcagaaaaggataagcctccagaagagaacagagttaaataattttgactctaaaacagaaatatcatgccataccaatacatgaatagagaacaaatgcatatatattgttttgttcaccttttcaaaaggaattttgaatttttgaaagtaatgtgatataatgtttaatgctgtatgcttaataaaaatacatacttttaaggtaacagctatgtttggattgtttgatagaataaagtatcaaaataaatctaagcatgatcaaatacaaaatcatagatacatcataaaatatgagggctatctgtatttttcaatccttagaatcatctggtggagtttctaaaataaaatatcgatgtctaagctccaccccagatcaattaaatcagaatatctggaggggtacctgagcagagattttttttttttaaagctctgtagctgattccatgtgcagccagggttgagaaactttgggctgattattgacaatttcctgtagaaatgcacagaactgcctcataagcttgagttctggacattgcagactgcctgctactgacatacagaaggaaaaacaaacccactaaaatgcaattctacaccttctgaaacttcttatttcatagctttgtctgaaaacaaagc

SEQ ID NO: 38680 - DNA, 1081 bp, Homo sapiens
tccacagcaagtaagccatctctacaccatctcaagcaacaggttgagaaagcttaaatgggagatatggttttaaaatggattttaatggctcatttgactgaaatttattttagggagaaatggattctagaaaatgttggcagttatatcaggtgaaattattttgttgtcaataatccaaaaatgagagcaatgggaagagaggaaagagacaaaggccaagtaggtctagctcttgagatgatggacatggtacctcagtaagcattgggaaacatctcacatattctgcttttgtgttaaagatgataaagcattggtagatgatggtgaaatgtttcagtgatggcttgacaagtaaatttatttcaggggtttgacaagaataaaatataatgaaacaaaatattataatctttgaaagatataaaatacaatgacggtaaatattataatctgcagaacaatcagttttgtttttaaaaacagaatctgtaagatgacctgaatcacacatttataaatcaaaaatatttagtatgaaatcaataattatttcgagaaagaaaacattattcatatatgtgtaccgattttattttccatacttttagagtgctgtattgcctgtggactttaaatatttaaattcctagtctgttattaatactaatttagtatttgcatgcgaatatcattttagttttatcattttcagttgtagctgaaaagctaaaactacttaaggattccattgtgtatacaatcataaattagtaatattagcccctaaaagttttatcaaagtaaatataccactgcagaaaagattccttcatttatttattcatccacaaattttactgctcactaatgtgtcaagctctctattggctttcacatttagagagaaatatgaaattctctcagccctcaagggaccctcgatctagaagggggaagggggcggggaattataaccaaagaatgccagtaaatttggtgcactgaaagaagttgttgcacatatagtgaaggagcagataaaggagtgggcagccttctggagcgtgagtgg

SEQ ID NO: 38681 - DNA, 1047 bp, Homo sapiens
cttatttgaaacccctgagttttgacaacatagaactgtgaaattttagagctagccaaatagaattgacatgcaatgaataggagttaaaatcattttaattttgaccaaaacaatagtattgactttaaccctacatcatttttcacttttgctgccaaccattttcttttgacatgtcacttacatttgttacctacttcacaaatgctcctgggattggttctccttacaattcatttttcataaaggaaagctggacataaatgcatttgaggttttctagggttacctattcagactcttcagtcacagagacaatcttatgcaccctctctctctctctctctctctcccacaagagctttcaggtacatcctgatgataaagagaaagacatgatgacttgagcagttctatgcagagcatcttctccacaccctataccgtggtcccacacagcgcagttcatttcatgcttccccatgaatgagagtattgtaagttctatgtgcatgaagaaataaatgattatcccattctccagaaacacaaatgccgtatcacaaagcatgcaccattttccttttaaaattccttcctgaaaagtgtttgtggttgttgttttgatgaattaatcatattaggacacagaacgcagatcataagctcagtgatgaagaaactcgtaacattcaagtttcaatggaaatgtttcctgctcagaaagtccccttgtccctttgtgtctcctaacctccattttattttatcataacaccaggttatgataaaaccataatacctggttttttatcataacaccaggttatgataaaaccataatacctggttttcttatttattaatgtattcattgtcctcttgtctgtctagactcgtaggctcttacgtgccttatcactgcattatctacagagcctagaatggttcctgttgctaatcaaatgtttttcaatgaatgaatcaatgactacagctagatatcccaggaattataaggagtaagaattcagagaaagaagg

SEQ ID NO: 38682 - DNA, 1051 bp, Homo sapiens
gtgctgctgtcaacactattgcattggagattaagttttcaacacatgaactttgggggacacaatcaagccatagcagccagccactatattttcatggaaagaaaacatattgagactcccacaaagtaaacttctttggatgccatgagtgtaaaatcttgatttgagcttcatttcatagccatggtggcaaatcaaattgttaaatatatttgtgagtctataattatggagaaagtcattgtctcataatatattccaaaaatgtttaaatatttgtttgtcctcttcttttttcagtgtctcatagtctttctcttttaccatgcccatttatttcttgacatcaccattcatgaaccttcccaacatggttttaagttcaagcttcttgttttttctgctttggtaggatcttgctataccattctcttgcccttcgaagcacaataaagccaataatagagacatcttcttgtatcagcattttggaatcaatattttcataggtcttttacagttaaatcagctcttggataaagtggaactttaagaaagtctggactttaaaatgactatattctggtaatcacaaagtcataaaacagagcatttcagtgacgatgggtcatgttttttcagtcttaatttagaatttttttcaactgactttgagttgctgttacaattcaacctgcctctggtgttttatatgccttaaaatttgtggctactgtataataaccaggaaagcgtagctacagggttccaattactttggcaaaggagccttattacattgtctccaactaagcacataattaatgtctctatttcaaggctatttcagcaaattcaaaacccagaatctatccatacatatttagggatgcatgggaacacttgtgatgtcttcattgcagcagacagtaataccagaggaatttttggaagaatatggaatactttatcatgggttgcaaatattttaaagatgtggtttgaaattaaacatgttgttctaaaaagtctccatgggaatagaatg

SEQ ID NO: 38683 - DNA, 1025 bp, Homo sapiens
caaaacatatgaaaaaattagctgggaatgttggcacgcacctgtcatcccagctattcaggaggctgaggtgggagaaccacctgagcccaggaggtcaaggttgcagtgagcagtgatcactccactgcaccccagcctgggcaacagaataagaccctgccaaaaaaaaaaaaaaaagtgtttagtataaatactgcttgttatagttacattgacaaatacccctaacatgctatcagagctcagccattaagttaatgttatatttaataggttattatagtgatactgtttagccaattgaggttttaattgtgtaagtaggatacattacaaattaagaaactttattggatttttatagaatagtggcttagtgcatgagttataacatagacttatgatgtgaataaacaacaaaataagatcaaattttggccagtattttgagcaggaaaaaatcaacatattaaatcattgggatattatttataattattaaaaactcatgaattcttaactagaattataccttctatattcattattagttatgaattaattcttaaatggctcaaatatgaatatcaccatgtgtaagatgctaaaccagtcactgaggaaaaacaaataaatgtgaaaattgttgacctttttaaggaatttatggcctagaatgtatgcaagatataaaatactaaacaagaagcaatttaaagcactctgtgatacccatgagtgaactggggtgtaaatcctctaatacttaaaaaacagaacacagtcactatgagattgtagctaggtcttcagagattaatatacttcatattagtaacatgtgcttgaaagttcatgagtatgtccagatacttcttatctcaatatttccttggatgtaattactctacttctttgaaatatcttttaagctggtattatggtttgaaggtatcctgcaaagtttatgtgttggaaagttaatccccaacgcaacaatgttgggagggagggcctaatat

SEQ ID NO: 38684 - DNA, 1034 bp, Homo sapiens
agaagcacaaaacagactaagctgttatttccatttcaagcattaggtttcacttagtgtaatacataattcataaatgtgaatattctcagttaggtgcacagaatgggattgatcaagcccccagttcatggtacacagacattaatagtcctgagattggcttcctttttatataatacttcattttaaaaattgtatttgtctaccctatctcctattttcaatcccattttccctatttgtgtatatttaatgtaggactgttcacttaatttttaaatttttatgaatgcatatatatgtatatttatatacatatataagacatataattatgtgtgggatatgtttttaaatttacaaacatttagttatataaatggcaaagagtggtgtatcagccagggttctccagagaaacaaccagtaagatattttatttatatagagagacagagagagaagagagacagagagacagattgctttcaaggaatttgcttgcttacacaactgtggggactgggaagtctgaaatctgtaggcaggccagcagaccggaaactcaggcaggagctgatgctgtagtcctgctgccgaatttctaaaggaactcttggttttgctctttagtccttttggccaattgaatgaggcccatccaccctgtcaaggtaatctcctttgcttaaagtcaactgattgtagatgttaaccacatctacaaaatgccttcactgcaacagctctattattatttgattactgggtactaccatttagccaaactgacacataaaacttgtcctcatacatggcttctggtttcctgttctgcttaagatttcccccacttcttcaagtaactttattttaatttataactatacacctagcttcaacaacagaatacacttgtggacttaggttgtataccatttcaactcaagaaaaagaatctgtattttctacagtccagtctagtaacatttctttgagatcaaacacggaggttccagagtttgaatgtg

SEQ ID NO: 38685 - DNA, 1030 bp, Homo sapiens
gggcctcttcctttacgtcccacaattaatagaaattactgtctctcacacccacctcatgtaccaccttttaaagtgaaagctttaaaatggttgtccctaggtgtccaagaggtattgattccaggaccccagggactggtttcaggacccctgtggataccaaaatctgcaggtgcttaagtccccgatataaaatagtgtagtattgtatatggccaaagcacattctctcatatactttaaatcatctgtagattacttataatatctaatataatgtaattgctatgtaaatagttgttttactatattttttatttgtattacttttttgttgcaatgttattattttttcaaatattcttgtcctcttgttggttgactctgtggatatggagagtcaactgtaccctgttgtactccttggatcaggcatttaggagcagtggctggactatgagttggttattctgggcttgctgactgtataaagatttggttcatgtcactgtcacccagagcctatggggccaggcaggatcagaggaggaaagagggcaagcaggacttctatgagagcaagagcgtggcccagtgcagagccaggcccaaggccactgatgcacaacattttgaatctaggaacagaaggaaagggaagggtgggaagcagaagacaaggcggtggtcctgtccaccctggaaaatgagtgcctgcctctgagaataggatgaattagccatgctcggtggtgctcctccaccgcagtgcaatgtaatggctcactatccaacctgcagccaggctgcctggcttcaagtcgtcactctggtacttactaattgtgtaaccttagggagattactcaagctcaacaagcacctgtttcttcatctgtaaaatgagggttataaaatcattaccaacctcatagattcctgtgaagattacttagaaaatataaaatactctagctcactcctgtaaagagcaacgcccgacacaggaagttaagcatttttgcat

SEQ ID NO: 38686 - DNA, 1050 bp, Homo sapiens
tatgagataaaattgatatgactcattttgcacctctaagtgacagacgatggtgccactagcagagccagacagccccaaaagaagatctggcttgatggaaagatgacaagtttaacttggggcacattaagttgttggtgctggcaggacattcaacaccaaaactcatgagagattttcagtggagagatcactcatgtacagaaaataattgaagccttggaattaccaaaggagaaaatgcctgagaacagaggcttaaggccatttccttaaggaacacccccacttgcagagcaagagcacacaaacagtgaatggcaagaaatgaggtgaacactttggaaagctgcagaagtcatagggggagaaggtgtcagaaaggaaagtccagacaagaattttattgtcgcaaataaatatggaacctgagaagagatgctgaatttgatgactaagagaaaactggtgacctttcaggaaagtagaagagtagtaagggtcaaaggcatgctgtgaaagattaaggcatgaacaggtggtgagcaagtagaagcaatgagcatagaagattttctcaagatggttgatagcaaaagcaaagacatcctagaattatcttaattttattatttgcttaaaagtcacaaacttcacttgacaacttaacagaatagtaaaattaaagtaactttgtaagaacggggagactacaacaggctataaactgaaagagagtttccagtgccccataaaggagtaaaattgaaaaataacagtgggtggtcaagaccacaaaacaagtgggaaaatatgggatcaaggatgtaattgacatgttccaattttatgaaatccacatcatatatctagattaacgtaacaattaacatggtctgccaaacagctcagagatggccacgagaattccaacagtgtatgagccattttgtaatccagtcatgtggtcacccatggatgtggcctgtcttcccaaggatgaattaattaccttatctctttattcattgtctttccattcccatt

SEQ ID NO: 38687 - DNA, 1031 bp, Homo sapiens
cggaactattcacaatagcaaagacttggaaccaacccaaatgtccatcaatgatagactggattaagaaaatgtagcacatatacaccatggaatactatgcagccataaaaaaggatgagttcatgtcctttctggggagctggatgaagctggaaaccatcattctcagcagactatcgcaaggacaaaaaaacaaacatcgcatgttctcactcataggtgagaaatgaccaatgagaacacttggacacaggaagcggaacatcacacaccggggcctgtcgtgggatgcagggaggggggagggaaagcagtaggagatatacctaatgtaaatgaccagttagtgggtgcagcacaccaacatggcacatgtatacatatgtaacaaacctgcacattgtgcacatgtaccctagaacttaaagtataatttaaaaaaaaaataaaataaaattaacagaaaaaaaaagaatgtctttaagagacggacattgttgcagagcccttttactagggttaaactggagtacagagaacattagagtggggctttagtgaggtgtgtgggcctgatttcagggagtatgtaaaggctgggaaacatgaattgtaaggcagagatgttgggggctaacagagagggagggggtcaaaggtaaccaaggtgtcaatcctagatgtctggtagaatagtgtagcatttaatggaatcagaacatcaggatgaaggcagtattaattgcctacaggtgataaaagttgtccacagaaaatatccagcaggtagcaggaaagacagacagaattgggatttgggaaagagtctggactaaagatgcatatttgagaattgctcatggagagatgagaattgatgagatgtggcaatggataagatgtttggaagagtgagaggaaagagaaatgatgagatgtggcaatggataagatgtttggaagaatgagaggaaagaaaattaatgagagcagaatcctttttgtttttacctaaattttaatgatga

SEQ ID NO: 38688 - DNA, 1035 bp, Homo sapiens
ttctcagttccacattcacacatcacactggtagcttgaaatgagccatagacagggaatttatgccacagaagttggcaaatgctacaaattagggttttgttttgttttattgagacccagttgttaaacatttaccagaatgccactgaccacattggtggtgttcttgttatttttgtttgttatttttgcagtttgttttgccctcattagcttcctcactaataatataattttgagtagaagttaagattttggtggatgaatctaatcagagagtgagaagaatgatgagcttcattagattatctagtcaagctgcaaattacttattcaaaaaagcctgtattttaagaacagaaatatttattagatggcagatagaaaagtagaaaatggggtttctgagaataaactgatgattatgtgaccctcagataagtatctaaaattttttattgtatttattagagcaaaactggagaagaatttacaaatttggtgctctctctctgtgtgtgtatatatatatatttgagacagggtcactcaatcacccaggctcatcatacagtggcatgattgtagctcactgcaggctcaaattcctgagctcaagcaattctcccacctcagcctcccaagtagctgggactacacatgtgcgccaccacactctgctaatttttttttttctgtagagacagggtctcactgttttgcccaagctggtcttgaattcctgtgcttcagcaatcctcttgcctcaaacttacattcattttttatgtaaacactttgatatattttataatctccagctttctgcaatgtctgggatcactgtctatacaaggtaatttattgtttcaatttctaaaggaaagtggtgagattttgagagcagagctgggcctgttttatccttttatttccattctctgtcccaccctctgtcttttgataatgcatagcaatttgtaaatactgataaataactggaattcatctagccataagattcatagctgg

SEQ ID NO: 38689 - DNA, 1067 bp, Homo sapiens
ccaacctctggtaactaccaatctactctgtgtttttatgagtttgactgtttaactcatccaaataacagaattatctttttttaaggctgagtagcattccattgtgtatatataccacattttctttatccattcattcactgctggatacttaggttgtttctatatcttgacaattgtgagtaatgctgcagtgaacataggagtgcaggtctctctttgacatactgatttcaaatcctttggatatgtacccagaagtaggatacctggctcatgtggtaattttatttttagtattttaaagatcctccataatggtttttcataatgcttctattgtgtcctgtgcttgcatacttaaaagaatagcaagagacttgagcggaatttatacacaaaacttggagtcctctttctcaggctctctcctttatgaagttccccagctcactctccagtggctctttcctcatgttgctccagctaccctcagtataaaactgtgaagatctgaaactcaacccataccagtcacttactccaagtattgactccccttcaaaatcttcctacttttgttcactctccaagccccccggctagttgtttttctgtattttgaccagttgttatttgcaagaggttcaattaggagcttactcttcaagattacaaatggaaactcctatactgattttatagagaaaaacattttactatttgccagaaacaccttgcaataatataggaatgtatgaagtttatgatccacggactaggcagtggacagtcttctgtgagcagcagctctgataatgtatgcatattatggcaccagcacacacagttattttgatactgttaagcttatggatggttgttttacatgaagtctacggttatgttttacatttgcccctggtcctcaccttcactgagatgctcacttaaagcactaaagtatccagactattgagaattaattctgctctcaagtaactacggagctttaccaccatgttctgagtaattcattacaatacgtaatatagaattgccaa

SEQ ID NO: 38690 - DNA, 1041 bp, Homo sapiens
cgaactgttaaagagtatagtgccatatttcttacatgctctttctattccccataatctcttagccctttttctgccaatgttataccggattattcctttatatattcctatatatattccttatatttcatataagcatgaaaatgttctttctctcatttggatatgtaatcctaattaaacaaagtcccagcattttcttaaaagatatggagctcatctgtcgacttgtaccaatatcagattaattactgtaattattaagaaacatttgaggaatgttgacattcaaatcaactatagcataaaacatgtaccaaaaagatgatgacgttaaataacttttagaagactatgaatcttggttgtcaaggggtccttaattgctatcacattgtctgttgcttaatgcacataaagtataaaagtaactttaatcaaaactaactcaagaatagaacaaataagaaatataataggattagtaaattctattaactggacattcacacacatcacgaagcaagggttcaggagagatcaggctaaagaggtttctggtggaggagggtcaactctaatgaaaacattggaagtcgatgggatgtggaagcatcatctgttgaaatgacttccacaatgagagagaaacatctttctctcttaataaatcattacgtctccactgtccattgcactttggcccctgtctttttacgatagctggcaagtattcactgtgcctgtagggctagacagcaataggaatgataaaaagaagagttgacaactatgattcattgaatgcatactgcatgcatacatggtgctcatttgtattggccagacaatttgtaaaaccgttatagtaatcctcatttttcagaagaagaacctgattctcaggtcacaatgtagtttatctaagatcatactggtggaagtggcataactgggattataattcacacccatctgactcttaaatttaagctagtggctgaactaatttacactcctaccaacagtgtaaaagtg

SEQ ID NO: 38691 - DNA, 1009 bp, Homo sapiens
aatctgcccacctctttttgaatgtaggccagcaaataatttttgttttgcacccttctgtggggcagccctggctgatgtgcagccatgttgagtgattgtcctgcatccaacagcaggaatgaagcttaacaggcactgaagggaagtgaagcaaccctggggaaggagaggattcagtataaatgtaacacaccaaagtaattcatcagtagtaccctttccaacaatagcccaagtctttacagttccatttccattcatttttattttgtagcaaattatcatgtttcttataaacatttagagaaatgtatagttggattattattatgcacactgaaacttaaaggtatatttatgactttctgcacacctcctaggtggaataaatatgccattttttgtaaaccacttctaacagggaccatgacagaccaaatcatgccagtgccctactctgtagtgaagtatctgtgcaatgaggttacaatgacctaataaacggatataccatgagaacgcttaagaacctgcatgcaacattacctttgagatttaaatgagttcttctctgaaaatataatgcagatctttccaacttagtagaaaagcatgcttttagtttgcttagtagaaaagtagtaacattagaaaaggggggaaatagatgtatgaatataaataaatttttttttaaaatttggttgtattgaactttcaaattagccaactaatggtacatataaaataattataatcacactttacttagacagcattaaatatgggatgatcagagtattatctgtgatcgcaaaactgttaacagattatgtagctttattagaaaaaaaatttctttttactattaatatgtgttcatttatgtaaaaaattcaatattactatgaaattctgctgaaatttttaaaaataatccaaaaaagtttacgatgtctatcattaagtcttaaaagagagaataagtgtgaggatatgttaaagg

SEQ ID NO: 38692 - DNA, 1041 bp, Homo sapiens
tatatttttttaagcatgggtggcaaaagttatttaatgaatcatcttccaatgtgcagaaatagttgacaaataatgtacccttgttttccccatatttttcgtatttttttcaatttgcctatatcatacatcactttttccaatatatgattttatctttgcttctcctaaaatgccatttctctatttttctcaaatttaactctgtattttttcttgtgtcttgtgcctgcttccctcacttattccagactttttttttcttttggagccagggtctcactctgtctgtcgcccaggctgaagtgcagtggagcaatcacagctcatggcagcctcgacctccccaggctcaggtgatccttccatttcagcctcccagatagctgggactacaggcatgcaccaccactccgggataattttttcatgtgtgtatttttagtagagacagggttttgccctgtttctcaggctggtctctaactcctgggctcaagtgatctgcctgccttggccttccaaaatgctaggattacaggtgtgagccactgtgcctgacctgttcctgatttttaaatacctggttgtcctcttcttttgtcatttctttattattatgtaatcctattcaccaaaaaaaaaaaagctttttccccttttgttgtctccatcctcaaaaagtgattattgatctcttctttatgtaagatactaggcaggaccccaaagggaagacaatgccctctcctgaaaagccaaggcccagtgaagagatgagagacaggtccaatgaaacaaatacaaatggtatgaataaaaatacaaatgatgtgaggctcctgatgctaagtgtcacaagcacgatgacacttctccagccctatttccatttctactctaaattaattttgtcttcttttgaagtctcacctgcaaggtagcagaccgtaaaaaatacctaaccctctgaactacttaaactctattccaattcggttatttcaacaggaccttttcaacatgctcagtctttct

SEQ ID NO: 38693 - DNA, 1032 bp, Homo sapiens
ccataaatcacactcactttagaaatacgtttttctttgatccaaatgtcttttcttaataactcattcctaagatttccattttcagattcctgtttttgcataagattgcatgaaatattttttgccattacacacagtgcattttattgaaaggactctaaagggcttagggaaaggaaaatttccctaaactgcaaagaaagtcagctaatcattctgaaacataataaaaactagtttttaaaaatagctcatgataggtaatggggagtaggtagacccaaacaagattggtcagtttctacctggacaataaagtaaggcattaatttccttcagatataggtatttctgtagcagatattttttagaatttttttaaaagttgtgtaagggtgttttatttatcagaaaaaataaatgtattttgaactgtttgaaatgtaatccaaaaattacagctgaaaacatcaattatttaaatttatgttacacaaataattgtaagtcttgtgtactggaagtaaacaataaaagtatgaattttcttttgaccacccctttcccctaccaggggaataatggctccatggcagaggcagtttgtacctcagtccatatacatccccttcttattggcattgcagagggattgcagcctccccgcggcaagtagctcaataaccaaatattgaaactgtctgagtctgtaccctgctgcccatgtcataaattcttgtatcttaaggtatcaattttttatatgctttacttttacttatgctttttattcctatgccctttcccttgtactctacacctacctgaaatgcagcatgcatgccagccatgcctatatcccatgaacactacctccaatgctacctgactctctacccttccacttttctttttattatcattaaagtaataatgggccattagtactactcaagacacaaagccaaggagtttacaaaaactaaattactaagtactgtcctagcagccttcctaacttaatgccag

SEQ ID NO: 38694 - DNA, 1118 bp, Homo sapiens
gagtaagaataagaggagaccaggcggccacctgggctgccacaaaatataaggaaatagagagaacaaagaatacaaaaagtaggaacctaaaataaggcagattaagaagagtgaggtggtacttcaaatgccaaagaagtacaagtaccattgaataagtacaagttgctgctgaaaggatgtcattaatacaattaaatgcaactctatatgacatagtgatcattatggttattgcttgtaagaatcaatattcttaaggacatatatgatagtcttctttagtttctcagaatttatatgatgagattaatctctgccacatcaagtagatcttcaaagatataactcaatttaaaaacctgatacatatcaaacaactgaggtttgaattatttgaccaaaaaattttacatcatgattagaatgatgttcttgcctgaagatactcccttgtcaatctaggatataacccagagcctacaaatcctggtaaaaactacttttcacagctcatgctatattaaaaatccctgaagcattcattgttggtttttatagactcttgaaaattcagagccaaaaccttttaaagggtttaggaaaagaaatataaagaaaaaagaaggaaaagtccaatatgaagcaaatacacttgggaaagaaagaagtcatcataatagagcattcacaagcaacagtgagagatgagagatagcatcagaaagagtattgtgtatgcatagagggtccgtcctcagagatacatcctcactttccttttgatgtgttcaagtgaatctctgaaaccatgtatagtgttgagtctatagcaatagaaatcattataaaaattcaaagaataaaatactttttttttttttgagacagagtcttgctttgtcagtcaggctggagagcggtgagacaatcttggctcactgcaacttcagcctcctgggcttaatcaatcctcttacctcagcctcctgagtagctgggaccacagatgcacaccaccatttttgcctaattttttgtattttaggtagagacagggtttcaccatgtttcccaggctggtcctgaactcctgagctcaagcgattcatcca

SEQ ID NO: 38695 - DNA, 1029 bp, Homo sapiens
ttgaatgcagtaaggaaaaaaccatgcaaatatcgaatgaacagtattccaggcagcagcaacaataaagttaaagaccctggagtgtgattgtgcttggtgtgttgaagaacatcaaggaagtcactgtggctggaacagaatgaggcagaggggaagcagattagataggaccttggagcctcggaagccactgggaagctttgatcagagagctactcaacagcatataactgatgcatttatagtgtgtattaggaatagcctgaaatgtattcaagtaaagacttacattctcccttcaccttccaccctcctttcttgccatctctgattattgaaggtataaaatgaagcagtaccaccaaggccatggtaagagaaacaaactcaccttgactcagcatctactatgtgccaagcgccatgctagaaactatagttttatctcaattcagcagcaaaatcagtctatcaggtttcagtggcacaaagaagagaacacagaaatattttagtcaattaccaaatggtaagctacaattttttaaataagtcccccctgcataaagaaaagataaatttttaagttgatggatttctgaattactctgatttgatcattagacattatatgaatatatcaaaatattgcatgtacctagaaaacatgtacatccactatgtatcaataataaatttttaaaagcccccaagccttcttggacatttgctaagggcagtgtggctgtttgcagccctatatgcagaaacctccatgaatatgtagggtacaaggcagagagaactgaattcagtcagagctgaatggtgcttggaaggtgcccagcctcccaagaagatgtctatttaccctcagcgagcagtcacagtgccctctgcccaggagggcaggattagctttgaagcagggttgtttgtttctctttttagaaaagctctgttgaaacataattgatatatttaaaattgcatatatttaatatatacattttgatgggtttggac

SEQ ID NO: 38696 - DNA, 1035 bp, Homo sapiens
ttcatttaaagaggaagtaatctggaaaagagccatgaataacagaattacccagtaccttgatgttttctcatttctctgccggcattcagcccaacagctgtcactgtacctctacaggaacttagttcttgtatggcaacttgagtggcattgagctctgatagaaggtcataacatctttgttagaaataatatgcaaatttttccaagaggttatgtctcaagtttctattctaaaagcaagaaaagtcacaaaacaaatttctttgtagatcaaatactaagaggtgaagaaaattaatttccctctggcttttgtcttggttgacaattcttctgggataaggttgattatttttatgattcctcatggagactgtcagctctgcctgattaactgaaaactagcataaaaagattgtataatgaacattattcatataaaattattccttttagaggctaaataagaaaatttgccttacatagagggaaatttggcactctatgttggttgtcttactttgattaccaaaaatcactttttgagtcctgtatgataactcccatattttagagtagcaattgatctcataggaagtaaataacatagccacacaactattatgtggtcagacaaggatttgagtgcagtaattattagctgggagtgtccatgagcacgtgtgcacacacacacacaagcctcagctccacacgttctgattcagtaggtttaaggtggagccccagtaatcccagactttgggaggccgagatgggcggatcacgaggtcaggagatcgagaccatcctggctaacacggtgaaaccccatctctactaaaaaaaaaaaaaaaaaaaaaaaaattagctgggcgtggtggcgggcgcctgtagtcccagctacttgggaggctgaggcaggagaatggcgtgaacccaggaggcggagcttgcagtgagcagagatcgcaccactgcacaccagcctgggtgacagagcgagactcggtctcaaaaaaaaaaaaa

SEQ ID NO: 38697 - DNA, 1133 bp, Homo sapiens
ggttaccataggtggagagagggagaacatggggagatgtacaccaaaggatacaaaaagcagatatgtaggatgaacaagtctagagatccaatgtacaacatgagaactaaaggtaataaaattgcgttgtgtttggaatttttgttaaacaaatagatttagctgctcttgtcacaaaaaaagtaattatgcgagataatagatatgttaatcttcttcactatagtaactcttttgctatctatatgtatcctataacatcattttgtaaaactcaaatataaacaataaaatttgtaatttgtaattttgatctttattttccccagacatttaaaaatatgtcaaagaatatacttcatccacaggcagatttttcatatccatttaactatgtctccagagagcacttattaacagaagctaaacatatggaccttctaaaattaagaaaacctttttggaacttgaaaagacttttgaatagggctagaagcaacaagccatagtgaattattcaacaccaggatatcaaagaaatggaggaagtaatttcgtgctgtagaagcaaagttctgtaaattgatatgtgatgatattcaggatagtttaatttggtagcctggaagagaatcaaatgaattgaagaaattcttataaatatttctttcttcttttttaaaattaaagatatctgctaatttgaatatgccacctgtgctttactccaatgttcaaatttctttttataaattgcaaaaaatgcatctaattttacaaatattcctcactctctacaattaaaaatatatgcatataatttaatattcttatgaaatcaaatatctaaaatagaaaaatcctaacacagaccttactttatgatcatctttgtgatattctaaatcctcagttattttaaaattgaaacaacggggaagttttcaaataaaagatcttatttcacttgaaagaaaaatgtaggtgtaaggggaaaagttataggtaataagatttaatggctgtgagaaatagacaaaaactgatagtgttctctagagaaaatagctttggggcagacagaagagagatgaggtgtgatactgagtgaagttttaaaaataaagaaa

SEQ ID NO: 38698 - DNA, 1024 bp, Homo sapiens
ccataatgataatctgattattatttataatattaagttctgggattcattatgattttatttctcacaaatttccaaggaaattccaaattgctaagtttagagctggacaggacctttaagttgaattcttttaaccttctcatcttatagttgaggaaataaaatgatacagtttacatttgttcagtgttaacacagtgaggggtagaaaaggaaacatttgccagtgcatataatgcttatattgaatattataagaattgcattttttctactgctgcctatggaccattctcttacctatcattcttcacccgattagccattagtgtgtacacattcataaacctaaaccttttcaattatagtaactcttatagaatggaaaggtaggggggtgtgtgtgtgtgtgtgtgtgtgtgtgtgtgtgtgtgtgtgtggctgataaattattgacttctgtgtactattctttacccatactttatcacttcttacctggacctccttctcttctaactcaaatacccttgcactctaaattttgttgctgtgtctctggataactacataaagaagaaaccgaaagaggataaaagtgaacataggtatcaatttatatataaagagggaagcatgaatctgacttggtactcactctatgagcagcacggaaacaggtatagggatttatcagcttcatatcagctgaccaccacaagaacccataaatggaagatacatgttgttttagacacttgcaagggaggataagtgaaagagaggcctgagcaaagaagctcacacacagggcctgtgcctatgactccagatgaagcccaggtcaggctgtgaacagctctgttagctatactaaccaagaagtttttaactgtatcccaagggcaatggaaagccgatgaaggctttacagcaagaaaatgacaagacgagatttatgttttggaagaatcctcctggcttaaatgtacggaatggagaaagagtggtgcaaaggaca

SEQ ID NO: 38699 - DNA, 1027 bp, Homo sapiens
aaggtaattaagccattagggtggagccctgatgaatgttattaatgtccttatgaaaagaggccagagagctagctagcctctctttccgccatgtgaggttacaataagaagttggtagtctgcaacccggaagggggcctcaccagaaccccaccattctgacaccctgatcttagattttcatcctctagaactgtgagaagtaaatttccatcatttgcaagccaccagtttatggtggtttgttaagtagcccaaactgacttaagacaagtgggaaggggctgagtagtaagaccaatgcctagaatagtgcttggcaaataggagatgacaaatgaataactgttgagtatgtatgacagcagaaaatccaattatgatgctgttgagaaatccaggcaggagaaggcatcactggggccagcatggtagctgtcagtgagtgtgcattaggattaagtgtttaatgcaagtgtgcagaactaagaacatcctatgtttttatggtgtgtccaaatccggagtaaagacaaagttttttattttgtttgccaagatagcattttccttttagcagtttttcttctttaaagatattgtactctttcaccactaaagttgcattacctctgaactggcagttttgctgatggcttctgtggtctggaggcttgcccatttattttctgatttcccctttggcagtgcacatttctgctctcattcttcactgcaagcttcaaatatataagcgttctagttactaacaaccaagagacaaagagattgggggataaaagtacaagagcaagcagattcatacctgatgagttattggagtgtttcccttaatcaatgccattgtcatcccaaatgttggcagatcaagcttggataggatccagtatactcactgtcactgaaaatagttaattacttggagggcattatgtgtggtggtagcacagggctatgtacatataggtaaatcaaaaaaaaacttaatgggcatattaattca

SEQ ID NO: 38700 - DNA, 1035 bp, Homo sapiens
tgagaacacacagtatttggttttttgttcctgcattagttcacttaggattattcttttgcccacttttatttgttttattgctagtgggtcatttgagttatacaatatttaaataaaagagaaccataaacagtttttgtcttaggggataattttttaacacaatggtttccttttcaggtcaagatgagctcagaaaaaaaggtattgaaataattcaatcatagtttactaaatgagaacattttgctaatactttatgggttacatgaataacattcaacttgggagatttttatagtattgttcattttgatttctttttctaaagaatattaatgtcaaaacaagttttcttatagttcatcttctaatcattacacaccataacatgctcacttgagatctacccatcatttttataacaatttccaatgcagctgagatgtgaactcatgacagatttttttagttttttgagattgaagaacagatttcaaaataacacactgaactaatcacaggaaactaggaagcagaaatagcaatttttctgaacagaaattaatattggaactatcaagtcagtaattttatttgaaagtgaaaactagggtcaccaaaatcccacttagaggtcgtcacctcacactgaagactaagataaaagcgcctcttaagtgggtcgccatccgcatcctagttgtgggcactctgtccttccagaccccacagcctattgtcatcaacagcacatctctggcactgtgattagctcaatgtgctatttttaaatctactattcatgctcagagctctcacgcaggtggaagacccttgccttcccttcccagagctatgcagtattcttctctctcaccctccttccactcgcataccacacacacaccttcaacacttcgacctcccttatggggtgagcaactgctgtcttggtttgcctacaactgaaggatatcttgggatatggaatttttggtactaaacccaggacattgggtcacatacgtg

SEQ ID NO: 38701 - DNA, 1023 bp, Homo sapiens
ttgtttatactacaaatcggagaagcaagtcatctcttattttgtgatgaattgtttttgtcatgtgttctcctatgacttagagatcctagagatttctacaaacaacagcttttagcctaatctaggtgacaatgagacaaacacaataagaattttaaataaattcagtgtctcacaacagaatcacatcaatctagagaaatgagaaaatgggtcaagtagataagaaaatctaacttcctactgttggaaaataaactatttaaagatcatgatataagtaatatgaataccagctcaaccatactctgtatttttctttaacattacatactttattgcttccattaattgaattttctacgattctattgaatttaccagtctatattgttttaattaagcatattggtataaatttgcagtcatttataggtgaccaatacaaatttttttttcacttgttttcgcaaaagatagataattctggactcacagatctctagacactgttcctggtcataacaggtattcaagaaacattggttcccattcctatacctaacaccttctgcacattacaggaagaaaaacatgtgatccttgaaaaacttagtctggagaataaatacatgaaaaggagggaaaatagaaaaattacatgctaagaaatgtgtactgcttgagaactctttaagcaacaaaagtgttgtctctattaaaagcagacaggtgaggttacctgagaagaaacccgtgttttcatgttcatctctttaacatggggcaggtccttaggtacaaaacagatctgaacttcttgctttctgttactcttaatttaactggctaaatcagtaatatgactttgcttttagacagttatactagacagatattttattgagtactctttgaatttagaaaaacaagggtactaaaatatgcccagtgatgtaggaactatgtgcagttggaaggactctttgccaaaactctaaggaatcttgtggattcctt

SEQ ID NO: 38702 - DNA, 1052 bp, Homo sapiens
tatggtttacttttattacagcagaattgagctacagtttcatataattagatatttgtctggtccttgtataaaagcatacagactctgtcatgcctgatgtcttttattgcccactttaactggatactaaagtttgtgtttaaagagatgatttatatagacaaagaacttcttctaaaaaataatagaattctattttattgaaactaaagtttacttttttattacatcatttgtctctctgaatctgtagcatgttggccaatatagtatgataataaattactactagaatacctcatatgaaaacttatatttttcttgactattaatttgaatcacttttttaagaatcaaatttcaggatatctggttaatgatggtgggttgaacacatacattagcctctgagccccttctgaaaccacatcaaaatgaatataaagaggtcttttaaagatcctaaatcactaggacacaagaaataaaagagaacacaaacaaccctggaaagcatatggacaagtggtaactgacttagcagaacctagaaagttaaatcctaagtcagcaggtgggaaagccaagaaacctgatttatattgcagaccaaaaggcgaggaactagtggctccaggcacctctggaagtggaagcgaagtgaggctaaaacaaaagccttcttgtaaatttccttaagaggcatttagacacccagggccccttcccaactctgcatgcgaggtaattgcctcacactttgcctcacactttggcaaaaattggaggacgattctctggaaggcctgccagagagagcttccagattgtagtccccaaaggctagagttgagggaggaatactggactgaaaacaggcaggtaaaatgaaagttaatacattacaggtaagctctccctcacttgactcccaaaaacccaccaggcactggaagagccttctctcaggaatctgcagcccaagaataaacacctgactgcatagaaataagggcagaggggatgtggggagttcctcatgaaaagac

SEQ ID NO: 38703 - DNA, 1065 bp, Homo sapiens
atttgttgggttacttgggaagtgttgcagattaatatagaaggaattaggacttggtccttgaatagtgtctcaaatattaaagatcttgaaactgaattattttgcattttgtactttgaaaacattgtgatgcaccaaagtaacataaaactgggtcttctaaggttatgttttttaaaggtactatgcaaaaacaataattcttgcctgtagtcccagctactagggaggcagaggtgggaggaatgctcgagcccgggaggaggaagttgcagtgagctgagatagcacaactgcactccaggctgggtgacacagagtgagactccatctcaaaacaaaacaaaacaaaacaaaacaaacccagtaattctcaaaataaggccaaccttaaaatatcccaggtactaaatcatttagcctataatctgatatcactgtttaacagaaacttttccattgctgtcaactaaaaggtaagaaaagggaatgaaactaataaattctgagcacatgcttcgtgttggatacatttagtgctttacatttgctttttgtgctaaatcctttactaagtttatcatttcatgcaatacctgcaacaacccagtgacaacatctttattttacatatgaaagaaacagactcagagaggttgctcaaagccacacaacaagtcagttatcagaagaagaaaagatccaaaccagagccaaaattatttagcagcctcaaaaaaattgacttcagtgtctaaccttccctcgtgtttaaatactctttccaggataggagatgtaattaaaacaatagctaaacaaaaactcaagccattatatcccttgagggctggggggaagatttaaattggttttgttgttatttggttttttcttttttctttttttttttttttttgaagcttctttttaaccctttttttctttctttctttcttttattttttttatttttttattttttattttttatttttggtagaaacagggtcttgctatgttgctcaggctggtctcaaactcctggcctgaaactatcct

SEQ ID NO: 38704 - DNA, 1067 bp, Homo sapiens
atcagatatctgcttgactcccttaataacttagagtttgctccaaaaggcctaccctgctcctatttaaagctggaaaccttccatctcttcccagcaccttcatcctcttttatcactctctatagcacttatcttccaatgctctatctttctgtatcccaatgtacttgttcattatattatctgcttgcttccactagaaacatcaaatggacatggatatgtttactctgttcagttctgtattccagcatttagaagagcacctggctcagcaaatatttaatgagtgggcttattttatttaacagagttaaagcgatttctgtgtatcaggcactgttctaagcactgtaaaaatattaattcatttaaagtctggtgacaaccctattaagaatggatttttcattccaattttatagaaaaaaaaaactgaggcacagagaggttaagttaaattgcacacattccataaatggcagacccctccatgcttctatcccctgggctctgctgaatgaatgaatgagacatagtggaaaccaccttttctgcactttgttctgagcgtcccactctgaccaaattaatgatcccagtgtttgacattgacccattgaagtcaatgtgctggccctttgcttccccaaaacttgtagcttattagttatttagaagccagtatcaaggagaaagaggcaagtaggccttatctactgggataggtctaccttttagtagaagtatgaaaaggatcaaaacagaatatgcaaatacagatcaaggaactagtgaagatagggctgtggaaatgaatctcaagccccttggatcagcagtagacccttccttctggtccagcttgtcatgctttgctaggctaagggctgcctccacagattgcaggaacctggaacttacctgtgggacagaccgacacgtatttgcatagtaatttgtacagctagctgtagcttattggaatgattacttcaatgtttgggaaacatttaagatgattgaaagggggtaattagcatttgggaggaggcatatctcct

SEQ ID NO: 38705 - DNA, 1043 bp, Homo sapiens
gtggtcagctaacaagccccatgtactattgcaccctattgacaaaggcccaattgatagaggttttatgggctaattactgaaggttttagcatgtccccttctgaactgcccaccttccttacccctgcactctagccaaaaccaagagcatttcaaaagcccactgatctcacaaatcctaaaatcattacatatttgtgtttggaaaacatattttaaacaattataacataagggaagaaataaatctatttaactttttttaattaggtactttgtttcattactactgtacattgatgtatgtctgcttggttttaagcatttgctttgaaaattagtaaaatcttatctagaacataaaattcttcctcatatctatgtgttcaatttttatctctcccctaagactcttctgtcataataacattctatagctatgagcactaattgctgtattgctgatgtggatagtcaagtgtgttttgggatgaccacccaagctgcccttcatttacccagactggctgctttatgatttctctatgtgaaaacacaaaacactcacccaataacatcggcataaagaatttgtgaataacctctaagactgatttcatagtcattcttttttctagctttcattactgacctacccaaaaattgcaaatagacctaaggctgaaacttgggtcacaataatgagcctgatgtgtcaggaagccaacaaattacttctcacagtggctttttttagattccttggtgacgctttccaaaggcagatataacagggccatatttttcagtcttgcagggagtctcagtgagaaaataccagcctgttgttagtcttggatctgcatttgatgctaagtgtaagttgatttcttattgttattttaacagtttattttcagtgtaattatttccacaagaggacaaaagaggaataaaataaaattttattttatcctacgtggataaaataaaattgaagcctttattaaaatcgaccacatggctgagactactctaat

SEQ ID NO: 38706 - DNA, 1029 bp, Homo sapiens
taattatagtataatccgtttaatctacatgtggagaaataatgaaggagcaggaaaaatgaatttcttaacagatcagtggaaaaccatattacatagattagcaactgtcttttcaagatccgtattttcagcatgtactagatggtatctgatgccatgaaagcaaatattctaattccactggccagaactggcaaagaacttcttattttcctcactttgaaacataagtaaaggggttccacttgaaaattaataagccatgtgatatgattcgattcctgtccccaaatctccctccttctaggggccattgtctaaagtctaaaagaaaacataccaggcacagtggctcatgcctgtaatcccagcactttaaagggagagcaaggtaggaggatcacttgagcctaggagttcaaaatcatcaacctgggcaacataatgagaccctatctctacaaaaaaaacaaacaaaaacaaaaacaaacaaaaaaaactgtaatagctgggtgtggtggaacacactggtagtctcagctactcaggaggctgataggagaaggtaacttctgcccaggaattcaaggctgcagtgaattatgattgcaccactgtactgcagcctgggcaacagagtaagacagagagagagagagacaaagagaaaggaaggaaggaaagaaggaaggagggaaggaaggaaggaaggaaggaaggaaggaaggaaggaaggaaggaaggaagggagggaagaaggaaggaagggagggagggaaggagggagggaaagaaaggaaaggaaagaaaataaatgtaactattataaaagatgttcaatgttttattttggaataactttagacttacttagaagttgcaaaaatagtacagaatttccatgttcaaatgtactctttacctaactttccccaaaatattttacctacgtatactgcaattatcaaaaccaggatatgaatacatactattagctatagtctttatttgaatttcaccagtttt

SEQ ID NO: 38707 - DNA, 1061 bp, Homo sapiens
tgttattattatacagtgtcccccagcgattatttttctgtaaattattggggaacaggtggtttttggttacataagtaagttctttcacggtgagttgtgagattttggtgcacccatcacccaagcagtatacactgcaccctatttgtagtcttttatccctctcctccttcccatcctttcaccttgagtctccaaagttcattgtgacattcttatgcctttgcatcctcatagtttagctcccacctatgagtgagaacataggatgtttggttttccattcctgagttacttcacttagaacaatagtctccaatctcatctaggtggctgcaaatgccattaattcattcctctttatggctgagtagtattccatcatgtatatatatataccacagtttctttatccactcattgattgatgggcatttgggttggttccacatttttgcaattgtgaattgcgctgctataaacatgcatgtgcaagtgtcttcttcatataatgacttcttttcctctgggtagataaccagtagtgagattgctggatcaaatggttctacttttagttctttaaggaatctccacactattttctatagtggttgtgctagtttacattccaaccagcagtgtagatgtgttccctgttcaccgcatctccaccaacatctactatttttccacttttttattatggccatttttgcaggactaaggtggtatcacattgtggttttcatttgcatttccctgatcattagcgatgttgagcattttttcatgtgtcttggccattcatatatcatcttttgagaattgtctattcatgtccttagcccactttttgatgggattgtttgtttttttcatgttgatttgtttgagttcattgtagattctagatattcatcctttgtcaaatgtatagattataacgattttctcccactctgtgagttgtctgtttactctgctgactgtttcttttgccgtgcaaaagctctttagtttaattaagtaccagcaatttatctttgtttttattg

SEQ ID NO: 38708 - DNA, 1079 bp, Homo sapiens
gaagtttggaaaatatttattttgaatgaatgaataatgaacacattgtgaacaaataaatggtttactatttaattattcaggaatcaattaagctttattaataaaaattgtttgggggttttaaaaagcccacacacaaatgagaggcatcacagaggcaaacggtatgacattattaaaatcgttattgctgaatcacagttcagcaataagcaagtgtttgaggcattcaaataagtgagtatttgagtgactctaagaagataatgaaactcctccactgttttacagttgcaataatttttaaggaacatataaaaacatattctagtgtttccatttgaataaagatagtatatataacatatgcaattaaaaagaagaaagaaaacaaattttaatgtgtttttcttttcaccttatgggcagttactagatgtatgatcagcaattttagcagtagagaccttattaattgtttttgaaaactctctagtgcttcacaccgtcactcaaaacagagaaattccttttaattaaatgtcaggaagtattccaagaaattttgccagcatttctgctagccagtaagtaaggttaattgacaatctttaagagagaatcttagagacattcatatcataattaatgtaatttaagatgctgaggatgcatgaattacctactcagtgtaaatggggtctttgattgtgaagagaaatactcaagtgcagtggtatcttacagaatagattccctcattagtgtgaattagtgtttctgaatgttgctaattagcaagcctgggaacaaacacaatgaaaaatcaagtttaccaaatcacaaaaaaagtactggttagcatatttggtaaacatgggtcgataattattttgattgaatctcccagcaacctagtttattgtggttgcaggccctgtgcacagtatgttttacctgccataggtataatcaaccatatactaaaagtttgtaatgactgttgagatcaaaaagtatttcagaaagtcactgagaatatagttttctgagataaggagatgatgttctatttc

SEQ ID NO: 38709 - DNA, 1039 bp, Homo sapiens
atagttcgtatccattctagaatatcttattgggttttttttttctcccttcattttctctgaaagaagagagaaaatatgaagatatttctcataataaagatatgaaaatctgttatttgaaagttggacttgcatactggccccgattttcttatccttcctctttcattttctacctctttgtctttttgtcctactttctaggagttttagctaatattatcatccaaacctcttactaagattttcatttctgctatcatttctaaggtcctttgtttttgttgtttttgactaagggttcttttattttagtatcctatttttgttgcatggatagagtattttgccttatatctgtgaagatattaatgacaatgttttgaaattttcatttccttagtttctgttaccttctagttgcttttgagctccatttttgtactggaagatttccttagatacatagtaaattgaatgttttctcataataaaatgttggagactagaagggtgactggagtttctgagtgtattagagctgattaactttgatcttcaccataggttgacctgagtcaaccacttttgggggaattcctggcaacagtatctttagctcttttttcttgcactgatcagattccccagagagtagctactcaaactcctagagggaaaaggtcttactaccattattacgataacgagcaggttgtggtggatcctcaacattcaatctgtgtatgatcacttaataccccagcttttggtttaatacctgtcctttgactgtgttggatgtatctttggatgaaggggtgaactctcatctaaagatttctatcttctgctggaataggagaggaccatatgcccaggagtctgggagagattgcacgcaaccttccttatcttagttatcccctctttatgcttggatcaagaagtacctaacgttgccaattcctgagccttttgagttttccaaagtgtaaatcttgttgttcttagcttttctcagtgttggcatagg

SEQ ID NO: 38710 - DNA, 1065 bp, Homo sapiens
caattcagtccacgaattaatctgacttgcaacaagtatggaaaatcttatctagtgagagcagattaggcttcctaaaagtcatacttaacccagtttatgtcatttcccaagaccttctgaagctttctgcttttgctttacaacctataaaaaggattgtgagctgcaagaaagaaaatgaaataggtttattctgctagctaagcacttcagcaacagcttaagatttactttgttattcttcttgaaacttgactgatttttgtgaagtctttgcagaattcccttgcttttcagaattctttcttggttcttatttttaatggaactttactatttacatgtctatctttttgtggattcttgacattttctgcttgctgcattgtggtacctgagggggatgtttttctcctccatatcctgattctgcctagtggtttttcatcacttctaaattccatttcaaattaacagattgtgtcgcttgaacccaggaggcagatgctgcggtgagccaagattgtgccactgcacttcaccctgggcaacagaacaagactctgtctcaaaaataaaaataaaaataaagagaatacaattaaattaacagattctgtaaaaacctaatagatacactcaatagcttaataacctaattgaaaatattttactcatggtgtacttaatttctaaagatacataatttaaaaaccaactaatacaattagcagctctaaaaagaagtttgcaggtataagtcctaaatcttatgcagaagggttcttttcctaaggtgtttaattatgttcgtaagttcaacatcagttgccggagggtttttgccagaacatgcccacctcttgcagctcccctgaagcagtatgtatatgtatattacagattgcaggtgtgaaacatctattattcatctcaaaatagtaactttgggcatttttcttgttattttttaattgttagaatatttaatacgaatatttaaatatgccttttgtatttcagtaactcttgcaatagtagtttttcctagcagccaaatta

SEQ ID NO: 38711 - DNA, 1050 bp, Homo sapiens
atttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcg

SEQ ID NO: 38712 - DNA, 1001 bp, Homo sapiens
ttgcccaggctggaacgcaacagcacaatctcggctcactgcaacatccacctcacgggttcgagcaattctcccgcctcagtctcttaagtagctgggattacaggcatgtgccaccacacctggctaattttgtatttttagtagatggggtttctccatgttggtcaggctggtcacgagctcccgacctcaggtgatccgcccgcctcggcctcccaaagtgttgggattacaggtgtgagccatcgcacccaactggtctcaaactcttgacctcaggtgatccaccttcagcctcccaaaatgctgggattacaggcgtaagccaccatgcccggcctaaattaagcttttgaaacgatatcaggtggtgctgctggaaaggcagccgcccccttgcccattacacaatgcatttttatggagaacccgacactgaaccattcttagatgacctgcttctggggtgggatttcagacatagcagagcaacttcctcgctgcgatctattgaaagttaaccctcagctgggcgtggtggctcatgcctgtaatcccaacagtttgggaggctgaggcaggtggatcacttgaggtcaggagttcaagaccagtctggccaacatggtgaaactccatccctactaaaaataaaaaaaaaataaaaaaattagccaggcatggtggctcatgcctgtaatcccagctactcgggaggctgaggcaggaaaattgctcgaacctgggaggcagaggttgcagttagctgtgattgtgccactgcactccagcctccagcctgggcaacagcaagactccatctcaaaaaaaaaaaaaaaaaaagaaagttaaccctcaacgcatataattttattttaaaaagacggagaaaaacaaaaaaaagtaagcaacatcgagaaaaagttgtaagacttttctcaatgtaagagttttttcacaacaaactcctataaaccattgaacgtcactcactgtta

SEQ ID NO: 38713 - DNA, 1046 bp, Homo sapiens
gtgaaactctgtctctaccaaaaatacaaaaattagccgaacgtagtggtgcatgcctgtgatcccagctacttgggaggctgaggcaggagaatcgcttgaacccgggacacagaggttggagtgagctgagatcacgctactgccctccagcctgggcaacagagtgagactccgtctcaaaaaataaaaacattaaaaaaaaattaaactgctagttagatttagagttttgcttaaatttaacttcatcttttgggatgtttatttttggcaagaatacttcataagtaatactaggcattatgcacaagtttagtgtctattaaagtcagtacgtatcatgtggaatttatttggataagagagaaactagtagataagcaaatcagtattgcatctggttactgttttttagccagaagatcagctgccatgttacttgactcacaccaaccctagagtggatgagattgtccttaagaaccttcaccttaatagtcatgttaaagaaacgacaagaggacctcggtaagggcaaaatgtcagtgctcagttactttaaggaatgacgtcaatcctcttttgttcatttcaagtttatttaaatgttctattctagatactgtccctccattgaatcaaaagttttgcgttttccaaaccgtctacatcaggtttggttggaacctgaaggaatggattctgaccttatctacccacaggggttatctatgacgctaccagctgagttacaagagaaaatgatcacatgcatcagaggcttggagaaagctaaagtgattcagccaggtaaagaagatcacaagtgcccttcagtataaggtcagcattgttttaatggtcagtgaggaggccttagctacagtcattgttgttcagagcctcagaagatgaagcccaacacctatacattttaaatagtctgttttttgtttgtttgtttgtttgttttgagacggagttttgctcttgttgcccaggatggagtgcaatggtgcgatctcggctcaccacaacctccc

SEQ ID NO: 38714 - DNA, 1192 bp, Homo sapiens
actttacaactccaagtccaaagtgattttagtcactttgggttacagaagcaaccaaaaatcaaacttttataagtcggatcttaactattaacatccaaatctactcactagcaatacgattacagaagtcaccaaaagcaaaattatttcataagtaaggtcttaactattagcattcagatctaaaccactcactagttctggggaaatcacctaatgattctgctggtaaaactcattttagttgatctttccctttctggtattaaacatacctcagcagcctccttctcaaatttttcaatggttcttttgtcgatgccaccgcatttatagatcagatggccagtagtggtggacttgcccgaatctacgtgtccaatgacgacaatgttgatatgagtcttttcctttcccattttggcttttaggggtagttttcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggcccc

SEQ ID NO: 38715 - DNA, 1033 bp, Homo sapiens
tattgaaagtagtatttttattgtgttctgacaatatcaagttgatacataaaaagactatgtttataattattcaggtatacatatgggaagccagtgaaaggagacgtaacgcttacatttttacctttatccttttggggaaagaagaaaaatattacaaaaacatttaaggtaacttttgcagacactttataacttgtgatgggtaaaatatgtgtatttttctagaaataagatttagtactgaattaacaaaaagttaagtgtaagaaaatcaagagctttccagcattgaacaaatgagaatttatgcaattatagcgattaaaatggtaccagagctatcatattgttgtgacttagtttgagttttatttctaaaatttgaattgctaaaatggtaaataatactgaacttttaaacaaaacagataaatggatctgcaaacttctcttttaatgatgaagagatgaaaaatgtaatggattcttcaaatggactttctgaatacctggatctatcttcccctggaccagtagaaattttaaccacagtgacagaatcagttacaggtttgtagactttaaagtggaggtaaaactattcatgtgacactgctttatcatctttcttattataactggcactttcatttgggagcatcattgactttctaaagatgctatttaatgttgaaattgttatgactgttagtctaagttgcaggatgattttataagggggaccttattttctatgaaagtcactacttcaaccacatgtgatagctcttcttaatttttttttccatttctactctttccccctgaaaactacatggaaaggcttacattttcagctggtaaccttcttctttttaaaatcactgaaatctcagctgttcctagacagttttcacttttaataagaaaataaagttgagtttcttggacctttctgttactatttcaacaactttagccaatccctgaaagagcaaaagactattctttcattggccttaatttg

SEQ ID NO: 38716 - DNA, 1051 bp, Homo sapiens
atttaaccctgagttgacacagcacatgtttcagagggcacggggttgggggtaaggttacagattaacagcatctcaaggcagaagaatttttcttagtacagaacaaaatggagtctcctatgtctacttctttctacacagacacagcaacaatctgatctctctttcttttccccacacccagccatcccattactgggtatatacccaaaggattataaatcatgctgctataaagacacatgcacacgtatgtttattgcggcactattcacaatagcaaagacttggaaccagcccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtggaaattgaacaatgagaacacttggacacaggaaggggaacattacacaccgggacctgttgtggggtggggggatgggggagggatagcattaggagacatacctaatgtaaatgacgcgttaatgggtgcagcacaccaacatggcacatgtacacatatgtaacaaacctgcacgttgtgcacatgtaccctagaacttaaagtataataaataaaaataaaataaaataaaattaaattaaaaaatggagctggattagatcatttctaaattccttttcaaatctgagatttttgagtcaacatggaatttcttggccaagcccaagtggaaaccagttctgcctgctagagagagttgcttaccttgtccctttgctctttcttttttgatttttttctttccttgttccatcttcagtgattccccctttgatgaatcttctgatgggggaaaaagtgttgttgttttgcttgctcggtgttatttggtggaccttataaagtgtattttatgtaatttttttctcttttcataaaggttgtcagcttttgttt

SEQ ID NO: 38717 - DNA, 1021 bp, Homo sapiens
ttttttactagagcccagggtaaatgccccttttcagtagttctaatgattagaatttgatttgagtgcatagagaatgtcatcctaaaataaactcttgaggaggttaaacagtccttaactgaaaattctccctgatgcagtaagagattaaagtggtgcttgtgattgcagtgtgcagctgcagtctatttgctctcttttaatgctggccaactgctggtggtagacagattggactgagcgcattgtttctctcttggatttggttagtactttggaccactcttggacatttcagttgtttcttgtaaagaaaaataaaattaggttaagaatggaaaactcagaaaagtgtatcgaaatgctcttatattttggcaaagtcaatgtttctaaacaagggagccgtgtgaactgatgtctgcttctttgaacagggagacaggctgtgagaagttacaactctgaagtgaagctgtcctcctgtgacctttgcagtgatgtccagggctgccgtccttgtgaggatggagcttcaggctcccatcatcactcttcagtcatttttattttctgtttcaagcttctgtactttatggaactttggctgtgatttatttttaaaggactctgtgtaacactaacatttccagtagtcacatgtgattgttttgttttcgtagaagaatactgcttctattttgaaaaaagagttttttttctttctatggggttgcagggatggtgtacaacaggtcctagcatgtatagctgcatagatttcttcacctgatctttgtgtggaagatcagaatgaatgcagttgtgtgtctatattttcccctctcaaaatcttttagaatttttttggaggtgtttgttttctccagaataaaggtattactttagaataggtattctcctcattttgtgaaagaaatgaacctagattcttaagcattattacacatccatgtttgcttaaagatggatttccctgggaatgggagaaaacagc

SEQ ID NO: 38718 - DNA, 1030 bp, Homo sapiens
attttaaaaagaagtgaaagaatcattataccacaatcaatatttctagaaacatcaaaagccacaataaaccaattcccctttatgttgtagaacattagttgaatagcattgctttataaaaaaaaaaagtctagaaatagatcaacgtatattcagtcaattgatgtttgacaaaggtgctgaaaagcaattctgtggagaatggatagtatacttcaatataaaagctacatttctgttatttttgaaataaaattaagaagattatttttgtaatctgggattggcaaataattcttagagaataaatacagaataatataaaattaaaaatgattctttttttgaaattataagcatcttctcatcaacatacactattaagaaaatgaaaagacaaactagattgggagaaagtatttacaaaatatatatgtgataaataacttatctagaatacataatataatacatcatagtaataaaaacacaatgacttagtaaaaaatgggcagaaattggaacagaaaattcatcaaggaagatttatcaaagagccaataaacatattggaaaatgtatttaatatccttagtcatcagggaaatgtaaattacgattataataatatagtactatacaatcataaaatagccccatttcaactgaagtcatgtgacaaattctagccaatgagttgggaacaaaagtgagctatatcatgtgggggctggcacatttaattgttgatgcaaaacacctagagttttttcctcctggtgtcttgacttgtaaccttggagatggtggctgactcagtcactcagcggactccctgaatgaatatcatgtacagagcctcccctttaatccataacagacatggagtgaaatcatttttgtttttataattcactgaaatttgagggttgtttattactgcagcctaaaatagtgtgatctaatagcatggttgaaaaaacctgattttggctatcaacagtccctggatcaaacattcaggtgc

SEQ ID NO: 38719 - DNA, 1044 bp, Homo sapiens
tggcgacggcaggtctggattgccagacaggtttttctttttacctcgaggctttctctgaagggagtcggagcatttaaaaggcggcctcaaggtggattgagtcgggggaggattagcagtatttgcttaggttgtaaaaccgcgactttatctaataaatcgccattcaaggtgcaaatacaaacttggaacagaggtgcgtgacatgtaccccttttgtcctaaagtcaagaatcaataatgtgacttagccctattatcttgcctctaattaagcgattctcacttattctttctctattgctaattctcacgttacatttccccttttctgtgtccacctttctcttttgcgcattgatataggaagtgttttgtaataggctgtagctttttctcttactgttataaaaaccaggacatatagcattactacaaaatgagatactccgtaaacactttaaaagtgccagctatttaatgacccaagaaaatactcgtgatataaaagttgactaagtcaggatattagagtagtgtagcgactatagaagtacaatatagagcgcaactaaaaagtgaaaatggtaactctgctgaccggatgaaggatttttttttctgtttctttgcacttttctgtattttccaaaatttctataataggcgttatgttatttgtaaaatttaaacaatatatacaatccatattatactgacatctttgaaatccaggccagagagtaaatcatatcatttgaaaacaaattacttttttttaggcttagtctgcagtaatgccttaaagaaggtaaactgaggaaagagaaaataaagagtgcttggtcctcataatttaccgttaagctgggctctgtggctcacgcctgtaatcccaacactttgggaggccgaggcgggtggatcacctgaggtcaggagttcgagaccagcctggccaacatgatgaaatcccgtctttaccaaaactacaaaattagctgggcgtggtggccgcgcctgtaatcccagctactcggg

SEQ ID NO: 38720 - DNA, 1046 bp, Homo sapiens
ttgaaattggaaacaaaagatggcttactcgtgcttattatcttcagtatgcagatgattatacttttgtgctatcctagatttccagcttctataggcccgattgagttaaaattctaattggatgaacatagggaggattaaaacaagcacaaataaagccacagatgtagagttaatgtgagtttcaaactactacttttactttattctaatctaagggtctttgaatgtataggtatgataaattcgagtttcaccatgtcttaagcatttttataaagcaagcaaacggtaacttctttagagcataagcataagggttctgggcacggtggcggcacgcccttaatcacacacagcattttggagggccgaggcaggcggatcacttgaggccaggaattggtgaccagcctggccaacatggcgaaaccccactctactaaaaatacaaaaattagccgtgtgtggttggcgcgcgcctgtagtcccagctactgcggaggctgaggcaggagaatcgcttggaaacgggaggcagaggttgcagtgatagcgccactgcactccagccagggcaactgagcgagattctgtctccaaaaaaaaaaagcataaggaaaaggaacaattttagttcctcataaccaattttcatatgctatattgaatctttccaaataaatgatatttaatactaatgttttctgcttatttcccatgattcttttggtgtcttacacttttaataataataaaatattccggccaggcgtggtggctcacgcctgtaatcccaacaatttgggaggccgagatgaacggatcacctgaggtcaggagtttgagaccagcctggccaacatggtgaaaccccgtctctactaaaaatacagaaattagtctggcgtggtggcgcgcgcctgtaatcccaactactcgggaggctgaggcaggagaatcacctgaacccaggagctggaggttgcagtgagccgagatcgcaccattcgcactccagcctgggcgaggagcgaaactac

SEQ ID NO: 38721 - DNA, 1067 bp, Homo sapiens
tttttttccttttaaaagcagttttttattgtggtataatatacataacatataagttactgtttaaccatttttaagtgtatatttatgcagttcattggtattaagtacatttataatgttgtgcagccaccaccaatatttatttttggatcttttaaatcatcataaacaagaactgtgtacctgttaaacagtaattctccatttctctacttcctttagcctctggtaaccttgattctactttctgtctctatgaatttacctattctgggtacttcatatatgtggaatcatacaatatttgtccttttgcatctggcttatttcacttagtaactgttttcaaggttcatctgtcttgtatcctgtatccaattcgtatccctttaaggctgaataacattccgttgtgtctatgtgtgtgtgtgtgtgtgtgtgtgtgtgtacatatgtacacacatactgtattttgtttattaatctgttgatagaaatttgggttgtttccaccatttagcttactgtgaataatgctgctatgaacattggcatacaagtgtctgtttgaatacatgcttttgttattttagatgtctccctagaagtgaaattgctagctcgtagggtaattctatgtttaactttttgaggaactgccaaattattttctacagtgcctgaactgttttgcgttcccactagcaatgcacaagagttccagtttctcccacatcctagccaatacttgttactttccatttttaaaagtaaataatagcagccaggcagggtggctcacacctgtattcccagcactttgagtggctgaggcagggaggatggattgaggctgggagttcgagaccagcctgggcaaaatggcaagacctcacctctacaaaaaaatttaaaaatttcctgagcatggtggcatgtgtctgtgatcccagctactccataggctgaggcgggaagatcatttgggcccaagaagtcaaggctgcagtgagccatgatggcaccactgcactccagcttgggctaccttgcctcaaaaaaaa

SEQ ID NO: 38722 - DNA, 1082 bp, Homo sapiens
gatttattgatctggttttctgctggccaaaataaacaacaaattcagagatccacaaatatacacacaaagttctaccaaaactataaatatgttaaagaaatttttatacaagaagtcattcagaatatattggctaaatattgtaggtgcttcacttctgtctgggcaacagctccgttcatcattaccactttatgtgccttcaccgatgagatgttgatttgaagttttatttgaaggagagctttgaactggtaagtctctcatttaaagtcagtattttatggttttctttctttcatttcttttatactttttctgattactttaaaatataaaacaattattcagtatgcatatagttttgaaaaattagaattaaatctgaaattaagctgcatagaaaatataccactttttaaacatgtttataaaatgtttacgagagactttttaatcattaaaaaaaagtttggatgtatataaacagtaatacaacattttacatttttgtgtaaatatctaggactttacaataaatagctgagttgtcttcgaaaacgttgtatttgactttctttgatggcagatttactgtagttatacattttttaaaaactgtctttacggtgctagctgtcctgtacatttcatttctgaattgtactatttggttcatcatgagtctcaggcacatcagctttttgaacatgtatctattaacatgaacctgttaatagatacattagtttaatcttctagaatttcaggccggtgatttctcaatgaagggttgatattttcaagagtggtagaagtataactattttaccatggtaataccactggaattactttcttttcattagctaaggctttctttcctttcagttcatttctttgtttctctatctttctacccttaattttcaatctaagacaaaaaggaaaaatgaatgagaatatataaaatccataactaaataaacagaattatgtgttcatttattgtagggttcaacaaactatgatccatgggctaatcttgcgtgccacctaattcagttaataatttttat

SEQ ID NO: 38723 - DNA, 1050 bp, Homo sapiens
ctgagctatttttcttttctcaggtccatatggatcattggtttaaactattatagactggtttctccatttgaaaatgagtgtggaattaagagaaatcctttattaaatttagttcacagtgtcttcatatctttccccttctctttcacagaatcttctctttgtctttgggcttctgcagtttcactgtgcttcttttaagggatttatatcttttgttagttaagaaaacattttagtcattatctctgtggattttacctttctacattattatttctagacctcctaatagacataaaaccatcatttaaaaaaaaaaatccgtaacctatattttatgtttaaaagcaaaaaaggaaaaaaaatggctaatggaatgaagaagtatatctctgtaccgtattctgaataatttctttagctctatcttccaatttacttttatctttagctctaagctgctatttaatccatacattggattttttttttttacttttaaaagatttcaatgacatttatcatttatagaactgctgttggttctctttcaaagttgtattttcgatagtgtgtctaattttttactgtttcaattctttgtttttcagaatttaagtgcttttaacatacatatgtctctaacttaatggtttctattaggttctcttattatctgatattcttcggtgctaaacttcctgaatatcagtactttacttaaattacatgatgtgataattttgggtggaagataacattgataattttcacatatttagtattctcaatgaactattcattgatgcagcaaatacatattgagcacagtgttctaagtgttggagcaaaacagactttttttgttcttgtggaacttaaattctaataacttgctatgcttattagttacttaatgattaatgttataaacaggagttgtcacattaaggctctaccctgaagtctattgtctgttagctacagtggtttttacgtttttaaatgcttggaagaaagaatcaaatgaattctatttcatga

SEQ ID NO: 38724 - DNA, 1028 bp, Homo sapiens
tctgacatcagtaaggtccatgtttgtaattggttttctagtcatttgatctcttttcgaacaaatggattcatctattcacagtagttctcttgatgctgtgcttgcattacctggaaaactgtcttaggctggggtagggcggtggatttaaagttttagggacttccagactgaatatatcatcatgattttattaatgggagtactctaatctgtgagataatcagccataaaattttaaaaacttatttacaccttatttcctcccagtaatttgatgtagattaccaaattagcacaaataaaataatggaaaatcaaaacaattaggaggtgagtagatgtgccaggatgctaaaataatttatatgttgtattttaattcaacagttgtctctgaattttctgggaactgaaattgtgtcctgtaattttataattgtatgataaaggaatctttacaaatttattttgctccttttgcctgttatatactgtgatctctctaaagtgattgttactgatatgtttatattattatttgcatctattgaagtataaagtatcaatttctgcctgtacagaaactttgatactaaggcaaaagttcttatacataagcacaagttgaaatgacagccgattgccatatttggctgtagtgttctccagatagcagcaaggcctgataagcaggggaaatgcttactttttactctctggagaaagctatcctaagatcctctaccctaattgtctcaaatatctttggaaagattcacatgaaaagaaagtaatacaataaacctccatgttcctacaaatttgcattgtctttaggaaaaaaaaagtaggcagttgaattattcttaaatccatgccaatgctatccaccatcattcccaatagctgtatgtttttactacttttaaatggttttcaaatagttgttgatagattgtcacattatagcatttttgactcatatttctggatctttttttacagttaaatcgtcgatctga

SEQ ID NO: 38725 - DNA, 1047 bp, Homo sapiens
ttatagtactaattgaaggtaatttttcttttctatattgtatgaaatagtccaacaagaatgtaagttgacatttttacaaagtcctacattactaataatgacttttccccggttttatgttttattttaacatgaaagcaactctagggcaggacttgataaaaacacatattgaaggtacctgtaagaataccatgacttgttaatcagatacattataatgaatgcattttttctcaaggataagaaaaatgagcattgatgtgtctttgtgtgtgtagtgtgtgtgtgtgtgtgtgtgtgtgtgtgtgtgtgtatatatatatatatatatatatatatatatattttttttttttttttttttttttttttaactgttttccttttcctaactcccttggcttattgggaagtattatacctaacccgtttcttctacctctgtttttctacctatttcctttcctctgtacaggtgagtataaaaaacaacagaggccggacatggttgacttagacctgtaatcccagcactttgggagggcaaaataggaggatagcctgagcccaggagttcgagaccagccttaccaacatggcgaaatcttgtctccataaaaaatacaaacattagccaggcatagtggtgcacacttgtagtcccagctgctcaaggtgggagaatcacctgagcctagggagatcaaggctacagtgagctgtggttgtgccactgcactccagcctgggtgacagagccagaccctgtcatctcaaaaacaaaaacaagagagtactaaactgttcttattttttgggcacagcagtatagaattggaagtggctacattaggtattaatgcctaactgttggttttcattttgctttttctggaaatgcagctatataagaaataaatacataggataggacagactagatttaaacttttatgtttatattttgcttcgcttctttaatagggatgtgattatattcccttgtttttctgtcatttatctaacctatgtgttttttag

SEQ ID NO: 38726 - DNA, 1313 bp, Homo sapiens
tattaatgtacatttataatattcttttccttttgaaaattttttttaaatttgtatatttttaatgtgttcatgtaaaaacaagttactatattttttttcttcatttgctaggattaaattggtattttagttgcatactccacatgataggagtataagaattgatataggaatttggggattttgtaaattatgctttgcttacagttagttccaaatatttcattccttttataataaggataaataatattagacatgaatctcattttattctaaattgagggcttatataatttcattctcgagtaattgatgttaatagctttttggagttttcatgaactatggagaagggtggaacttttatacattggacttgtgataagaagccaagattttaaattataggcttttccttgtgtcccaaatcatataccatatttaatctaagacttttgtgcaaaaatttcagccttaaaaaattttttttcttactccaaaggaaataatcatacctgatattaggatcagtctggaaccagtaaaaattttataacttctaggaaatgctattgtttcttgaagactatttctgtaacaacagtagtctcctccttatttgtggtttgatttaaccattcccttattagtagatactgaagttgtttctgaatttgctatgataacattattgaatttttcagatattgagaattatgtccaggtgagggaagtacatactatttataaaagtacaaaggaggtaccatggcattaaacatgaaaggacaagctaactcttctgctatgtagcaacactctcgggcatataataaaaccaggtgtagtatacagagcaaaaaacccatgtgctcacaaaaacatttgctcgtcttctggcaatgtaatcagaaagtgtggttgacacccattttatttatgaaatgtttttaccaatgcttcattttggtatattggattcggtactatcatcagtttcaggcacccattgggggtcttggaaaggatcgttagagaatagcagggaatattgtattctaacatatcttcaagtatttgatagttaaagcccttttaagatttttttatatttttgtgtattcatcttcctgtttgtttattttgtatattgacagaaatcgaaaaacaatttagacatgactcaaaacatagtatattatatatatataatgtatttaaaacaagttgatcacagtataattttgccttaatgactatagttactgcaactacagtgatatatcaacaatgaggtcttgcctctt

SEQ ID NO: 38727 - DNA, 1123 bp, Homo sapiens
ttccagactagccttggcaacataggaaggccctgtctctacaaaaaaataaaataattggcctggagtaggtagtaagacagtaaacaaactggaaagtccagctatttttaatttccaaccaaactgttgaatcaattaaaaaaaaaaacgagtctatagtgcctttcaaatgcctgaattttgacatttgtacatcagctgatggattaatattttgaattgctatgtgatggctctgcatgggcatggtggccagtgcttcagttttgacagcattaccatccttggtgatgacatggacagcaatgtttctacaattgtttgaaatggtaaatatatttttgattacatgctgccttttaggcatacgcttttattcattccaagtatttatcgaacctgctgttacaggatacagtgcatcctgcataaggatacagtgatgaacaaagcagacaagatccccgcagtcctgtagtttacattcttatgggacaaagactaatactgaacaagtaaaacatgaaataataatttccatgtagagaagtgtaatgggttgatgtgatagactgacagtatgatttctttaaatcgcatattcagggaaactctttactatgaagctaacatttaactaaagactaaatggggaattggcagtgccacgatcataagaatggcttttccagatagggaagaggttgtgctaagttactaatccaggaatgagtttggcatgtcaaagaacagaaaaaaggggccactaaggctggagcttagagaggaaaggagacaatgttatgagacgggtttggagagactggctgggacctacgtcataaaaggtttttgtaaggtgatctgaagcatttggattttatattagtgcgatagaagctttcagagcatttgagatagggaagtattgttacctgataaatatttgagatttttaaacacagtcttttgcatgtgatttataatttggcataaatagaagtttaaatcagtggcaatcagttaaggctgggcaagttcctctctaaatggaggtgtgttacaaaggaaaatcagtaatagtctgtaagtactcaaaactatctcagcaaggtctagg

SEQ ID NO: 38728 - DNA, 1056 bp, Homo sapiens
tttctttcttttttttttttttgttttctttttctttgagacagtctggctctgtcgcctaggctagagggcaatggtgcaaccttggctcactgcaacctctgcctctcaggttcaagcaattcttgtgcctcagcctcctgagtagctgggattacaggcatgtaccaccatgcctggctgatttttgtatttttagtagagacggtgtttcgccatgttggccagtctggccgcgaactcctggcctcaagtgatctgacggccttggcctcccaaagtgttgggattacaggcatgagccaccttgcccagccggtaaatttctaaggctagaatttagttcgtaatagtgtaccagtgttggtttcttttttgacgtgtgatggcaatattaaggtgttgacattagggtaagagatataagggtattctgaattgtcttcgtaacttttctgcaaatctaaaattatttcaaacttagtttactacaaaaaatagactttcaccactgaggcttatcgaacttttaatgaacagagcattctgatgttatttaaacaattcaggatagagaaataaatgctctctagttcattttaaacagcttgtaaaaatcttgggtttatgaaatgggacctctgaagctacacaaacgcaaaccctaagaagcaaaaatgctacccacctacacaggaagacagcagatgacagtagagcttctctgcctctggttggttaggggtagaaaagaaatagccactttgagattaaatcctaggcttgattttcaatgagtttggaatttgaaatttatacctgcaagagtaatggaatcctcaaattaagaaattaatgtaaatgctggccaggtgtggtggtttatgcctgtaatctcagcactttgggaggccgaggcaggcagatcacttgaggccaggagttcgaggccagcctggctgacatggtgaaacaccatctctactaaaaataacaaaaattagcacagcatggtggcgcacacgtgtaatcccagctactcaggaggctgaggca

SEQ ID NO: 38729 - DNA, 1050 bp, Homo sapiens
tgcgcttttatacaattagctataaggtttttgctttttttccccccaaattttgcttttttcccccaaaattagtgttgtgtttaaatagatacagtatttggatgtagtatttagatatagtacttagttactaaggattatgtttaaaatccttgatattgtgtgtatttgaagtttaagagaggaatttaatactttacaacaaacatactttatagcccctgacataatgtaatcatactacaagactaaatacttgttccacgattgctgatcttgtacgtaacgttttttgttctgattttggaattgtcctcaagacaatctcattcaacatttattcctttatttattaatttgtttttaaacaactaaaaaatacagtaaaattttacaaattgagtttcatttattggtatagttttgttattttatagtatcactttttatatggcaaagaagctatgatttgcttttaataggcttattgtaagtatgccattaactttttcattttgaaaactgtatttcctgttagaataaaactacataaatttcttttttaggaaagaatacccacctcatgtccaaaaagttgaaattaatcctgtaaggttaagtcggctccaaggtgttggtaagtgtgcagttttgttacacctgtgaaggatttcaaattgctgtatgaaaagtacaatggagatacgatgctggctttagaatattcccaggtataatagatatatatgtagaaaaccatttttttgtaactgatttgagaatttcttcaatggtaacctgatacctggaacagttgcacagttaggtgattacagtttgaaatcttttgattattttagcatttttgctatgttacaaatttgcaaatagtgtaactgtagttgagctatagctttgaaattgagttttattgaactatgttataatgtattatgtaattgtgtttccacttactggttttgcttctaaaatttagaatacattagggaaacactcaattaaaaagagaccacacctgctaaaact

SEQ ID NO: 38730 - DNA, 1509 bp, Homo sapiens
ctactggaccattattaagaacgtcaattcatcagaattctggaggacagaagtcacaaaacacaggattaacaaccaagaagttttatggcaacaatgtggaaaaggttccaattgatattattgtgaattgtgatgacagtaaacacacttatttacagactaatggaaaagtcattttacctggggcaaaaatacccaaaatcacaaacttgaaagaaaggaaaacaagtttgtcagacctaaatgatccaagtaagtattttactccctttaatattgcttatatcaatccagtatttttcagatatatttttacaaccactctccccaaccccatatatatttttaatataaatgtgagcttaaaactaatcttgttctcatcctgtccatcttaaatagttaaaaaaaacaaaaaaaagaaccacagaacttgaccctagtcttagatgaagtgctagttataaccagcattctgacttcggccaggttaatttaatctttctgatctgtaaatgggtagatttcctgctgatagtgggtttttttttttgtgggggggggggtgcctaaaataacataaagtatgcatagcccaataaaatatttgacatacaatatccttaccacatttgttcctaactctatatcctgtctttttactcttatgtgtatgtgtatggcatgcagtccttgtttataataaatagcaaaagattagaaattattggggactggttgactagagtatacagcgtgtatactctaaaggagtgaaagatctgataaactgtgtaatttccaagatccttaattaagtgaataatgcaagctacagataagagtgtatactgtggagaatgaacataatttcttctaaaaaatagaaattgggcacagtggtgtcccaactactcaggagactgagatgagagaattgcttgagtccaggagttgaagtgtagccagggcaatatagtaggaccctgttgctaaaaaaaaaaaacaataataataattataaacagaacactaggctttccttttaatatatacttgtgtagtttttcattaaaaatatagttcatgggcctttttaaaaaatctatatacatgtacacacatacgtctgtatgtatatatatatacatctatatatgtcaggtactgtgctaagcattttacataccatttgttcttgcaacgattctgtgaaatagatacccttattgtccctaattctacagagaagagaaattgagccaaataaccagtaagtggcaaaaccccacctctcaaatgctatatatgtaaatctgtttagatcgtctaatctggcctgttaggttttctgctaataaaagaccagtgttgaaagagaaaccatgctcaatatttgttcctgagactggacagtaaaattaaaaagacaggtagagaaatactgagatgatacttctctgggacatgtacattactcagtaaaaattaagcatttatgtttga

SEQ ID NO: 38731 - DNA, 1024 bp, Homo sapiens
aaaatatgatatataaaatatatatacgatatatataaaatatatattatatatatatacttgactacatggagtttcacacatatttacaatgcattctattttgtgaacaagttgtatgcaaattattttttacaccttaaattttttgggactctgaaatagacctactgttcttcttgtaacttgctgatattgctgtttgggtgagtggtgatggactgtaaaatcaaattttatatttgtatcatattttttaaaagataccaagtcttaatgctttcttcagatttaactttttatcagatagagtggattgtatcttcattcatttttattaattttagatctggaggaggtccaaagcaaatttaggatattttccactttggtaatttatttgcatttttaatggacagaaatgaaatataaaattataactatagttttaatataaattataaattattaaaatacttttagtcattttgtccagtgatgatgatgatgacaacgacagaactaacagaagagaaagcatatctcctcagcctgctgattcagcatgttcttcccctgcaccatccactggaaaagtagaagcagcgctaaatgaaaatacttgcagagcagagcgtgaactacgaagcattccagaagactcagagttaaatacagttacattgccaagaaaagcaagaatgaaagaccaggtacttttcacttttgttgacatttgttcagattaatgcctccattttggggtgtaaattttttttagaaggcagtttggtagtgccaagaaaaaatgatggattattaagtggggcttaaataccacatgggagattatttggaagaacattaagccatatacaaaaataagtttcaattaaacttaaggcttgaagtataaaaaattcaacaagaaaacacagtatcaaccttaaaataaaatgtcagtatgtacaaaaatttcttataaaatctagcagaggagagaagtcattttgacagagatata

SEQ ID NO: 38732 - DNA, 1080 bp, Homo sapiens
gcccatgagttcgaagttgcactgagccatgatggcgccactgcactccagcctggtcaacaaagcaaaactctacccccacacccacccccgaaaacaggagttgtgagaattaaatgagatcgtacatatcaagtagtaggaaaaatgcctagtacagtgttagaagtttatggtcttgtaggaagcacaaatacagaattaaagcaatgatagaagcattaacatggtacagtcctagcagatgagagaatgcttcattatctttggaggttgggagatatgagggaccaggaagctttcctggaagagcttacattatgacccaatatacattatgacccaacataacacatgtatacacctatgtgcaatgtgtttatacatttatcaatttgtatgtttttactggtttgtgatataaaatggacatgtatatgaaataaaacagaacttagcatcagtatgcatagttctctgtaatattttctagtttcttatactgtgtttcattaaacaaaacaaaacttttaaaaattgatgctggaatctgctgaattgattttatagcctattggtggttgcaactcagtttggtgggaaaacacattgttataaagagcaaagttttgatcagagaaatgatatcataattgaatttctgttaagaccattttgataggcatgacatcgtggaagtctagatgagaggtgatttaaggaaatttaattaagatgatttaagaagcctatttaagatattttagttgaaatgatgagacattttatgaggtagaattgtttactatatagaattagtagtactccaggactaattaagtggatattaaggaggagaggaaagggtaccaggtagctcctagttttctggctcacaagacctgctaaatgatgttggcactaaagcagtgaatgcagaaggagaacaggcttgggtgaggaggggataagttcccttttagaggtctgtgatataacaaaaggacagtgccaataagcagttgagcaaatggcgctagagtttggttgagttctgaccaacagagatggtaagatgtt

SEQ ID NO: 38733 - DNA, 1096 bp, Homo sapiens
gccagttttcccagcaccatttattaaatagggaatcctttccccgtttcttgtttttgtcaggtttgtcaaagatcagatggttgtagatgtgtggtattatttctcaggcctcttttctgttccattggtgtatatctctgttttggtaccagtaccatgctgatttggttactgtagctttgtagtatagtttgaagtcaggtagcgtgatgcctctagctttgttgtttttgcttaggattgtcttggcaatgcgggctcttttttggttccatatgaactttaaagtagttttttctaattctgtgaagaaagtcactggtagcttgatggggatgacattgaatctatacattactttgggcagtatggccattttcatgatattgattcttcctatccatgagaatggaatattcttccatttgtttgtgtcctcttttatttcgttgagcagtggtttgtaattgtccttgaagaggtccttcacatcccttgtaagttggattcctaggtattttattctctttgtagcaactgtgaatgggagttcactcatgatttggctctctgtttatctgttaatggtgtataggaatgcttgtgatttttgcacattgattttgtatcctgagactttgctgaagttgcttatcagcataaggagattttgggctgagatgatggggttttctaaatacacaatcatgtcatctgcaaacagggacagtttgacttccccatttcctaattgaatacgctttatttctttctcttgcctgattgccctagccagaacttccaacactatgttgaataggagtggtgagagagggcatccttgtcttgtgctggttttcaaatggaatgcttccagtttttgcccattcaggatgatattggctgtgggtttgtcataaatagctcttattattttgagatattttccatcaatacctagtttattgagagtttttagcatgaagggatgttgaattttgtcaaaggccttttctgcatctattgagataatcatgtggtttttgtcattggttctgtttatacgatggattatgtttattgatttgcatat

SEQ ID NO: 38734 - DNA, 1096 bp, Homo sapiens
tgttatctcttttttaagtgatccatacaagtggccaaaaagcatatgaaagatgctcaacatcagtaatcattagagaaatgcagcatcaaaacaatataacacagtgtcatctcacatccattaggatggctactattaaaacaaaaacaaaaaaaaacagaaaataagtgttgatgaggatgtggagaaattgaaactgttataaaatggtgctgccactgtggaaaacagtgcgtaggctcctcaaaaaatttgaaatagaactacaatatgatccagcaatcccacttctgggtatacagtctcgtgccacataacgtttcagtcaattatggaccatatgtgatagtgagcccataagattataataacgtatttttactgtaccttttctctgggcacacaaatagtttccattgtgtcacagttgcctatggtattcagtacggtaacatactatacaggtgtatagtgtagaagcagtaggttataccatatagcctaggtgtataggacactatgccacctcggattgtataagtacactcgatgatgcacaacttcaaattacctcatgatgcctttctcagaacataaccccattcttaagcactgcatgactggatgtccaaaagaactgaaagcagcgtctttttgttttgagttagggtctcattctgtcacccatgatggagtgcagcatcacagtcacagctcacgatagcctcctgggctcaagtgatcgtcctgcctcagcttcctaagtagctgggactacaggtgcacaccgtcacaccctgctaattttttcacttttatacagatggtgtctcactttgttggccaggctggtcttgagctcctgccctcaagcagtcctcctaccttggcttcccaaagttctgggattacaggcataagccactgctcccaaccagaaagcagagtcttgaagacatatttgcacacccatgttcataacagcattcataatagctgagtggtggaaacaatcctgctgtccattgatgaacggataaaccaaatgtggtgtatacatataatgcaatatgtatacatttccttccttaaa

SEQ ID NO: 38735 - DNA, 1031 bp, Homo sapiens
ggattttatttttgtaccccttaatgaagcgtgagtaagaatttcctttaaaggaaaatctttaaatcatgtaaatgatggcaatttttaaataatgagtatgaggtgaagaattcattttaaaacatctttctgaaatctcttgtgtatattcatatttgtactgcctgttttacaagaattaatgcagtttcacagtgaagcatgtaagatattgaattttagagacaatagaccagatacctttctaatctcattttattcattaatgtcaaataataccatttttaaaaatatggtgcttattgtctagcaagtaacctatagaaaagtattattttatacaaaaagatgattaggtcacataaaggaattggaatcttaagtttaaaatacacttctgtttttagccagaaaggagaaacgatggttggatttatgccatttttcaattaaaaaccatgtggactacttgaagcagtttctgagtaaatggaggtgtttaaagatttgtattattctctcccaatgactagatagtagtattttacaatggagacttaaaagttttttgtgttttattctttcgcttttctatgccctcaatccaaagaacaccagaaatacacttgtagtcggaaaacttgggtttatcacttgcatcaaggaatgacacacaccatgggccactctggagcctctcaataaaaggatgtttcaaagaacctgtgacagaatctgggctttccttgagtgatatgggggagggtctaaagtagtggtttgcctaggtaaagaagtagcattcactcattaataaagaagaagaatgttggctattttgtggtttccaactgtgaccttatgtttttctctgcttagacaaattatgatatggccctactttgtctcattctatcatggttgcagaatatgctttcctggagttggtattctatgagattgtttatgtctaataagcctagctgtgccaagctagcttctgaattttttttttttaacttttgtag

SEQ ID NO: 38736 - DNA, 1046 bp, Homo sapiens
ttcatattatcatagtaaaatttaaaataacatttaaaactagttaatttcttcattctcttcaaaataaggttttggctgggcgtggtggctcacgcctgtaatcccaacactttgagaggctgaggtgggcggattacttgaggtcaggggttcaagaccaacctggcgaacatggcgaaacctcgtctctactgaaaatacaaaaattagctgggcgtggtggtgcgtgcctgtaatcccagctactcaggaggctgaggcaggaggatcgcctgaacccgggaggcagaggttgcagtgagccaagatcatgcccctgcactccagcctgggcagcagagtgagactccatctcaaaaaaaaaaaaaggaaaagaaaaaaaaagacagaaaagaaggtttcttgactgggtactaatttgtcttgtaaagtaacatgtgaacagcttactaggtgaaagggaggaaagcgatttgtcagaaatgagttataaaaattttaaatagaaatattatttgattatacacgatttaggaatagaggcgcatccctcttagtcactatacctctgcatggaagttattatcagtgcttccagtcatcttagtgagaggtagaaaatgaactctgtaagagagctctaccatttgtagattaaaaaatagcctataaatcaagagagcttgtttttgtttttgcttttttttttttttttttttgaagagacaaagctacaaatacttatacactaattatgttagattggctgccatatatttgtcatctgttttgtttttattttttctggtagtaccagttttgtttttcttttctttctttcttttttctcgagatagggtctctgtctgtcactcaggctggaatgtagtagcatgatgtcggcttactgcagcctcaacctcccaggcttaagtgatcctccgacctcagcctcctgagtagctgggactataggtgcatgctaccacgcccagctaatttttgtatttttttttagaggatggggttttgccatgctgccc

SEQ ID NO: 38737 - DNA, 1042 bp, Homo sapiens
ttctgaactgctataccaatctctaacagattcctatgcctcctgccttctggttttcatggttgtttcccaaaaacataaatctaatcctgttactttcctgctttaaatcttatagtggcttcctgtggctgttgatttacagaccaaaatctttcacatgattgataagcacctatgtgatctgaccccctatttaagcttctagcctcattttcccaccattttcactctagctttaatacaacagccagccacctgaatgccattgtttcatgttctttcttgcctctaggccttgattcatatttcctaacctggaatacttttttgttgcttctattataccttgtctgtctaacatgtattcattcttcaggtcttagcctaaacatcacttcctcttggaattgcataaaaccccagatatgtattttcacagtactctatacttctgtcataatacttgccatatttcttgttttaattgttgaattacctgtctttctaaactggagctggcaaacttgttaataaagtagtaaatacattaggctttgcaactgtgcagtctctattgcctcttagttctgctgtggtccagtgaaagcatctgcagaccatatgtaaatgagttagtgtggctgtgttccaataaaactttattacagaaacaggtggtgggcagaatttggtccactggcaaaccctgatctagactataagatctatgatagaaactgtgtcttgtatctccaatacctaacacagtacttggcatgtgatagataatacagaaatacatattgaatgcgttgttgggttttcttatttttaacttcggaatgtttctgtgattgaaatgaaaggttatttattacagttttctaatacgcatttaattgtattttcagaatccaattctcagttttgaactacctatgaatttggcaaactggtttcctccaccaagaatgagaacaaaaagagaagaaatccgaaacataattctgaagctacaggaagatcagagcaaagagaa

SEQ ID NO: 38738 - DNA, 1040 bp, Homo sapiens
gaagtcaaataatagaattctagggttgagatacctgtgctacagcttaaaccattaagtcccatatcttggagggtggcatttgtcagtactttttcaaagatccccaggtagttccaatctgcagttcaattacttatcttttttaaaaattaaatctttgtaagtaaaactttcttgtcaggtgttgaggaaactcttggtaaccagaatgttttaaaaatttagtttttgtgtactaatttttaaaatgtatggtatcttgtggaggagttaaaaaagtagaacactctctgggatagagacttaagaattatttaaaattattaaaatggtacacttgatacaaaatttgaaagtagaaattaattctgttgaaactaatactgttgagtctacttttctgtttctggcctaccgtatctaaaccactctaaacaggtcactcacttgttttatccttattttaatgagcttctgagatgaagtttctgtaacctctttttgtctcctgtttgtcacaaagattcttcatgtcttacctaaattgctttgtttacattctatgttcggagatgtaggtaggccatttgatcattgatgtgagtatacacactcatacactatcccccacccccgtcgcacagtttaaagccttctcattcgcatagataattttgtaagtctgaatagcctaatttagataaactttcttcgtagttcaattagaaaactctccattttgagtgcttggttaggttttaatataaaggaaacattttacattaggaatcattgttttactaaccttactgacaaaaagaaatagtgatgaggaaatgactaaaaccagttcagacagtattgagcatccagatactacaagggttgagaacagacgggactaagaacacatgtggagaagtcagctctgaaaagagttttggatcaccttcaggtataggtggatgaagttaccgatgtgttttcagttggagaggcagagtgttgaggaattttatacctattgtgttgtattt

SEQ ID NO: 38739 - DNA, 1036 bp, Homo sapiens
aagtagaggggttggcacagttcagttgacagccagttgatggacaaagaggagccttgtcctagtgctctgttatgtggctatggatgagtcacttaaatttcctgcctgtttttgtttttggaaatgaaaacaataacactggttatggattgttcatattataaaaacagttaaattctgatgttctgccgaaaaattggttcatcagtcggttataattactgttgctacttggttctaagtttttaagttttagattaagatggatttcatggcttgatccagtccagcacattttaaatgatttcactttatagatattaattagttaccctggatgatgagaaggggttatcagtatcttgttaacaaaagaagctgttaaattattctcaagaatataaggtggactgtatacttattttttacaaagggaaaaaaggggaatttgtgccatggaaactaaagatcccatttatttttgtcattatgccaaaaaataacaacagtgttttctctctggcttatttagagtggtagagcttctttgacgtttcctatttctacctctgcttgtatcgagctgtagaactcttcatttagaatataacattttcaaatattgaaaaattacttttttttttgtgggattgccactaggtggtgggtataatatgtgaggaatgatcagcagtaataatagttctgatagtttcgggtacctatatttttacattgttgtgctttttcattattgtgtatatttgaacatttctgtgaaacttagtttcttttcataattattttgtttattttctttagagacaggatctcgctctgttgcccaggccaatgtgtggtggtgtgatcatagctcactgcagccttgaactcctgggctcaggtgattcacctgtcttagcctctcaaatggttgggattacaggtatacaccaccatacccagctaaattttttttttttaatttttttgtagagacaagatctcgtcatgttgaccaggcttgtcttga

SEQ ID NO: 38740 - DNA, 1086 bp, Homo sapiens
gaattattctataaagatgtgtttccttgttaaacattggacttcttgataaacatggagaatgtctacgtacatttatatcttctttctcttctgaaacatcattagaatgatagtataggaattaaaaaaaattacatagttgggaacatccctaccaaaaagttagatgtgcccagttactctagaatgaagtcataggtctccatgtacttacatcgagctgctggttagctacttagtgactttctaaatatgaatggaaaacaagttgagaaaagcctttccatgagaaagaaaaaagcaatagaaggagaaaagcagccagaagtaatcagagacaatggagggaaagtaaaaatgtgactgtagaaataaaattttctgtggaagggttagaaagtcaagtggaggacattcccaagacggtggaataaagggataaatatataggtaatagaagagaaaagaggcaagagtaagagtggcaatcttatagaaggagaacattaaattatagacctcagaaggcaagaactgaataggaagacatctaaaaaatagaaagaatatcagaacattcctcattgtatgatttgtgcttccagactaaacatgttcttaatgtatgtagcacaatgaattcaagcaacacagagccatattatcatggaagtttagggcacccaggattaaggcaagatccttcaagctttcaagtaataggggtgaaataaaaaggggtacgaataatcaggaacctaaaaggcatagcagttctggatgctaaaatatatgttctcaaaatcttgaagaaaaatgactttcaacccagaactcaattatatgtgtgtgttcaatcagtaatttaagtatgaaggtagaacaaagaccctattgagcatgaaaggactcaaatacgtacctaggagcgagcagtgaagggaagccccagaataatagctggcagtagtttcagagagcagccaaacaagggaaggaggggtgggaggcactgttgttggttatataagcaaaaaaaataaaaaaaataaaaaaaaaaataaaatgtgctcttttatcacc

SEQ ID NO: 38741 - DNA, 1034 bp, Homo sapiens
acctgcctctgccttctgaagtgctggcattacaggtgtgtgagccaccgtgcctggccacatggggcgttattagcatattaataacattgatgccatgattagccatatggataatgtttaaagccgtaagactagatgtattactttgttttcacactttataaagaacttccctgagactgggtcatttataaaggaaagaggtttaattgactcacagttttgtatggctggggaggtgtcaggaaatttacaatcatggcagaaagtgaaggggaagcaagcaccttcttcacaaggtgcttcacagaaaagaggagggagaaagagaagagcggggagaggagggaaagagagggacgagaggagaggaggaggagggaggagaggagaggaggggtggttgttcttgcatggcttaagaaggaataggatctggtgggtgagtagcgactggttttagataggagtaagaataatttggacttagtaacagaatgaaaggaagactgtatgggcacagatgcagcttgatatgtagaggtggtggtgagagcttaatttttttttttatgagaaaacttgcatttgcattttcagagatagtttagtagaatactgtcttcaaagcatgttgtggagtggagttgaaagttaaagtggcccttggaaatctgaaaaaataatttgagggctgggcacagtggctcatgcctgtaatcccagcactttgggaggccaaggcgggtggatcacctgaggtcatgacctcaagaccagcctggccaacctggtgaaaccccgtctctactaaaaatacaaaaattagctgggtgtggtggcaggcgcctgtaatcccagctactcaggaggctgaggcaggagaatcacttgaacctggaaggtggaggttgcagtgagctgagatcacgccattgtactccagcctgggcgacagagcaagacttcatctcaaaaaaaaaaaaatgtgattctcatcttatagaatatctgaatatacttattgcata

SEQ ID NO: 38742 - DNA, 1033 bp, Homo sapiens
gaaaccatacaggggtaatggaaaaattaggttagaattcaccttaggcaaaaactgtaaacaatccaaatattcatcaacagagcaataggtgaacaactgtggtatagtcattcattggactagtacgcactacaaggttaaatatgttgaaagcaaaaacagtttgttgaatgaaagaagacagacatgaaagaatacatactgtatgatgtcacttatatgaagttcaggaataggcagaaactaacagaacagtaggaatgcccatggggaatggttattgaccaaaaggagtcatgagacaactgttttgttttagaaacagggtcttgttctgtcacccagaatggattgcagtgatacagtcatagctcactgtagcctcaagcagtcctcctgcctcggcctctcaaagtgttggcattctaggcgtaagctaccactcatgaccttgattggagtgtttcataaatggctatatccatttgtccatattcgtcaacttgtatacttagatttgtacatttcactgtatgtcagttttacctcagtggaaaataagaaaacaacaaaaatggcatactgagtagttccgtgaggatgagcttcgggagcacatcagtccattctcagagagtgagggaaagtttcccagagataataatctctctttttatccttttacttccacagttgatttatttttttcaactcttagctacctccccacaataatatctattcctatgactatttaatttattgtgcaaatgcagaatactttagggagcaaaaaggagtgctggtataaattacactcaactggtaaaaactatcattgtttgcttctgttctagtcagagggttgtactctactgcagtcatacctgaaggaaggcagtagtagagcaggtgtacctgagggtggaacaacctctgcttggcctcatctaaaagtagataaagggggccgggcacggtggctcacgcctgtaatcccagcactttgggaggccgaggcaggcggatc

SEQ ID NO: 38743 - DNA, 1056 bp, Homo sapiens
gaagttgtagatgtgagagctggttctgctcatgtctgactaacacagaggcttgtgataattgtcccttctttctcccaggccactgaaatttgtcatctatgaatgaacagactaaaacagatgtcttaatgattttcagatctaatgttctgtaatgctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaatacgcgagttaaatatttgtaaatgatttgagtacttgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaatgtaatgaatgttagcatacatttcatttgctctctagcattgttataccaaaggagcatatgtgggagattctaacacaaaaaaaagtctttacaataattaatacacactttagaaatgttgttagaagtgataaatggcatcttcacacctcttattattaccctgtggtagaagatgcagttgtatagagtattataagtgttgcatgatcaagttatttgaagagtatgaaatgcccaaaaggtaatgctatttgcgttatctcttatttttcttctctaacttccttctattgagggtaaagtgaacagaaatcagggaagattggaaagagacagggaatcaataagattaatatgtgattcaattaattattttaaaagctaagattttattatatttgtcttcatccttcctatgactcttcctatagatccaaatggtttctttctaattagaagtgatttcttttttccctagggagcttaatttggcatgtc

SEQ ID NO: 38744 - DNA, 1091 bp, Homo sapiens
ctcaaattatatgcataaaagtcttaaaggccaggtgtggtggctcacgcctgtaatcccagcactttgggaggctgaggtgggcagatcacttgagctcaggagttcgagaccagcctgggcaacatggcaagaccccatctctacaaaaattataaaaattagcctggcttgttggtgggtgcctgtagtcccagctatttaggaggctgaggtgggagaattgcttgagcccgggtggtggaggttgcagtgagccaagattgtaccactgcactccagcctgggtgaaagagccagaccccttctcaaaaaaaacaaaaaacaaaaaacaaacaaaacgcaaaaccaaaaaagcaggccttaaagcactgcgtagcactgttttgaaaaagttgaatttatttcattttattgactgctttggattttatttctttcctctttccccatatgtgctactaaatgagtcatgatacagcacttgtgccctttgaaatctctgttatttacctcatgagctaaaacctcttgaatttactagttttcttattacttatgagggtgtgttttttgtgtgcttatagaacttttctaagtgttcttatagcagtgaagcctacaaagtaagagtttccagattccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgaggatttctttcttgattttgaggaatatatgtcagtatatttttcaactttaagtgttcgtatatatattagtaaaaacattgaaactgaagtctgggggaagtttgtggaactagaatattagaatcaaaagtttggatttaaaatctaatgtgactatcgagtggcatgctggaaatttttaatttatttggccatcttttagtatgccat

SEQ ID NO: 38745 - DNA, 1050 bp, Homo sapiens
aaaatgcttctcatgatattaatagaagattatttttctcaaaatcatcttggtgttatatatctatttcggcttttaaataaacttgagatttaaaagaaagtttaaaatggaataaaaacagcaagtgggaaatagcagttaattgccactaaatacagttttagtactgtcatcacctaatgtgcgggtgacactacaggagagaaatttctttttagataaaaagcaaataaagtcataacataaaggatttgaaatgcttttcaacattcttttgtttttcagtgcaattttactgtattgtgataaatattgtttaaaaatgaaaaccattcaacctttatacaaattaaaaagaataaaactattttcagtacactcagttaatgacaacatttagttcctgcaactgcctatgctttttacttatatttaaagatttaatggccaggattttgtgaaatcagagtatgttctagtggtggttaggttacaggactgctgtttctgattccaaacattttggagtacgtgcctagtacgtgccacctccttgtaacaagaaacgaagagtgggtttatattgaaatcttgtatatcaaatgagagaatctttgtcttttgaagtagaaagtatctccatcacccgtttctatcttcaggcagataatacattatttttctgactttaaaggtgtgactttaggttcaaatcacttaggcccagatttctcaaaggtcatataacaagaattagatagaaattagaaccctggattcttatctcttgagaagcaacttccacaatattctgtttgttgccccaatgcttcctgtaatcattttgtgatttctccacttaaaattttactatgtcaaggaatttttaaattactcattatgattttagggatccacttggcaaaacttatttcgtagtagtaggaactgaaaaatacctttcaaaacagtatgaagagcagtctgatccaaattatccaaattacagagattaagagctggtagtatgttatagcactcctccag

SEQ ID NO: 38746 - DNA, 1032 bp, Homo sapiens
tccagaaactacacagccaggcttcatggaaaactggaatgtgtttgaaaccactgagttgtcctaggaactgacctttcagatgcagaaagagagcattagagctgcttgttttaaaacatgactaaatgagagtttggctaaactctgctcctcttccttctgctttacctttttaatgttttatattcagatttcttaagagagaatctgattatattttgtatagggattccaggtagccagaatttatatcatatcacacagtccaatacatgattgcctttaggtcagcaccagcagtcagtggaaaccaaagtattgggatcacaagatacaaaatgtaccaacctaagcattaataacaatgtgtggctttatgactatggatttagcaaacactagagcctaatgtataacacataccagtattcttaagtactgttaaatatatggaatgagattagatggttggtagacttatacaactcagtagaagaaaagcaaataacctgattttaaaaatgaacgaaggacttgaatagacatttatcaaaagaagacatacagatggacaaaaggtatagaaaaaggtgttcagcatcactaattatttgagacatacaaatcaaaactacattgagctataacctcacacctattagaatggctattatcaaaaaagcagaagattggctgggcgcgatggctctcacctgtaatcccagcactttgggaggtcgaggtgggcggatcacgaggtcaggagttcaagaccagcctgaccaatatggtgaaaccccatctctactaaaaatacaaaaaaattagccaggtgtggtggcgggcgcctgtaatcacagctactcgggaggctgagacagaagaatcagttgaacccaggaggtggaggttgcaatgagccaagattgtgccactgcactccagcctgggcgacagagcaagactccatctcacacacacacacaaaaacaacaacaacaacaacagaagacagtgtcgatgagaaag

SEQ ID NO: 38747 - DNA, 1052 bp, Homo sapiens
caatagcacaaaggtcaagaagggaagaacagaagtacagtgttataaacttcttatatgtgaaatgatatgctagctcttgatggtagattgtaataacttaaatatgtattctgtaaatcctaaagcaaacactaaaataatggagttacggctaataagtcaatgaaagctatgaaataatataataaaaatatcaaaaagaaaacagaaaatgagtaaaggggaaataacaagaccacaggtttaaatttacccatgtcaataatcacgttaaatgtaaatggtccacataccttcattaaaatacagatattttaagttaactccacttacatgctgcctgagagaagtgtactttaaatatgaagacatatgttggttaaaagtaatgggatggagaaagatatgtcatgctaacgtaaatgaaaagaaagctggagtggctatagtaatcaaagtagatttcagagcaaagactatgaaagataaagacagtcatttcataatgataaaagtcaattaatcaagaggacatacagcactaaatatttatacatataataaagcttcaaaatacttaagggaaaaatgatataactacaaggaaaaataaataagtctacaacttttgtagatttcaataccccccttttcagtagttgataagaccatagacagaaaatcagtaagaatataacagatttgaatcacactgtcaaccaatttgacctacttgacatatatagaacactccaaaaacagcagcctacacattcctttcaagtgcacattgaacatttgccaaggtagaccatattctgtgtcatataaaagtatttggccgggcgcagtggctcacacctgtaatcccagcactttaggaagctgaggcgggcagatcacctgaggtcaggagttcaagaccagcctggccaacatggtgaaaccccgtctctacaaaaatacaaaaattagctgggcatggtggtgcacacctgtaatcccagctactcagcaggctaagacaggagaatcgcttgaacccggga

SEQ ID NO: 38748 - DNA, 1046 bp, Homo sapiens
atttctttccaaaatctataaatctttgaatatagtcccacagaatacttatgttcactttctatttttaaaagactactctgaaaaacactcttggataataaatgtattatgtgcatacttatatactgacagttcatacaagcacatgtgtaatatttctattataaggacagatattgacccttgcatttcataatttttaaagatatttaagctaaaattttctcagccacatttttatataaaaccaaattttatgtaaaaactaggcttcaataagttagctaaattttttaaattgtaagacaaaatttttatggaaaagaattcctatatcccatcaaacctaataattttccacaactaaaaatgagtataaatacataattttaagtgcatcctgtcaggtctgatatttaattttactttagttagaagctaagtagttaccctgttacttcttcatggatgctaacagaagacttgagattcccagacagaaacaaaggactattactcatggcacaacaaggagcatgagcatcagcacattctcattgcttccccttgtcccaggtcccatgggggcaaaatgatatggccatatgcaatatggctacatatacagcaggcttttgttgtaggtaaagaatactgagcttggagggttcactgctttttatccatgaacagaagcaaacctgctctttgcctcatcccttatagatgctcactcaaaactcaatactgagaaatggcccaggtaaagaacagccaaggtctttcatgcttgccacacccagcaatatgtttaggaaggtgaagtctactgagggctatctcacatctaacagtttctttactaggaccagagaccattttggtaagatgcagataacaaccccaaccttaacaacttcacaacatgaatagaaatagtgataaataattcatagctttttacaaaagaataatgaggtataataggaaaatgttttgatgccaaaaataaaagagttaatgtttggatcggactccaacag

SEQ ID NO: 38749 - DNA, 1050 bp, Homo sapiens
gatcgcaccactgcacttcagcctgggtgacaaagtgagactccatctacatacatacatacatacatacatacatacatacatacatacatacatacataaaatgcccagtatcttacaagactgtagttcacagtgggtaattcaaatcagacactgctcttcaagagaggtaatattaatagaaatctttcaagaaggattgttttctactattaaaacaataaaactcttataaacctgtttatcagaaggatatttctgtttcagcaactcctggaatccttcttcaacatcccaaccaacaattactcccagatagccatgtcacctgtgaattatcatgaatcccacatcaaatgaacaaatactgcctctggactctgaatgtaagttggttcattataagagtgagaaaaagaagactaagaaaaagcatactgtattctttgctacatagggtttaaactttattaggaggccaggcatggtggctcacatgtgtaatcccaacacttcgggaggccgaggcaggtggatcacttgagaccaagagtttgaaaccagcctggacaacatggcaaaaccccgtctctactaaaaatacaaaaaaaaaaaaattagctgggtgtggtggcacacgcctgtaatcccagctactcgggaggctgagacatgaaaatcacttgaacccaagaggcagaggttatagtgagctgagatcacaccactgcactccagcttgggcgacagtgcgagactattgcaaaaaaaagaaaaagatgtattagggttttatatgctcagtataattaacaagacaatattagtgaaccaaaaactaaaaataatttacacactaaaagatgaaaagcccaggtggcaggtgaaagttctaatctaaaatgatcctgaaataagttactgatccctgaattaaaaaaaaaaaagcctcccaaatgccatgtcgcttaccatgtgataggcaggggtcaggcagtgacagtacgtgtgggactgtatgtccatttttcagaataagacactttt

SEQ ID NO: 38750 - DNA, 1028 bp, Homo sapiens
gggaaatggcagatgaaacaaagtggacaaagaacagattgaggtcactttttcattgtcctcatcttcttgcttcacttttcatgagataaagctgaaaagtacatatttttccgaaattacacgttgtcacctaaggttactaagtgacctcatttttctacaaaattgtttgcccccatttgcccatcagtgatcagagctagtttttgaaaatattttaataagagttcgtgtttatcttaaagctaagtataatgtgtaagtattcaaatcaccaaaatatttttgaaaagtactgtactaatctcaataagtacatggagtgttacaatttattgactcacattcctctactccccaccccaagaaaatgattagggaggatgattcagttacaaacttacactgcaaaaggaaaatgcatactgatcttggattagggttttttttccccaaatatttacaaaaggatgattataccagtgttttaggggatttttattccaggacttcacctttcaacataaatggtaaaatgtgcacgtgtcattttatatattttatttgccaaaaagaggtattaattaatcacattattttctgccctgaaatcccaaaatactatcttaaatgatgggtaaagatcttctctgaaagatggtggctattttttcaaggatgaaagaaataaagtaagacaatattcttcgaagactgagcagaatcattgtcataccccggagagatgaaatgccatattgatacagctgctaggagaacacagagttgcaaactgtcactacactatttgtacacaactccacagtgatgtcttccatgatgcatctctaagcagtatatgaggaaaaaagatgaaaaacaaggttactaactttgctgtgcaaattattttagaaatatttacccttaaaatgctaggtgtttttctagttactgtgtgaatctgtcactaatttttattttttggtattggattgaaaactaattagaaacattaccatata

SEQ ID NO: 38751 - DNA, 1056 bp, Homo sapiens
gttttaagtaataacatgatcagaattggatttgctgtatacacacataaatgtgtatacacacatacacaccaccaccaccaccagcaacagtgcagggagtgagctgcagtgatacaaaggaactacaggaaatgttgtcaataacaggtttgttcctaatagcaaaaggtggaaacaaccaccatgtctactggcaacagaatggttagattgtgatgttttcacacaataaatattatatagcaataaaaatgaatgaattttaccttatgtaaaaacgtgaataaatctttgaaatattacaaattattatcgtatgaagagacaaagaatatgccaccagaaatgtggaaaaaaatatattagcacccaggctcttgatttgttaaagagaaatgtactatccatgtttacacttatatacaatatctgcaatttattaaatttattacataaatatttgaatgtttataattcataagggatctataagcatatatatgtgggtgtgtatgtgtgtgtgtcatggtctaaaatggactgcaaaatcatgattgattccataaaagtataagtcatggccgggtgcggtagctcacgcctgtaatcccagcactttgggaggccaaagcaggcggatcattaggtcaggagatcgagaccatcctggctaacacggtgaaaccccatctctactaaaaataaaaaaaattagccaggcgtggtggcatgcacctgtagtcccagctactcgggaggctgaggcaggagaatcccttgaaccctggaggctgaagttgtggtgagctgagatcacaccactgcactccagcctgggcaacagagcaagactctgtttcaaaaaaaaaaaagtacaagtcattactggggccgggcgcagtggctcacgcctgtaatcccaacattttgggaggccgaggcaggtggatcacttgaggtcaggagttcaaaaccagactggccaatgcggtgaaaccccatctgtactaaaaatataaaaattagctgcgcatagtggcacacacctgtaat

SEQ ID NO: 38752 - DNA, 1042 bp, Homo sapiens
accacatgcttggccataaagcaagtgtcaataaattcagaaaaatcaaatcataccaaacatactctatgaccacagtggaataaaaatagaaattaataccaagaagatctctcaaaaccacacaattacagggaaattgaacaacttgttcttagactttcaagtaaacaacaaaattaaagcagaaatttaaaaagttctttaaaataaaggaaaacagaaatacaacataccaaaatatctgagatgcaacaaaggcaaggttaagataaaggttatagcactaaagaactcaatgagttagaaagatctcaaataaatgttctgactcacaccaagaggaactagaaaaacaagaacaaactagccccaaagtgaccaaaggaagagaaataactaaaatcaaagcagaactgaatgaaattgagaaccaaaaatccatacagaatcaatgagacccaaagctggctctttgaaaggataaacaagatggatagaccacgaggtaggttaacaaagaaaaaaagagagaaaatccaaacaagcacaattagaaattacaaaggtgacattacaactgaccctacagaaacacaaaagattatcagagactattatgaacatctgtatacacacaaactagaaactctagagaaaaatggataaattcctggaaatacaacctcccaagagtgaatcaggaagaaactgaaaccctgaatggatcaatattaagttccaaaattgaatcagcagtaagaaaattaccaatcaaagaactcccagaccagatgaattcacagccaaattctacctgatgtacaaagtaccaattctactgaaactattccaaaaaaatcaaggaggagggactcctccctgactcattctatgtagacagcatgagaaaagctggaaaacacataatgaaaaaagaaaactgtgagccagcatccctgatgaacttagacacaaaagtcctcaacataatactagcaaactgcatccagcagcacatcaaaaagttaattttggtggg

SEQ ID NO: 38753 - DNA, 1013 bp, Homo sapiens
tgaagtttaatatttcactttttctttagtaattttcagaatacattaattgatctagtactctccagaggtggttgattactttcttttttggaacatctttatgaactcatggatttttacatatttggtgtgcatcagtgtattgctatcattattattacctttttaatgctcctattaccacatctttagccaatgcataccctttcaaattagtgcttgtgtccttttgacatgatcttaatcatttttgatagattccctgttcttgggcattcagtgaatgacaatagtatactgaaacgaattaagataaaaaccaattgcttagagctagataaaaatttacaagttaataattttatcattaaaataatatttataatgaagatgtctttcaagatattaatttgccaaatacttgatagttaaataaagaaaaagtcagtgaaaacatttttagtaagatatgtgtgagaaggatactgagtagcacttgcaatctggactggatggctatttttcttcatggagatggaaaggtgccacaacaaaggtagtgctaaggtgaatatttctcctctgtgatgaaaaataactcacaaaattggcttctttgttaattttttttcaaaaccaaacactcagatcatcaacagcaaacaaaattgtgaatgtttttactgcacacaataaaaatgctacgatgaaattgaagcttgcttgttggatgaagaaagctgattgtgaggacctcgagttcttggaatctttagttcatttacaagttatgaaaataacagcttcggttgaaaaacaacagcattgcttatctttcctttgatgtagattgcacctggctgagcactactctaggaaatgaagtgttctcccttgtacctttagtagccttcaagatctgggaaagtcagtgcaaacctctactggtggccctggaggtaagaagagtaggcaaagagaatgatttagcaggtagctagaattctagg

SEQ ID NO: 38754 - DNA, 1067 bp, Homo sapiens
gcattttccaagatcatccaactggttaataatggaggcaggattaagtcccaaatttctgactaaaccctgttatatgtttcactacattattgctgtcctcagcaggaacaacgctaaacacttgtaccataaatggcatgaaggccattttctgtggatggaggttagtggttgccttacccatttcccatggataaggcttgtgagagctaattttgcctacttggtgtatgccagggtactgtcttcagcccagagcacagcagaaggctgaagtgcaaaatgctggtgcagcatttttgacagatcctgaaagcaagcctttgttgtctgtgactgctgagttgtgctatgataattgtggttcacaatgatgtccctaaggcactacaagtttttaggatgtgatctgaagtatcgaaaagtagttatatttagaacagtcttagtattcactacatatgatggcattctaaggtgacaatatggcaacccacacaatttatttaattggactttaaaataagattcgtggaatataatttagtagaagaatcaaggtatacagtcatattacttgttattatagtttatacttgtaatagttttacttttgcctcatcaaggctttgctgactattatggtatggatgtcattcactctttacctctttgaattactcaagttcattaaaacacaattaattcatcaattatgcattcatttaataaattcattgtgcatctaccatgtatcagacttgtgctagatacaggggagatactgatgggaaaaaaaaactataaagtatagcaactataacacttatagcacaataaatatgaaattacaactgtgatgagtgttattgaagggaaggtattcctgtatcacagtttattaaaggcagatttgatgaaattgaagataatagtagaggattccttgaggaaggaatgattaagcaacagtctgaagaagtagcctttaactaaacaaaaaaggcagagaaggggcttccaggcagaagagcagcatgtatgaagtccctgtggcatgaatt

SEQ ID NO: 38755 - DNA, 1045 bp, Homo sapiens
cttaagttgttcacaaattactacacgtcttagatttctcctcactcccaacagtattgtaaaattcttcttcgaatttcatctcaatgtctaggatagtgttgagaaatatttaggaaatatttttggattaattagggtattcgattaatctgaatacttcggttcccaacatttctagataaaggaagtttactgtaacatgtttataaaaggcaaataagctagacatctcctttcaaataggatttcaatagaaatcttccatttttttaaaaaaaggtcggctatacaatatctgttttaaaattaacaaaaaaattacaaaaagaccttatcccacaaaagagagagaaaaaaagtttgaaccctctcatttttattttgaggttaataaacttcattttataaatttatagatccattactagtggaataaacattcacatgggtgtgttgagtagtgagaacgtgagctcttttttgaggaagcagacggtgaaatgagacacgagggatggctctgggcagagataagggaactcctgccaaactcctttcctgcttgttactgtccacaaatatgtgtgtggttgcaatcgagcttctttgaggccctgttccatgccagaggctgataaaaaaaatgtgaccatttagttacaaatggaaatctcacagcatgtgaagcatagcaaccaagagagtcccaaggagattacccagcaacaatcagaaagttaaaaacaaagcaacacagtaaccaaaacataacccaaactatagagccaaggaaagcaggaaacattctaggcagagcagagatgctctgtgtcaggttcaattcaacagtgtcacaagatttgtacttcctcactcatatttagcagatgcctactgtgtggcagtgctttgccaggggctaggaattttaaattgagtaagaaatagtccatgtcttcaatgaaataaccccagcagtacagtgtgacaaatgctaggaagaggcatcagcaaagtaccatgggagaaaaggagatttggg

SEQ ID NO: 38756 - DNA, 1050 bp, Homo sapiens
ccagtagttccacttttagaattttcctccttaaagatcttcctaaaaacaaaacctgtaatatacaagcacacaattcttacagaattatttataaaaatgaagatatcctgagtagtaatgtggttaaatatgctatggtacatggtttaattttggaaaataataacgtttgtaaaatttataataaggagggaaaatatgtatatgacatcttttaaaaagaaacatatattaaagtataataaatatgcaaaaacattaactgtctttggataatggaatatgggaattttaaaacttcttaaaatatatgttctgatttgtctattctgaacatatttgacttttaaaaagtcaaacatgtgatttcagaaaaaataaagtacttctggaaatccaaaatatatatatatacttttataaccattcatgcttttctgcctacgtgaaaaaacatacaagataaaacgtcaatttatatttcttccctgaccatatgcacaactgtagactacaaggtgaccaagtagaatggtattatatagatttcaacaaattgatttttaaaaataaaaattttttacttttaaacagaaaatttaaagagtttctgcaatttatatttttataatttttatagatcataaaattattagaaaaaggaaatacagaattataattgtcggtcacattttaatttttattaatattaatacctatctgtaattgctttgcctaattcatgataatttgagtagctcatgacaagaaaaattaatttgtgactatgaagaagatgttgaatttttcaaattattattaaaataaaaaaatttaaactaattgagcagcaaaaagcatccagtataggtttttaaaaaacatcagcaatgtggggaaaaaatgtggggagctattaatagagaaatgaagaaactggagctattccactaggaatgttcccatcccaatatcatgtaatagtcttccaaaggtaattatgtttggaatatttacatttggattaaatgagcagtacaagaaagt

SEQ ID NO: 38757 - DNA, 1027 bp, Homo sapiens
attataaacacagaacctgtaagaagtcaaaatcacttttttctggttttgttttgttctgctttgctttgtttgtcaccactgacaaataacctagacagacttactaggtttttttcccagctttattgaggtataattggcaaatagaaattgtatatattcaaggtgtacaacatgatgattggatatacatgcacactgtaaaatgattaccacagccaaattaattaacatatccatcacccaacctaagaaattaaacactgcaaaaacttaaaatctattggtaacaccctttgatcacagccaagtccctttaccttcatggcatagttaatttggtgtttatgatttaagtatatgtataaaattgtactatatacatatatatcattaaataaaacataatgtatcaatacttctaaacttatatacttggttacatactatatgtgtgttctgcaatttcttattttctcagcattatgtttgtgaggtttacccataatgatctaagaagctctattcattttttaaaaaataaactctttttttggaataattttagactttcagaaaagttgcagaatacagagaatttccatacaccattcccccaacctcttctaattttaatatcctacacaacaatggtacatttgtccatactaagaaattcacattggtatgttttaattacctaaaccacaaactttatttggatatcaccagtttttccactagtgtcctttttctgttccagagttcaatccagaataccacattgcatttagtattaactcattttttctgctgtatgattacactacaatttatttcctcattatgttgatagatgtttagatttcattaatgtacctgatgatatcgttgtatacacatatgatatcttcgtgcacgtaatatgtaaagcatgctcttcaaagtagtaatatcaatttatttacagtctcacaaatatattaaatttcccactgctccaaattctttccaactcttggta

SEQ ID NO: 38758 - DNA, 1035 bp, Homo sapiens
cagctttatgtctttggacaagaaacttggcttctctgggcttcaggttttttgttgtgttgttgctgttgtttcataattgagatataattcacatgccataaaattaacttttaaaaattgtatgtcccaatgtgtttttgtgtgtgtgtatgtttactatgttgtacaataatctaattccagaatattttatcacccatattcatgcctattagtagtcactccccattctcacctccctctagctcctggcaagcactaatctgctttctgactcaatggatttgcctcttctggacatttcatgtaaatagaatcataaatgaaacctttgatgtctggcttctttcacttggcataatgtttttaaggttcattcatgttgtagaatgtattagcacttcatttctttttatggctgaataatactctgtggtatgaatgtaccagagtttgtttatccatttatcagttgatggatatttgggttgcttctactttttggctatgatgaataatgccgctctgaacgtttgcgtataagttttcgtatgaacgtatgttttcagttctcttgggcatatacctaggggtggaattggtggtttgtatgataatgctgtattttgtgtttttgaggaactgccaaactgttttccaaagtggccatttcattttacattcccactagcaatgtatgcaggttccagtttctctggatcctctcctacatttgtgattatttgtctttttcattgtagcacttttagagaatgcagtggtatctcagtgtggttttgatttgcattttcctaatgactaataatgttgtttttttttaaagaagtggttgtgggtatctttttttttaaaatctcttctagctctgaatttcagatttttcttctattccttgcgcagaccatatgaataacagaattgagtctttagggaatatatattttggaaattaatgggttaatcaactcctatgtatttatgaatatcttctattgtccagtgttcagccat

SEQ ID NO: 38759 - DNA, 1027 bp, Homo sapiens
cagacatgagccactgcgcctgtcctgcccaggctttttaaccatttctttttgctattctcttagcatagtaattctggggggaaaaccagtattattttttcattataattgatggtaacagcactcattaagtggaggaatttttttgcataattttgtttgggatcctttcctgaaataagagtgattgtgttatacccttgcaagcccaggagatgccagccatctctgtgtggtgtagctacttcacgtgttgctttgggtctcatcctttgtcattctaatgaattactacacacacctgtgtgagatttagcttttggagatttagcttttgggtttgcctgtatttatcttgtctcagataaatacagacaaacattgttcatgataatttgatttagtctattgatatgattatcccatttgtttacattctcttttattttcttccctgcctatttcaggtcatgtactaataacatcactaggttgaaatacggattctgggccctgagacagcccagagcttggctccaagaccaactctgagatcaatagctgggctacaagaccagcaatttggcatggactttgtgaccctagcccagaggaatccttttctccctcctttcctgtcttgagtggtgaaccactcttaaataatctgctcctagccatgtcctaaccaactggtatggctaacaaaagtgatgacaacagcaatattttcacttcccagactaggcaccagaaggaataactccaactgcagcctccctcactgtaccgttttacatacctagtaaatgtttattattatgctgtatcctaattgtagatgaggagctgaataatgacagtttttccatcctagtcataaggggtcagtgcaaacagaattttagcagttacatatttagtaggttaaaatgactccagcgttcggacttgtggatggcttctgaacaactgcagcaggaaagccctgccctatcattgacccattgagggcactaggctg

SEQ ID NO: 38760 - DNA, 1147 bp, Homo sapiens
gcctaggctatgaaatgtgacctacagcatccatcagaagtaaaatgcaataattacacatcagtgtaataggaagaatatcatgcaatgccatggcataaataaggacactcatgaaaaaaggaaacaattctagcataaagaggaaaaatggaactgacggtttttgtaaaagcttgtcgcatattttcaaatcaagacaggcaagtcttccaaatttagcaatgtgtagaaacattctcatgaaatcagaaaagggggtactggagggcaggttttcatcctttccaaactcttctaaattctcccacccagcgttcatttcagattcaaaataccatacacttacatttataaattgaaattttagaatgggaaaggaccaagtgttagtgactagtgaagtttcagggtatttccagaactctaagtgcatctgccctttaatgtttgctgccacttgctttcaaaaacccaaatcaactcatagttgtttccaaaaaatgcatgcaaatctagtggaagggaaaataccgcaaaaaaaaaatagtgctgtattaaaaaaacaattatttatgtgtctgtggaactgggtgcacctttaacaaatacttctgatagtcaagcaaatccagaatgttctagtgctgacatgggaaacagaactaaagaacaatatataaaagtaatcaggtatatcatttactctcagttagaattttgctcaaaaaacttgagttagtatggagcagaagaaaatggtgaggttctgtgattaaatatatatatatataatatatgtatttgctgtataatcttgaaaaaatactaaatgtgtggcacatatgtgtacagccgagtgccctttgataacaggacttgggtggtagcgacacctagaggcctcatctctgagtatagttacagggtgggctttgtgttgcattttaaccctcaccgtggtaaataaaaaaacctgtgaagatagctgtgaaaataaaatctaccctttaaaaaagtctattatagtatatgagatttatttatgttaaattggaaatgaaggtctggggaaggggaagctgcagtatttcagaaagttacttaagcgggtcaggaaacctgggttctggaaggaggtgggcat

SEQ ID NO: 38761 - DNA, 1051 bp, Homo sapiens
atgctctttaacaaaagatgtcatccttcccttaactaaatgtcattatgaatgatacttattatagcatgttgtaagagactgatgctcttggcacttttgtaacatctagaatgccctcctgtttctaactgttgtgattggcctttgctgtcccctgttggtaactgctttgttacacttctgttacttctgaaagtggacagtggtgataaactaatgcaaaattacgtcagctacatattgcaaggaaactatttggtatgcattgttatcagaagagagttggttatctgcataaaaagtgagagattgcttacttgcctatgaaataaaatacatgagccttggaataaatatttttgcttaagtctttttgatttttttttctaggtcctgatgaatacgtatctgggtggtctgggtggtgggcattttactgcctaaaaatgacaattatcttttgctttgttaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcaggtaactattaaggtatactaatactttctgtggtaggtagtacttcaaataaagattcgggataataatttatagaaaaatattatttatgtagaatggttaaaatctaagattaaattgtaaaggaggtaagactgagaagtaaaaaagtctctacaaccccatgcaaatttgtcttttttgctaactaaactttcgttaacacatgaaaaacaactctaagcaagagaatttttttttttttgcttttggaaatagagaatgtgcttttaccctggggaaatagttatataatttaagagaatttgaagaagtagttagataattatcttggtatcatcttcatgtctgcatatcttacttggggacaagtatttcctatgaattgacttttaaaatattcttatttgtaagatcacttttttgtacttg

SEQ ID NO: 38762 - DNA, 1081 bp, Homo sapiens
gctgaccacctttcctacagctggacaaccagaccttctttgaagggaaattgggcaacaaatctccatgtctaccacagccttctctccaggaggttaaccctgactcgttgttcctatggtggcagaagggtttgtagcataaagatagggcaagcataatgtgcaagtacattccaaacatctactaaccttttatttgctaatgtctcattggccaaagcagtcagatagtcaatatcagattcaaagcttggacagacagacttcacctcttaatgggagaagtgacagtcatattgtaaaggagtgtgcctacatggacaggaagaatttgtaagtatatttttgtaattgctaaactcctggattcatttttctaatatattgttcggaatttttgcatctctgtgaatgacactggcctgtaatttttcttttacatattgattttcggactagttttatagaatgatttgagtaatatttctacaaaaagtatcctctaggagagttttgtaaaattagaatcatctcttctttgcaaggttggtaagatttacctgtagaactatttaggcttaatttttttcttttggaaatatttttactgatattatggattcaatttctttaatagctatataaaaaccaagcttttgatttcattttgagatatttttgctgtttgatagaaatttctccattttgtcaaaatttttaagttatgtggggcaaaagttatgcacatgttctcaaattaactttttttttttttttctagtgggagaaggagggtatttatttgcaggcaccaagcaggggggccccgacggtgcacacttaagtcctgacctccccgatggctggcaggtcagggttttggttttgttttgttttttttcatttttattactattttttaatattatactttaagttctatggtacatgtgtacaacatgcaggtttgatacataggtacacatgtgccatgttggtttgcacatccatcagctcgtcatttacatcaggtatttctcctaatgctgtccctcccccagccccccaatccctgaca

SEQ ID NO: 38763 - DNA, 1032 bp, Homo sapiens
agccaaatcgtattacttggtaaaataaccagtttctccaattgtgtcctgttaccagaaaaaaaaaaaaaaaagattcttattgcacttacactaataagtatattgtcataagttaagaatactcacaactagtttgcaaatttggagaaagtaggtagaaacaaatacgctccaaattttgttcaggggaactcctctttataaaaccatcagatcttgtgagacttattcactatcatgtgaatggtccagggaagacccacccccatgattcagttacctcccaccggatccctcctatgacacgtgggaattatggaacctacagttcaagatgagatttgagtgggggcacagccaaaccagtaatgtaaaatacaggagtatactttactcaattgttaaaagctattaatacctcaaaagtttccttgatgctgcaaaacaaaacaaaggatcagcaatgtttgaagcaaagtcaacaagattactttagtgttctattagttcagttcatgcagttaactcctgttctgcttgatatttatgaacatttcacctgtctatgagagtcctgaaagttttttacctctattctaatgttacaatcaccatagttatcagaaacctgcatttaagtgcacctgtcaaagtcttatagctgattataaaccaccttttgaagaggattaaaacaagacaacaattgtctgtgaatgataaaatgtcttaggaaaaaaccacagtcaaaaacacaattgacaaggaaatttggttacctctgtggcatacagtgattttatgtagccattataattattaataacatacagttattcatattggaattgtaggagtttcccataagtttggaacacatatgaaacatatttatacaaatacagtccaaagacaacatcactcctgtatgattttaatatatcaaataagccaaattttacctttacattagtgtgctattattgataaaccaaatttttaataaaaccttataaacaaatctgttta

SEQ ID NO: 38764 - DNA, 1050 bp, Homo sapiens
ctggatgggaagagatctagagaacagaatatcatatgtctcctgactcataacttgggatctttcctcaattctactgaataacctgtagtggaaaaccatgtttctatagtcctatccctcgtccaggtggattatctgaacaggactcctgtggaatggttgtggtaatgtaattcatgtggacattgacaagttgccatcatgtggtcatgaggatggtgttggattccttatgtgtgaggctgataagggccctatgttcaattcttagtggtccttttaaacctacacctgtttatattttttatcaacatgcccataacttatttttcgtgaatccactgaaacttccagagacttgaactttgcctaaagtttaaaacaggaattttttaaatcccttaaatgaaaaatagttttaagtgtatcccaactaatatgaaacaggaaactaatgtctaatatccttgggaactataaaatattcaatagtaatcaaaacataaaatgattctcttctgtctttccgttattctctacttccaattacattttgtaaaatgtaaacaattgcacctgcaattgatggaaaaataccatcatgaaatcaaatgtgttttctgacttcatatatgtattgtagtatttaatattaagtaagctcagaagatacttacatggaatctactgccttttctgagcacaagagaagcaatgattaatagaatgtggtacttgctccaaggagcattcatttaagaggagggatgctcctatttgggtcttcactgtataaagcatttatatgtatattacttaacaactaaaaggtatgtacttatgcagaatactgccatcattgctcttttctttactgtaatggtaccattcatcaggtccatggaagccagcttctcacacattctctcttagacataggcgttttctttctttcttttctttttttttttttttttggtgacggagtcgcactttgttgcccaggctggagtgcaatggcacaatctcggctcactgcaacctcta

SEQ ID NO: 38765 - DNA, 1037 bp, Homo sapiens
ctgcctggctggaagagaaagtcttgagtagactcactctgttacctaaaatgagatttattctctgcaaaagagcagaaaaaaattcataggtaggggcacatgagagatttgatgtgaacaaaggggatcaagtggacctcacagttttaaataatattttttctcagaaaagtggccctataactttcaaaattgcaagcattacaatctgcttgaattttaaatttaataaatgttctgtcaactcctggacttgaaatgaaagttgcattaaccaaagacgtgcctttagatgtaagtttaaataaagcacctctaaagaagactaaaattctatgtaattttacataattaaatgtagctattttgtcatactacaattttccactcttctccttatgtctacaattttgatgttcatcatggatttggatggtttatttcagtgcaagcttacccacatttgtagggtgcaaatggtaattattctctacctaaagtcagacaagatgccccaagttctcagtttaatgacacttggaagatttttagcaaaacaaatagtgaatactcttcaaatctgaacacaaacaatgaaagcaaaagtaatttccaaaaggtcacttttatttctgctgctattctaccttttcaacgtccctattcttttcattgatgagaatttgattgagcatattggcactggcatttctgaaacgactgagattaccatacagttccaagggttaatatgtttttggttacaagaaactgttttttcaagagcttatctttagaaaatattattttcttgtcttttcaaataaaagatcatcagaatgtcaaagtctgaaatcctatgagtctttgggtgcaacttttttctcattccttttctatcacacaagaaaattaacattttgaattttctatgattttgtatagaaaattattcatgtactaagctcattgaagttagaaaagatgatctcaatctatgaacactgtcatacatactttattgtcataatata

SEQ ID NO: 38766 - DNA, 1049 bp, Homo sapiens
ttgttttgtatggcaggcctggtgtgaccaactccttcagcttttgtctggcaaagtctttatttcttcttaatttctgatcaacagttttgctagatatagttatttgggttggcaggtttttactttcaattttttgagtatgtaatctaactttctcctgacctgcagggtaatctgctgacagtcttatgaaggttcccttgaatgtggcaaatagctttttactcactgctttcaaaattttctgtttttgatttttgacagtttgattataatgtgactcagtgaagacctctttattctcaacctatttggagttctttggacttcatgcatctggatgttcatttccctacccagattttggatattttctgtcattatttctttaaattagttttctaacccatcttccttctctgctcctctgcaactcttataatgatatataattacttgatggtgccctataaatcccgagggctttctttactcctttttaaaaagatagtatatcaaagacttatcaatctctcacaaacatattagcaaaaaaaagttaataaatttaagctcaccgtaagtatgtattccactctcaacatctttttttaaactattaagttcaggcatacatgtgcaggtttgttatataggtaaacttatgtcatggaggtttgttttacatattatttcatcattcacatattaagtccagaacccattagttatttttcttagtcctcttccttttcccaccctccactctttgataggctccagtgtgtgttgttctcctctatgtgtccatatgtttttatcatttagctcttaattgtaagtgagaatatatggtatttggatttgtgtacctgcattagtttgctaaggataatggcatccaactacattcatgtttctgcaaagaacatgatatcattctcgttatgcctgcatagtattccatgatgcatatatactacattttctttatccagtctaccattgatgggcacttagattgattccatatctttgctattgtg

SEQ ID NO: 38767 - DNA, 1022 bp, Homo sapiens
atttgtcaaagatcagatagttgtaagggtgcagccatacttctgggttctctattctgttctattggcctacatgactgcttttataccagcaccacgttgttttatttactgtagccttgtacaattttaagtcaggtaacttgatttccagccgtgttctttttgattaggattgacttggctattggggctctttatggttccatagaaattttaaaatagctttttcctagttctgtaaaaaatgccaattgtagtttaataggagtagcattgaacctttaaattgctttgggctgtttggacattacaaggatattgaatcttcctattcgggagcatggaatgttttttcattggtttgtgtcattcctgatttctttgaacaatgttttgtagttctccttgtggatatctttcaccaccatcagtagttgtgttcttaggtatttctgtgtgtgtgtgtgtgtgtgtggcaattgtgaatagaattgcatttctcatttggctctcagtttgattcttgtgtttgtttagaaatgttagtgacttttgcacattgcttttttatcctgaaacttcagcaaagtttatcagctgaaggcgcttttgggccaagactatggggttttctagatatcaggtcatgttgtttgcaaacagggatggtttgacttcctcttttactatttggatgaccttcatttctttcttttgcctgattgtcctagtcagaacttccaatactatgttgaataggagtagtgagagggcgtcctcatcttaccttgaaagtcctcccagttttcaagggaaatgcttccagattttgcccattgagtatgatgttggctgtggttttgtcatagatggtccttattattttgagatgtttgttaaatacctaataaattcagagcttttaacatgaaggggtgttgaattttatcaaaagccttttctgaatctattgaaataatcatgtggtttttgtttttagttctattcatgtgatgaat

SEQ ID NO: 38768 - DNA, 1083 bp, Homo sapiens
gggtgggatgaggcctaagtgggccttttgggcagtgtcccataaggttaaggagccaaatgctcagttaattttcattttcccctgtggaagcaattatgaaccaaagtgatctctcttagaataaagctaggcttccttgggggatgagtgacatgtagagtgaaactgttcttctcacctctttcaacaagtctgctctcatattttttgttttactggaatactggaacctctcagctaaactctggggctctgatatggtttggctctgtgtctccacccaaatttcatcttgaattgtaattcccacaagttgagggagggacctggtgggaggtgattgaatcatggggttggtttcccccattctgttctcatgatagagagttctcatggatctgatggtttaaaggtggcagtttcccttgtgtgctctctctctccccttctgccttgtgaaaaaggggcctacttcccctttgccttccattatgattgtatgtttcctgaggcctccccagccgtgcagaactgtgaattaattaaacctcttttgtttataaattacccagtctctggtagtatttttataggattgtggaaacagactaatacagagaattagcactgggagtggggcactgctataaagataacctgaaaaggtggaagcaactttgaaactgggtaataggcagaggttggaacaatcttgacggctcagaaaaagacagaaagatgagggaaagattggaacttcctaaagacttgttgaatggttttgatcaaaaccctgataatgacatggatggccaatgaagtcaagcttgagatggtctcagatggaacttattgggaaatggagcaaatgttactcttaccatgctttagcaaagagactggtggcattttgctcctgccctagagatctggggaaatttgaacttgagagagatgattagggtatctggtggaagaaatttctaaagagcaaagcattcaagaagtgacctggctgattccaaaagtgtttggtcatatgcattcacaaagagaatacctgaaactggaaatttattt

SEQ ID NO: 38769 - DNA, 1034 bp, Homo sapiens
tggctctatctttctgactgggctacagtgttcacccctttgcctggcacatcccattgactttgcagttagtaggacaaggaactcttgtgctttcagtatacaggactgaagaaattttgtactcatttttttatcctctatgtgccaaggttaaatatttaactacctgtacatcatcaaaaaatatatcaaaccattgcttcagatagatctgggtttgtttttgctatcagttttcttttctaaaggaaaagacccacaaggattcacttacaagccagggtaagactgttggtgagtgctggttcccacagctgagtgagactcaattgaaagaagccaggaagaatgacttacaaggcagaggtcaggagaactaatcacaactgtaaatatatctgtatctattattattttaaggatatttcaacactccatagaatgcgtaacctggtgtggctgattttaaggagaatatacctaaagtatcataagatgcagagacttgtagcagatacatcttaatagcagagactatagaatgagccttgaacctacccttatctgctcctggcaacatttagagatgtcgagaggaggtccacaaaatgaaacatattaatatttcattttcctttgacaaaatatactctttaaaattttatacacattcattttattattcccccagcaaacctgccatgttaaactgttaggtttaactgttaggacctagtaggtgcacataagtgaataaataaataccataggccatctctgtgctggattactcaagggagcaaaggtctggaaaatcaaatgctcaggagaatgttcaggaaacagggagcagtacaatacagctgatgtgtaaggtatacagagagccaaggaatgagatttgtttggaaaaatggattatgtaaaatttcattggctataggccttattggctgtaattacaacaaaaagctaaggtgctctaggagtgaaaataatttccggaattagtggcatgataagtgattgtc

SEQ ID NO: 38770 - DNA, 1030 bp, Homo sapiens
gatgcactgggagcaagccaccatgaacatatcctcaggtctccagtcttctgccatcgcatgaaaaatggagcttgtcaaacacagagcagagctgaactttctgaattccacaggacagttcagagtgcttggaatgacacccacctgcaatttaaacaaaaaagaaggatgagtaagtgaggagctaaaaattgcatgtttccctaaattagatttatttgtaagctttaagtaagtgcaaacatatttcgaattatctgttatgaattgtggttttgttattaaatagacattttgtttaattcttatgtgcaaagtgaaaagagacttgttttgctggatttttctttttggtaagtattgaattttgaaggggtactagtttttctagccaaattgaaaaatttctcagaatttaaaggatactccatgtgagttcaagctgtgttagggtttggctacatatttttctttggcaatgaaaagtatgtttgattcttatgacttggtagacttcaaacaggctcacacacaaactgttgtccttataaggtagatgtggaggaaaccaacatatgagagtgaaatttatctcaaagcaaagaagtgaggagtttaaaagatagagaaatgcctttgattagattctctgaggttttgagcttctaatattttgattttcaatatacttttttttttccaaaatttgaaaggttctgggatttcttagcccttgttgtttgtttaaagttcctatccataactaatagaaagaaagtggtttggctatgttcaaggcttaaaagaaaaacagctaccacccataagcatctattatatgccataacattgaacacatattgtctcatttaattttcctggcctcgtcacactacagtattatcttcctcactttacatatgggaataatgaaactcagacaggtaaagtgatgtacacaaaggcatgcagttagtaagttttgggccttgtccatctgctgttccctatgtctgaaatattgtgt

SEQ ID NO: 38771 - DNA, 1075 bp, Homo sapiens
taagccatgtttctaaatcaggggtgtccaaacttttggcctccctgggccacattggaagaagaattgtctcaggccacacataaaatacactaacacttaactatagctgataagctaaaaaggtccatgcataaatctcttaatgttttaagaaagtttacgaatttcttgggccacattcaaaactgttctgggctgtgggttggacaagcttattctgaatattgaaaaagatactgatttaaaaattaggtcaaaggggttgaatcactaggtatcatgcagagacatagcattttgagtttgagtataatttaatagaaaattaaattctatccacaaaattaatagcatgtgtaaaggcactgagatgggagggagcaagtcttgaacagtggacaattgcctaggttttgcttagctgggacagaagtgtgaataagattgaaggaatgggtctattttatgaaggctttatatggctaacagcttgcatttcatgtctaagaaaatgaatatcacaattatagcagtaataagagcacttcttatacgctaagttaacactgagctaaagagctttccagggattatcaaatgtacttttctgagcttccagcagggaacatgctccacctgctttttcctgtgtaaaattaattggctcttggagaaggtgaaggtagtgaaaataggttgttgacatagtccaggtataaaataggcatgaattaaagaccattctgaaaaatgcacatttgtagactttattaaactgctccaaatgaaatcgcacaagtacaaacttgtgtaattaggaagatgatggtgctgttgacagtaatgaaggaaaacaaggaaattcagaaaataatagcagtgcttgacagactttacagcatttcttggagtgatattctgacaacagaggtactgtgaaatggaaagtgaggagaggtgtagtaacagtttatggtttatcagtattttggagggtgcctatgttttgtagagattttttacaataattaagcaataccttattttggttcttattctattacgtgcttca

SEQ ID NO: 38772 - DNA, 1091 bp, Homo sapiens
acaatcaatgcagaagatttctataaccctaaaacaagtggttatttctcccttaccagcaagcaagcagttctacagtagataccagctggatgtgctgcagttcaatttggacactatctacctggagatagtatcagatcccacaggttgagggctgagcctcataagactgtcctcctgttttgatgccaatcacaagccctagtttgttttacctgtgcttctgatcaactggctataaagttccacaatcctttctttagctttaatttgctagagcggctcacagagcttagggtactggttcattataaaggacattacaaaggatacaagtgaagagatgcatagtgtgaggtatgggtgaagggacgtagaactttcatgccctcctcaggagtgccaccctccaggaacctccgcatgtgttcagctggcctggacactctctaatcatccttttgggccttttgagacttcattggataggcatgattgaagcatggacagctgtgtagaaatgtgataggaaagaaaagatatgatgtaatactaacagactaagtgggggaacccagcaaggcccgtctgtcagatttttcttggcctctctacagcattccttccttctgggtatggggcaggaccccttctgaaataggggtctttgacctacaatgagaccaagtagtccagagaattttgttacggccagctccgagacaggggaagattcctgccttagggagaaaaaggagatgagaagagggcaggaaaagtcagagagaaattgttttctgaggcctgcttctgaggcccaaagttccccatattataataagggctgtgggagttatgagccaggaaccatggatgaaaacctacagacacactctcactcacaataccacaccaggacactagttttcaacctgatacgacagataatcactttgataccataaaaagaaaagttaccattttcagtatgtcaaggatttgtcttaaaatttgattcagaagcttctctttgatgttagaacttctaacatttatcttttgaagtttgaataattctttattccttt

SEQ ID NO: 38773 - DNA, 1052 bp, Homo sapiens
atgctaggcagatagacagtccctgtcttcaaagatcttatagtgggaacaaataagacatgcacgcgtatattcctagtattaaaaattacaaatgtcttaatagattaaaatgtaggaatcgtatttttttgccgcctggccctaccctgggtttttaccttctacattcacaaatgcacacatccacacttcttcagccaacctggactattctctgaaagttagcagcattttaactttcattctgctgaggcttcacttgtgctattccttctgaaatactctttccccttgcctatctgctaaaatcctatgtagaggttacccacctttccttcctttcctcaaatagcctatcagaatcaatgcctccacactgtcacattgttgcttttatttgtctacatgcttatattcttgttggtcagggactatattatattcttactttgtgtcttcagagtggagggcaatgtatggtcatataggatttctatgatttaatgtgaatgtttgttggaggaatgatctctactacttggatcagaagaggcttcctggaggaggtaacatttgatctcagactttgaaggacagatgcattctgatcatgggaaaatgagattggggaggacagtagtacagaaggacaaatgagcctattttaagacccaaggttagaaatcaagtagcagttaatcactgttaactaggaggtgatatctatacaggaagcaatgggaaataagtcccagaaagtgagatccattcagaacacttcgaagtacaggatgggagttacagggagaggatcagcctaggaatcttgctttgagaattttccatgaagaggtacagtggcctgggggaaataaaatatgtcatcacaaaaacattactgtgtgtgacccaatattgacttggacttcattagaaggatgatgatgctgtcacaggtattcacatcacttgacagtatacttaataaagtgaattttgtccttttaggaggacactgcatgtgagacttcagattggacctggagata

SEQ ID NO: 38774 - DNA, 1065 bp, Homo sapiens
tagtatttgacctgatatgtaaagttgtaagtggcctcgaagtggaatctgcatcagttacatctcaattagaaattgaagctatgcccccaaagtgcagtgatatagatccagatgaagagacgattaaaattgaagatgactccattcaacagagtcagaatgctttgctgagtaatgaaagttctcagtttctgtctgtgtctgcagagggaggccatgagtgtgtggcaaatggaatctccaggaatagctcctcaccttgtatttcaggaaccacacacactcttcatgactcttctgttgcttccatagaaaccaaatctagacaaaggagtcacagtagtattcaattcagcttcaaagaaaaattatcagaaaaagtttcggagaaggaaacaatagttaaggagtcaggtaaacaaccaggagcaaaacctaaagtaaaacttgccagaaaaaaggatgatgacaagaaaaaatcttcaaatgaaaaactcaaacaaaccagtgtattcttcagtgatggtctggatttagagaactggtatagctgtggagagggagacatttctgaaattgagagtgacatgggttctccaggatctcgaaaatctcccaatttcaacattcatcctctctatcaacatgtgctcctgtatctccagttgtatgattcatccaggactttgtatgctttctctgccatcaaagccatcttgaaaactaaccctatagcttttgtaaatgccatttcaactactagtgtaaataatgcatatactcctcagttgtctctccttcagaatctattggccagacaccggatttctgttatgggcaaagatttttatagtcacattccagtggactcaaatcataacttccggagttctatgtacatagaaattcttatttctctctgcttatattacatgcgtagccattacccaactcatgtcaaggttactgcacaagatttaataggcaatcgaaacatgcaaatgatgagcatagaaattctgacactactcttcactgagctggcaaaagtaatagaaagct

SEQ ID NO: 38775 - DNA, 1024 bp, Homo sapiens
tttttttaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaaggtattcttgtcaaacatttaggtttattatctgtaagcaggcatatatttactaagaaatcattttgcctagcactataagtaccacaaatttatcccttttctcatgtctaacaagtaactttttttcagtgggaaaaatatatatatacatatacatatatatatacatatataaaaataatacacacacacacacacacacataaaatttattttcagtgggaattagccatatctttaattttctcttatttatagatatgttatcacctgcaatggaaaccgcaaacataactccttctgtatatagtgtccatgcattgacattactctctgaggtaaatattaagctttttcacatgaactctcaagtagactgtttcattattaaaaattagcaagtaatttttatagaggaatttctaatttgagaaactattttgtgcttctagaaatcactatatagaattaatataaagttttggccttgtatgtatttggattatttagtttgccaaacattagtgataaatttagatactgcttcccttctccatgtcctattcttttttatgtgtttttttctttttcttttttttttttttttgagacagtttcactcttgttgcccaggctggagtcaagtggggtgatctcagctcactgcaacctctgcctcccgggctcaagctattctcctccctcagcctcctaagtagttgagactacgggtgtgtgccacaatgcccagctaatttttgtatttttagtagagacggggtttcatcagtttggccaggctggtctcgaactcctgacctcaggtaatccgcccacctcggcttcccaaagtgctgaggttacaggc

SEQ ID NO: 38776 - DNA, 1034 bp, Homo sapiens
tcctgcctcagcctcccaagtagctgggactacaggcgtgcgccaccacgcccagctaattgttatatttttagtagagacagggtttcatcatgttggctaggatggtctcaatctcttaacctcgtgatctgcctgcctcggccttccaaagtgctgggattacaggtgtgagccaccgcgcccagcccgtttacttcatttcttactttaaactcctatttcgagtgttttagtaaaactagatcctaatagcagtggcaaaggactcatagacatgaagtcccacgagttaaaagatgacacacaatgctatgtgttctggctgtttatatcagttcatgatactagcaatcctgataccagtattagtttaattcttatccagaaaagataaacacatggttccttgtctacaaagtattcgcctgtttcaatccaacctttgcctgtgtgccagtatgcattactataaagggcaagagactgttgaggggaccagtgtggatatctgcatcattaccttattgggaaaaaaaaaatctaattctacagtccgatgatgttactgccatctcctctgaaaattccaagctccacaggcttcaccaggcttttcaaaatgagagtttattttaatgattaaaaaccgctatttaagtagctcttgccaagccttttcattaccaggtctccatccctccccaagtatttctgcgagtctcatgtgctaagagatgtcttgagcagcctctgcagctttccgtgtttctgtggtcagctactgctgccctttcccgggaggcattccattctcctactgggtcctctcaagatgccaaagcttggtgctgggatttaggaacacatcctgttagatgtcagacagtgctgcttgtgctggggagcctacagaacttctgatgaaactaccatctggttttaccctctgtgccgtggatgcagacgtgtccttgggctacagagaggacatgatggagcaggaggccctatcccaaggaggtgttagaact

SEQ ID NO: 38777 - DNA, 1045 bp, Homo sapiens
aaaaatttggtgtataattaaaattattaggtaaatagtttttttttacatctccatggtaacttttgatgccgtttttgttgtagcccattacaaagtttatttgctgatggaatagatggttgtctaaaattattaccatatatttctattaaattagactatacatcataaaaacagattgtttatattatgggtacagtattgatttgtgaaaattgtttcggcacacataggcttggggtatatatactatatacatatagaaaaataattagaattatatgcccattaggtatatagttttaaatatatactgatagtgtcaaaatttggatgtttcattttcattgagatttttggatttttagaatttaattattttgctgtgatttttttttctaggtacagaaatagtaaagccatatacacctgtatctggttccttactctcagagttcaaggaaccagttcttcccaacaataaatacatctactttttgataaaaatctatcccactggactcttcacaccagagcttgatcgtcttcagattggttagtatttttacattttttaaacctcatttgtgctctagattggatcacattgtcctctagttatctccatgtaggagtctatcagatatctttaactcaacatgtctacaaccaaagttatcttctccttgtcctacacagcgtggccatgctccatattccttatttttattatttgcagcatcactgttcatccttgatccaatctggaaactcgagtcggccttgattcttcccactttctctttcccagtccagtcagccgctaagttctgttgagtctacatctcagtgactttttcagctacctcttctgccactgtcttacagtaagccttcatcatatcttcattggcttctgtttccttacaattgaccctactgcttcgcagctttgaaacctctgatgggtccccattatctgtactgcatgacctacaaagactttgataatctctccagcttcatatcttgctatacaaaa

SEQ ID NO: 38778 - DNA, 1044 bp, Homo sapiens
ctaataggcaaaataaccagctagcatcataatgacaggatcaaattcacacataactatattaaccttaaatgtaaacgggctaaatgccccagtgaaaaggtacagtctggcaaattggataaagagtcaagacccatcagtgtgccgtgttcaggagacccatctcatgtacaaagacacacataggctcaaaataaagagatggaggaagatttaccaagccaatggaaagcaaaaaaaaaagcaggagttgcaatcctagtttccgataaaacagactttaaaccaacaaagatcaaaaaagacaagggcattacataatgctaaagggattaacaagaagagctaactgtcctaaatatatatgcacccaatacaggagcacccagattcataaagcaagttcttagagacctacgaagagacactttcacacaataatagtgggagactttaacaccctactgtcaatattagacagatcaatgagacagaaaattaataaggatattcaggacttgaactcagctctgcaccaagcagacctaatagacatctatggaactcttcaccccaaatcaacaggatatacattcttcacagcaccacatagcacttattctaaaatcgaccacataattggaagtaaaacactcctcagcaaatgcaaaggaacagaaatcataacggtctcccagaccacagtgcaatcaaattagaactcaggattaagaaactcactcaaaaccgcacaactacgtggaaactgaacaacctgctcttgaatgactactgcagaaataacgaaattaaggcagaaataaataagttctttgaaaccaatgagaacaaagacacaacgtaccagaatctctgggacacagctaaagcagtgtatagagggaaatttatatcacaaaatgcctacaggagaaagcgggaaagatctaaaatcgacaccctaacatcacaatgagaagaactagagaagcaacagcaaacaaattcaaaagctagcagaagacaagaaataactaagat

SEQ ID NO: 38779 - DNA, 1097 bp, Homo sapiens
ttctcttgcggccgccatgtaagaagtgcctttcacctcctgccatgattctgaggcctccccagccatgtggaactgtaagtccaattaaacccctttttttccccagtctcaggtacgtcttttatcagcagcgtgaaaatggactaatacagtaaattggtaccagtagagcaggtgttgctgcaaagataccgggaaatgtggaagcaactttggaacttggtaacaggcagagattggaacagtttggagggctcagaagaagacaggaaaatgggaaagtttggaacttccttgagacttgttgaatggctttgacaaaaatactgataatgatatggacaatgaaatctagactgaggtggtctcaggtggagatgaggaacctgttgagaactggagcaaaggtgactcttgttatgatttagcaaagagactggcggcattttgcccctgccctggagatttgtggaactctgaacttgagagagatgattaagggtatctggtggaagaaatttctaagcagcaaagcattcaagaggtgactcaagtgttgttaaaggcattcagttttaaaagggaagcagagcattaaaattcagaaaattagcagcttgacaatgcgatagaaaagaaaatcctattttctgaggagaaattcaagctggctgtagatatttgcataagtaacaaggaactgaatgttaatttccaagacaatggggaaaatgtctccagggcatgtcagagacatttgtggcagcctcttctatcacagacctggaggtctaggaagaaaaaatggtaaaaatggttttgtgggcaaggcctagggtccttgtgctgtgtgcagtctaaggacttggtgccctgtttcctagccactccggccatggctgaaaggggccaacatgaagctcaggccatggcttcagagggtgaaagccttaagccttggcaacttccatgtgatgttgagcatgtgggtgcacagaagtcaagaaatggggtttgggaacctctgtctagatttcagaagatgtatggaaatgcctggatgcccaggcagaagtttgctgcaggggcggggc

SEQ ID NO: 38780 - DNA, 1030 bp, Homo sapiens
aagagaagagagagatcctcaatgtagtgaaatagttggagagatctacttggaggaggtagtatctgatccctaccctcaagggtagacaggaatctggaaaggagggagaggaagtccagcttgcaggtggaactgaatgggcaaaagctcagaggaccattttgagggttcccccgctgcaggttcctgtaccatcatgagccctcccttttttaatgaccctgttgtttctactgtctatgtcttcaggcttttgtgttgtccctcaagctgtgtgtgtatgggggggtgaggggtgtggggtgagtgggtgggtgggtgtatttgaaagaatgaagttcattgtgtggcagaggatagtttgaaatacaagcctgaattctttaagagcacagtccacagtccttgaatttttgacctctactaaatctttcatggttaagtaacagtgtttaaaatatccttgttgatctgaatggactcataataattttactgtgttcaaaactagtgctctttctctgtgaagggcatatttatgagaacttagtagatgtgtttgctgaagacggcatgtagtgggatagattaatgacattttgtaaatgttttcttttcaaaaatgtatttttttttagttatagttagagtgattggtacaaagtaagtcatttttaatggacttcctaggacagtttaattagtttaccaaagagaacattgttttctccaaattagtttcagcacctatatgaatttcctcgggctgccataacaaaataccacagactgggtagcttaacctgcaggagtttattttctgttttctttttttgagacagagtttcgctcttgttgcccaggctggagtgcaatggcatgatctcagctcaccgccacctccgcctcccaggttcaagtgattctcctgcctaagcctcccaagtagctgggattaaaggcatgcgccaccacacctggctaatttttgtatttttagtagagacgaggtttctccatgttggtc

SEQ ID NO: 38781 - DNA, 1050 bp, Homo sapiens
aagcttgggtcacatttttatgtagaatacttcggacttcttgaaaaattatcaaaccccagacattacgtgcctcacataccctccttttgtagcctttgttaagtacatctcatccaggtggggctgttcttcacttaggggccagtgcaggattgctcaggaccttgtaaaaatgggaattatattctatcttgaatagcaatttacctgaatatggcactcattaaagaatgggtacatggaagtaaagactaacaacagggaaatgtcattgttcaaaagttttgatattgaccatggccacaggaactagatggcaaaatgcagatgtagtgagtgattcctgaggaagccctgtcgttctgaggtatctactgctatgaaagggtagaaaatctattttatgtgtctggttcagtctataacttttgttcaggagttatttttttttttcttttgagatggggtctcactctgtcacccaggtggcagtgcagtggtgcgatctcggctcactgctagcctcaactgcccaagctcaggtgatcctcccacttcagcctcctgagtaactgggactgggtgtccactacacccagctaatttttttttttttttttgagacagagtctcactctgtcaccccggctgaagtgcagtggcacgatcttagctgactgcaacctccaccacctgggttcaagtgattctcctgcctcagcctcctgagtagctaggattacaggtgcccacaaccatgcccagctgagttttgtatttttagtagagatggggtttctccatgttggccaagctggtctggaactcctaccctcaggtgatccacctacctctgcctcccaaagtgctgggattacaggtgtgagccactgcacccagcctaatttttgtatttttagtagagacagggtttcaccacgttgcccaggctggtcccaaactcctggcctcaagtgatccacctgcctcggcctcccaaagtgctgggattacaaacgtgagccactgcgcctggccaggcatatg

SEQ ID NO: 38782 - DNA, 1030 bp, Homo sapiens
atgagaagaagctagtgctaaaatatcctggtctgcataaaagattatggggctttataggaggagagttaggataaggtttgggagccacaataaaaagcaaaagaagcacttctccacctccagatctgagttccgtgggtgattcattttgggacatttaaagtttgaaatgtctggagatatccaatattaaataccaaatatgccgttgaatatacaagcctggaatttggaagaaaggtgaagggtgaacaaatttgggatttgtagtagaaattcatcatttttggtcacctagcttacacagtgattctcccttctttcaaattgtctcattttttttttttttttagtgtggatttacccttcatttattctcagcttatattatttggatctacttaccctaatccctcaggtaggccctgattgacttaaccactcaacaaaccccaccacttggctacagtaattggtctgctgtgatgaacacaactcactgtgagagttagactggacatttttgcctaattattggaaaaaagaaactttctttttcctattgtgcattaaacatggaggatgtgaaatctgagagtgctgcaaccttcttgtaaccatgagagaagaatctattccatttgagaattaagtcaacactctgagaggaagagagaacagctgagctgtgaggtggagagaacaaggttgtaggcatagcatttgaacttgattgattcctgtggcactggcatttagccattccttagtagaaatcaggttcccccagaaatcagtcagtatggaagagggatacacaggatatggatactgaatggtgtgaatactgaaaggtataatgcatcagagccattactataacagtctctgacaatctgtttctactaattcttagaccccttgaagctcatccgtggtgcaaagggataaattaatcccactttaccccatacaagaaaaaaaaaatcagctatgctaattatcttacatttctcattcaagatca

SEQ ID NO: 38783 - DNA, 1023 bp, Homo sapiens
ataactcctattgttatgtgtgaatttgatcctgtcattatgatgttagctggtggacatggatgaaattggaaatcatcattctcagtaaactatcgcaagaacaaaaaaccaaacaccgcatattctcactcataggtgggaattgaacaatgagatcacatggacacaggaaggggaatatcacacgctggggactgtggtggggtggggggaggggggagggatagcattgggagatatacctaatgctagatgacgagttagtgggtgcagcgcaccagcatggcacatgtatacgtatgtaactaacctgcacaatgtgcacatgtaccctaaaacttaaagtataataaaaaaaaaagaaaaagaattagaaaataaaataaaataaaataaaataactccttaggtgatgaaagtaagatgtgtttttggttaagggaaaaaaaggtaatttttgtaccaaagtagaatgactggctgttccaaaactagaaagaaaaaagactgtagaaggcttgtggaaggttaatcttataaaataaattttaagtgtgatcacattggctaaagttagaagagaagttttctaagttttccttaaattgaacattaatttcaaaggtatacattgatacaaaactagaatttggttctctctattaaaacaagatttttcttggagtattgagctgctcttaatggcaaataatgaaaggtttttctttacctttcaggtaattggtctaggaaaaaagtatgtgttttatcataatagttcctgtgttttatgttgcctttattaagcctttgattacttaagaaaattgagtcctctctattaaagagctcacgtttttctacaagtaggcattttttaaaagaaatatataaccctgtgtttgcctttttcttttctttttgagacagagtcttgctctgtcacctaggctggattgcagtggcatgatcatggctcactagcagcctcaacctcctgggctcaggtgatcttttcac

SEQ ID NO: 38784 - DNA, 1049 bp, Homo sapiens
cccagcactttggaaaggcacagcaggaggattacttaagtccaggagtttgaaaccagcctgggcaacatagtgagaccctgtctctgcagaaaatgaaaaaaattagctggatgtggtggtaagtacctgtagtcccagctacttggatggctaaggtgggcggattgcttgagcctgggagattgaggctgcagtgagccatgattgcaccctgcactccagcttggattacaaagtgagactgtctcaaaaacagcaaaaatttatgcttccttttctctgctttgaatcagcacactataaagaaactatttctgttctttggtattgtatgcatctatggcttgtatagatataaggtggattgtgatatattctgacattaattagctggtcgagattataaagtatggacacacccctgtaggtaagatctcccattaacgttgtaaagacaggtagtgggtccttaatagaaagtcagtgcatgcaaggcaaacctacagcaggtaaaaaagggagttttgagaattcaaggacagtagatatttaggcaaaaacttttttgttgaagggatgaaggtagagagggtcaccaagctggcatctaccacatagactcagaacgcattgaattctcccagttctagatattcacttgcctcttgtagttagattttttagtttagttattgttatatctgattcattactgaagcctcattccagatttttcccaattaacctatagtgtccaccttgggcaagagttttatgtggggagtaaccctcaaagagatggtaaatttggtgggggaacataaattatatgccttccccacttccttcgcagcctatctggagattcatatatagcagctccactgaatggtgagctctgatagaggtcagggcacgcagtgattaacacagtaaaccagtatcaagtaaaaaatacacgtttgaaaccttgaaaccatctagaattctctcttttccacatttcctgtatccaattaaattcttgaatattcttcattctacca

SEQ ID NO: 38785 - DNA, 1047 bp, Homo sapiens
agttgcaaatatttcctctcattgtgtacattgcccttttactttgttaatatagtcttttgatttaaagacatttaaaattattcttgggcagtttccctcagctttgtctgacggaagctgctgggcttctgcttccagctggtggagggtgaggcattgccaatagtggccaggcatccagtgctggtagcctgcatctgtgccccacccgcagcaccctgagcccactatttctgccgtaggcagcccaaccagcggccgagatgtaggccatcaagtatgtggtggtgggagatggagctgtagggaaaacttaccaactcatcagtgatcagctatacaacctggagaatatatccctattgtctttgacaatcactatgccagtgttatgttaaatgggaaaccggtgaatctgggtgtatgagatacaagtggacaagaagattacacaggtggacagattatgacccccacccccgttcctatccacaaacagatgaattcttaatttgcttttcccttgtgagtcctgcgtcattagaaaatgtccatgccaagtggtgtcctgaagtgcagcaccattgtcacaacactcccatcatccttgtgggaactaaacttgatcttagtgagagaaatacaagactgaaacactgaagaagaagaagcagacttccatcacctaacggcagggtttaggtactgtaaaatacctggagtgttcaaccaggcctcaaaatagtgtttgacgaagctatgcaagccgttttctcctgacctcccttgaagtagaggaagagaaaatgcctgctcttgtcgatatccgagccccttgttcttggtcctgtcactggaacttttgttaaaaaacagcaaaacaaaacaaaataaaaaacaaaacaaaacaacaactaaaaaccccaaagcacaaaaaaacctgtggagcctttgcacccagtaccgagtttttgttacaaatcattttttccataaaagcattttgaatcaatcaataattttaagggttttcttgttgtaaat

SEQ ID NO: 38786 - DNA, 1043 bp, Homo sapiens
ttactgagcttctctcaggttctgtgttcctctactttgaggagctgacagatggtgttttctctcctttcattactgaccagctgttgtcatctttctgcatcctccttaccctgaagatctcaactaaacatgattttctcttcagaggtcttccccaaagcctatactaggtgaattcttctattttctatagttctcttgtcattatattcattgccttttattgttaatgattagtgaattgtctattttctttgctagacatatttcatgacgtttttggtcatcagtacttctccaatacagaacacagtatctaatgtttaggagacaataaatatgccaaatgaatatttcatgttccatgtaaaacttaggaagggttatacttaccattgcccttatcatgtattatttatctatatatatagtatatatggccaaatcagatgttgaaataatattgtcatactctttactacttatttcttgagggagccctggagtgataaaaagaggactggactaagaatcagacaataggatttctttttttttgttctgctactaattggttctgtgttattaagcaaactaatatgcatctattgtttttagtttgtaaactgaaaaaaatacactggtgattatttaaatcccgttcacatctgtggccatgtttcaaagtgggtccttatgttcaccttggcttagaattctaacaatagtttagccaaaatagcagctttgtgaataccaaaaattggagcttaatagacattccacctcctgaactgcagaggctggaaagccagaagttgcattatgcaaagtcccttgcagctatcttaaggaatgtaatttgggtttggctggttacatgagatttgaaaggcagaagaggggttgaagctcagaggtgaaactgaatcactgatgcttctagtatttctactgataaacccagttgtgaaggtttttgtttttctgaggttgtgttagcagaagttccagtggccagtcaccagctttcttcaaaa

SEQ ID NO: 38787 - DNA, 1008 bp, Homo sapiens
agtccgtttctcatttgctttcgcccttcgaggagtatgatttccactatcctttctgtcccgatcaccccctcacccctgtttcttggagtccttcctatttggcttcctgatgaagtgggagaagactgaggttcatgtggatctgtgctttgggtagtttcaaatcttttctttgcttgcccaagggcactgctcaccagtgactgcattctaaccagaatttggaatgttaataacactgtttgctagtgatgaaaatcatttcatccatggtgaaaatcggagagtttgggactacatttgcacttcattacgagccttacacttaggtttaaaatttcaaggtagtgttgctggctctggtgaagactttgatttgattgtcttgaggaggaaaaagaagacacaatttacacaggtcatatttagagttaacttgtgagtgtatcattacagagaattcgttttggaaaaatactgatcttaacgtagaacaatggttgaccattttagctgagtagattacattttcacttattttttagcttccaaatattgaaatattttctttattatgtcggggatacgtgatcacatacaaaagaatctccgttgctgtatgcactttattgtcacaaattatttgatggctgttcataatcttaaaaacaaaaactgtgagatcaagtggtgacgtctaggaggatgtgcaatgtgaaagctccctacttaggtaaataggtctggtgagtacctgtggcaaaattaaagtctcattcctttgaattttaatatttaaaaattgttgaaatttctcagtttctctactttgcagtacccactcattcttaattggtctttaaagatttattttagagataaaaaaatttctctaagatacccataataggaagtatttcatttgtaagtcgaatcagtttttatataataatcagtgaaaactattaaagtctagctttgctgaaagacattttcccctaatag

SEQ ID NO: 38788 - DNA, 1051 bp, Homo sapiens
ggaaaatcagaagatctggcaatattgaactgatgcctggctgtggattgaaatggcttcctggccaactcctcttggctgtttaaaatgtttgtgaccccacctagacttaccttcaatttatttacactacgctcctggttctacgtttgtgactgtttattgtctttactcctttcaccttctggaaggtaaatgatagctattattaatatattaaagaggactagatccaaaagtttgtagtatatgtgtggtggggggggctttccctcatagggaagaaaaagtattagctttttcccacctgtcactaggttcgtggctgagtcacctttaacagactacagattaagaagagaaaataacacaaatttatttaataaaagtttcacatgacatgaagttttcagaaatgaagacccaaagatacagggaaacctgtgtatttcagtgcttggatttgatgaagaatagacagtggtggggaaatgtgattggtcaaagcaggtaggatctaatggtaataaactggaggggagcttaacaaggcctgtttgtgcagattcttaatgttcctgtgttttcagagataaggacatttcctttcctcagggaatagcgagggcacctctggaatgagggtcttatgacttactttaggggaaggtcagaaaattgttttatggcctgtttcaggggagaagggtgggaggaggtcagaaaccttcctgcttctgctactttctcaaataccaaggtaccatattttggggtagcatttactgaaccctatcaccctcaatgttttcttcctttcactcttcactagcaacactcaagcatttttcccaactcatcattatgtctgaggcaggactttctcctcagaaagtggttcctgatgacctggttgataatccatgctttacatactcatcttcagcagtcatccactctgacattatctcccgtcactcactctggataggatttccaggtgtccattatttttatagacttttagcccttggcttccattttcagtcac

SEQ ID NO: 38789 - DNA, 1080 bp, Homo sapiens
actgcaacctccacctcccaggttcaagagatttttcctgccacagcttcccgagtagctgggattacaggtgtgcaccatcatgcccagctaattcttgtatttttagtggagacagggtttcaccatgttggccaggagggtctcgaactgccaacctcaggtgatccgcccgcatcagcctcccaaagtgctgggattacaggaatgagccactgtgcctggccaatgtggactctatatggtataaaggagtatgtaaactgtggagagaagtagggctattttctacagcagtggtcttcaaattttttaattgggtaccttaccagaaaacatttgaatagaaaacctcaatataagtatgtctaattataaatcatatgtataaatatatatactatttcggcttatatagtttttcaagtctgtttatgatgtaattttatgtttcagaacaatttaatatactttttttcctgctgtacttcagtgtacatcctctgtttggaaaccactagttcatagtgctgtgagtaatgaagttttctaagaatacattattaaataactgcctgatttatttgccctatttcctccatgtacggagacattacagcaacagcccagtcagatttttttcatgctatcttttagtcagatttaatttaatgtgtatttctagtttattgcttctgccatgttttattctttatgaagatccccgagtattgagtgtgccagttaccagattctctcccagctctaaattacctcttcattacttgatctgcaatattggagcctaaccctttaggccaggggtgtccaatgtcttggcttccctgggccacattgaaagaattgtcttgggccacacataacatacactaacaatagctgatgagctgaatcgcaaaacaaaacaaaacaaaaaaacagaacaaaacaaaaaccttatttacaaatttgcattggcccgcattcaaagccatcctgggccacatgttgatgttgaacaagcttgccttcggcatttcttctttatgtgatgttaattttgtgagtggagagtgctgg

SEQ ID NO: 38790 - DNA, 1143 bp, Homo sapiens
tgatattttggatttcaacatttaggattgtgtgttttgggattatgatgagcactgctttcgttaccggtgtcacaatttaattaatacagtaatttaattctgttggtgtaccatttgtattctagaatattctagaacttgaagcatactttctttgagaggaggtcttgccctgtaacccaggctggagtgcagtggcacaatctcactcattgcaacctctgcctcccgggctcaagtgattcctcccacctcagctgggactacaggtgcgtgccatcacacccaactaatttcttgtatttttgatagagatggggtttcaccatgttgcccaggctggtcttgaacacctgagctcaagcgatctacccacttcagcttcccaaggtgctgggattataggcatgagccaccacgcccagccctctatttttcttactttttattttttattttttaaacatttgctaatttattataaaggattttacaaagtattgacaggaagagatgtataggacaagatatgggggaaaggggctcagggaccttccacgccctgcctgggtacacctccctccagaaacctcatgcacgttcggctctccagaaattcctgaacctagtcctttggatttttatgaaagtttcattacctaggcatgattgattacgtaattggccattggtgatcaacttagtcttcagcccctctctgctctccagaggttggggggacaggtggggataaaagtctcaaccttgtagtcatgctttggcctttctgatgtccagcccctgtcctcaagttacctatgggctgccagccatcagtcaactcattaatatacaaggatgccttcaggcatatttttctaggttattaatggaggttaaattcccagactagttacaaaaagtattttttaaattcacagtaaaactgtaatgttactttatattctaggaacaggatactgtgcaggaaagaccactgtcaaattcagagttttgttttgggaatgccttaccacttcattttcattccctcttagttctccagtcctctttctcaagtagctgatgttctcatatttctgtgagtacactttgcatcttcactcaaacctattcctt

SEQ ID NO: 38791 - DNA, 1092 bp, Homo sapiens
aatgggaaaagtttaataagaggatttggtatcaactggctgtccaaagataaaaatggaccgtcctatcacatacaaaattgttttttagataaagatttaaatacaggcactccttcatttgcgtggtgcaccttgaggtgttgcagaaatgatgagagctgaaactgcaaagcaattttaatactttatctgttggaaatcttatagttttcctgtgaccgttaaaattttcattaaactattaaaaacacccatgactggtcacaaatgtattgggaaatggaaaagaattaatacactaaaaatacaaaaaatagaaaatatttaaaattatctaaaaatttgaaacattagaaaaattgagaactaggcagggcgtggtggctcacatctgtaattttagccctttgggaggctgaggcaggtggatcacctgaggtcaggagttcgagaccagcctggccaacgtggggaaaccccgtctctactgaaaatacaaaaattagccgggcatggtggcacaagcctgtaatccttgctaaccaggaggctgaggcaggagaatcacttgaacccaggaggtggaggttgcagtgagccgagatagcaccactgcactccagcctgggcagcagagtgagactccgtctcaaaaaaaaaaaaacaaaaagaaaaaaaaattgagaattaggatgtttctatttgtaaaaagcttatcaagaatactttcaatgatgcttgccttctaattgtataacttaagatatggaacaagcatctcttctgtgccttgccaaattgtcattttcttttctaaatttgtattagttttcaacattttatatagtactttgcatttccaaagtcatgaagtatttcagagacttcctttaatgtgatgtttttttcctctgggatatcttcatcttttggtcataaccagtttccaattccactttcagcattgccactttttgtttccttgctacactttcatttttgttggtcagtcccctcttttgactgtttacttttgtaaaatgtcaaatcagtgtatcactgggagacaggaaggcaacacagttacac

SEQ ID NO: 38792 - DNA, 1027 bp, Homo sapiens
ttctggcactgtaatatgctccaggctcatctggcgtatttcctgcctgagtcctggaatcaaccgtttctctagggaggacttgctccttttattggagaatggtattagaaaccaagatctatattaaactaaatatgaattcttactgatgtctccaagtctaattcattaacacaaagatcattgtagcctccttcccttgcttatctgtgacctcccacttcaacaaaatgtcatgtaattggaatcatacagtatgtagcctttcagactagctttttccaccattggccatccatttacttaatcctagtatacccctataggaaaaaactttattaactacagtacagtgcttttgtacagttcttttttactttattcttacattctccactcatttccaaagttacttaggtcagcaccttatttctccattcctttcagtgaggttcttttcatacatttgtaatatagttattttgttgtattctgtattccatcttgggcttcctgaacctcctaaataacttttttttcaatttgcataccttaagattccctcttttgtgttgtatagttttatagattttgacaaatgaaaatagtgtcgtgtgtccaccattacagtagtatacatagtagtttcactccctaaaaaaaaaaacaacaaaaaaactgtgtttcatctatccagccttctcccaaacacctgacaactacttatctatctgccatctctatagttttgcctttttcagaatgtcacgtaattaaagcttttcattcaagcttctttcacatagcattgtatatttaacattcatccagggctttacgtgtctgttaaaccaatgagctattagctcattcctttttatcactaaataatattccattatatggctataccacagtatccattcacctgttaaaggtgaatggctaaacaaactgtggtacagccatgtaatggatgctgtttttgatgtatgtgctgccagtttttggtgatttgaataaa

SEQ ID NO: 38793 - DNA, 1090 bp, Homo sapiens
atataattaatttttaaactcttattcaggattacatctgttgccgtttctacagttttgcaagaagtaccatcagccccgttttgaaaattacattttgccatctgttttcacttattctatggtgtgttctactcttaaatcttaagcttatcaaagaagtagagtagtaagagtagaagaaatatacttttctctgctatcataaatagcacataatcaaacccaagtagcagactttcccaagaaggtctcaccatgctcagttttattgttctcagcatttttggtgagttaggtgtcatcttgggttttacttttattaacattttgcataggttgttagtaccaggtgtctgacactcatggtgcatccttggtcttaaacctgtttttccttcttctgtatgtattattttaaaatctaagctctaagacaactccctattatagtcacactgaattttttaggcactttccctctacttctatattgggttaatttgcaattgcataaattgcagttttgtcagcttgccagtcctttcttgcatcttgagcactgcagttctcttttttccccccagaactcttttcttttcaaaggaaatttctaaagctttagattttccatgatacttacaaatcattcatggttttgtgggaaataagcccttatttagtaataaactttgcattttaaagtgaaaatggaaaaattgctcttagtttgctagatattagcatacctaagatgcaataatattttagcaggagaggggatgggaggagagagctagcgataactaatgttgcccaggtaaatagggtgaggtcagatctgattacatgcagattataccctactattttataattaaatataagtatttaattatatgacccaaagttttcagttttactgaaaaggatttttaaacgcactctttggtttcttaaagctcctagacaaggacattattttttagtgtgtgtatatatatctatatatctatatatatatagatatatagatatatagatatatagattttttttttttgagacggagtctccctctgtcgcccaa

SEQ ID NO: 38794 - DNA, 1035 bp, Homo sapiens
ttctttgtcagttattttggcttaaagattctatatgaattttaggatgcatttttctatttctgcaaaaaaaaatgccattgagattttcatagagattgtgttaagtctatagattgctttgcctagtatggatatcttaataatattaagtcttatcatccatgaacacaagataccttcccaattatttatgcatttcatttcttttaacaatgttttataatctttagtctacaggtctttcgcctcctccttggttagctttattcttattttattgtttttgttgcaattgtaaatggaattattttcttaatttcctttttgaactgttcattgttagtgtacagatgcaactgatatttatgtgtggatttttatatcttgcagctttaccaaatttgtttattagttgcagtagtttttaaatgggatctttagggctttctacatacaagatcatgtcatctgctaacagatgattttacttcttttcgatctgtatctcttttatttttcttgcctaattgctgaattgtttctttctttcttttcttttttgagacggagtttttgctcttgttgcccaggctggagtgcaatggcgcaatctcggctaactgcaacctccgcctcccgggttcaagcaattctcctgcctcagcctcccgagtagctgggattacaggcatgcgcctccacgcccagctaattttgtatttttagtagagacacggtttctccatgttggtcaggctggtctcaaactctcgacctcaggtgatccacctgccttggcctcccaaagtgctgggattacaggtgtgagccaccgtgtccagcctaattgctgaattatttctaagagagaatacaaattaagtatttttaaaaaggataagtgatccttgctttgaaagcaatggaaccactagaaggttttaaacagggaagacaatcaagtgtgtgctttaaagtaataccagaagcaccctggattctagtgaagtgatggaggtggtaagagtagat

SEQ ID NO: 38795 - DNA, 1109 bp, Homo sapiens
taaaatgaaaaatataccatcagtattgaacaaaatattagttgaatctcttcttctggaatgtcccaatagctttttgtggttactcatcgtggaaggttgtaatgccctagcattacagattttagggatgctaactgctggtgttgaagaataactgctgtaggaaaaaaaattagtgtaattttaataacattgactattagcatttaacacagaactattttcatcatcaacaagtttattcagctcattctaaatggtcccttatataagggccaaaagtacttaacttttaaaagttagcaatataatctcttcttgcttataaggtcaagtcttttgtgatagccttactagcaataatagaaaattgaaaaaaagcattttagttcccgtgtttaaaaatatttcttataagtgttggtattgcaaatgaattattaccaaatgttaataatctattatgtcttgttttttaaagtgaatgaatttttagcttttgagggtcccatcttgttggatatgagaattaaacatctaatcaaaacaaatcagttaagtcaagcaactgctctagcaaagctgtgttctgaccatccagagattggcataaaaggtagttttaagcaaacttaccttgtctgtctttgtacatcatcaccaaatggaaagttaatcgaagaggtgagtatgttttctttcattagtaattattttttaagttgagaaattaatttttaattagaatgtctttgatttccttttctcttagatagcgaagagatcattgtcaatcttacatttttggtatgttcttgagtggtggcaacttgattctaagtagcttttagaattatatgtaaactgattgcacctagtttctgttttaaataatatacatcttttaaatgctttggctaaattgtgggaaagatagtggtggcttaacagtttagtaaaatatctatatttgtcagcttttggccttaacttcaatcttgtctgacttcaagatacttgcacatcttttaaactggctaatttaagtaactttatagaatttttgtgacttatctctggaaatactttgtcatataaattctata

SEQ ID NO: 38796 - DNA, 1031 bp, Homo sapiens
tatttttccctcatgaatagatacgtagtttattagtctatacccagtgtacctctctgtgtgtctctgttgattctaatgcttgtttaaatcagtggataaaaggggaaaaaataaaagtactgcatttttttttcatgatcagatctgatttaatgggtagagattgcttatagttatcatcagttagttacatataaatgcttgtaaattcttaaatagttggttctccggtgtttcttaattttctcagaattactatataaatttctactggctataaagaaaggtttttttttttttttttaactgcagccagtctttgtcccagtaatgacaaattataactgacttgatagtgtatgaattaatggcattttattcataaaaactatctaaatatttaatgaaaactaaaggtatattgctctatattctaatataaaaccattttgtggcatatttctattggctttttctttagatttcagaagttgattgcaaagatgcactggaaatgatctgtaacttagaatctgagggtgatgaaaaaagcgctcttgttttatgtactgcgtttttgtcacgtcagctccaacaaggagatatgtactgcgcttggtgagttgatctttttttttttaaagaaatatttgttaaataagaatgcaaaataggctgtgagaattcatataacttaggaacataatttaaaatctttttaagacaaaaggcttatatttagatattacatgctgtgcaaacttattatcgagtagttgttacaactcaaaactttgtgtattaaaggccacacaattccttagcatgcataccaggaattatctttggtcaggaaatttttaagtgttagaaagtgaaagaaagacttgttttgtctaatgccaccataacatttttttagatatgtaagcaatacatttctttttatggtacattttcagttgggcatagcttgttatatgtaatcctttgggaggctacaggaaacagagatcttggtttcagtt

SEQ ID NO: 38797 - DNA, 1034 bp, Homo sapiens
agacacaggaatcgcttgagcccaggaggtggaggttacagtgagctggaggttacagtgagccaaggttataccactgcactccagcctgggaaacagagtgagacttggtcttaaaaaaaaaaaaaaaagatcttgggccagctcttcttgtctacttgggtaggtagatctgaaacaaccaccccctcaccaccgccccctgccacccgcaacacacacacatgcgcacgcacgtgcatgcatgcatgcatgcacaatcactacatgaagctggaacctgtgaagtactttaattttattgaaaaggtagactagaaaaataatactgtctaacacatatggatggtagggaattttaggtatgtccaactggactctgggtcagaggaggaaaatctttaggaagttataactacaagtctaccctcatacagatttgggagccacatttaccctagctgtgtagttcagaaatccgtatgccaagtaagttaatgtttaagaaggtgaggatgaatacctaagattcctgcagaagaaaatgcagaactgctttaggagggacatattgtcaacacaggcgtctcataaagccctgctttaacatgagttcaccattaagatttataaacatacaaaactatctgacctgagtgattttcagcaaaggaataataggattacttgcctaatactttaaataatataattatggaaaaatctaggaagtatatgtatttaaacacttaaaatttaggaattaaagtatgagaaagtatcaaaatgaccaagcagatcgtaaaaagagtcaaaagaacgtttggaaataaacatacatagttatcgaaatgaaaattttagcagatggattatacagattagacacaactgaagagggagttaatgaacagaggttgtatatgtgcttccacttattttttactattaagtattaataaatcagaactcaagtttcataaagttactgattttcttatagtaacctttgtagaaatgcagttgatttccat

SEQ ID NO: 38798 - DNA, 1044 bp, Homo sapiens
aatatggggatgttctcagttttataattagattagaagggttttgtttcagttagattgcttatgcaaacaggaagtaagagttacaataaggatgacatttattgatcatttactatgtgccagacattatactaaactataacacatatttaatctcctttaatacagcagtttaatgaagtttaagtgctgttttgacctctgttttataagtgggatgggaaaggtcagaaaagtcaaataacttccaagtttgcctagccattaaataattccataccaaagtcttagcttctaatacttaaacattttctgcccttctatgcagttcattttacatacacacataccagactaagctgcagtgctttagaaggggaatcctttcataagttgctattgcaagatttgagtaaaacaaatctcaatcttaactaaattctgaaataaattagtgttgattagtgtagattaaattaacatttcctatttgctttttcacagactgaaggggctggacttgctacctgtatagaactgtgtgtaaaggctcttcgcttggagtctacagaaaatactgaagtgaaaatatctatttgcaagaccatttcatgtttgttgcctgatgatctggaagttaaacgtgcttgtcaactgagtgaatttcttattgagcctacagtagatgcgtattatgctgtggaaatgttgtataatcagccagaccagaaatatgatgaagagaatcttccaataccaaattctttacgctgtgagctgttacttgtattgaaaactcaatggccctttgatccagaattctgggattggaaaaccttgaaacgacaatgtcttgcattaatgggagaagaagcatccattgtgtcttcaatagatgaactaaatgacagtgaagtatatgaaaaagtggtagactaccaagaagagagtaaagaaacttctatgaatgggctttctggtggagttggtgctaattctggccttcttaaagacattggtgatgaaaagcagaagaagaga

SEQ ID NO: 38799 - DNA, 1104 bp, Homo sapiens
tggatggagccgaaattgctcaagaacttctacagagtaatggacagccttctcttcttgccagcatgattctctccacaaatgcagtaaatttgcagcagccacaacaatctaccttcaatccagaagcatgttttaaagatccatcatttctacagcttcttgctgaaaatcgctcgccagcatttttaccaaatacatttcctcgatctggtgtgactaactttaataccagtgtcagtcaagaaggtagtgaaattattaaacaggctttggaaactgctggcattcccagtacatttgagggtgccgaaatgctttctcatgtttcaacaggttgtgtctctgatgcatcacaagtaaatgcaacggtgatgccaaatccaactgtaccacccctgttgcacactgtatgccatccaaacaccttgctgaccaaccagaataggacgtcaaactccaaaacttcctccattgaggaatgtagcagcttgcctgtttttccaacgaatgacttactactgaagactgttgaaaatggtttgtgctctagttcatttcctaattctggtgggccatcacaaaattttaccagtaacagttctcgtgtttctgttataagtggtcctcagaacacaagatccagtcatttaaataaaaagggaaacagtgcttctaagagaagaaagaaagttgctcctccactaattgcacctaacgcttcccaaaacttggtaacaagtgacttaacaacaatgggactcatagcaaagagtgttgaaatcccaactactaaccttcattcaaatgtaattccaacttgtgaacctcagagtttggtggaaaatctaacacagaaattaaataatgttaacaatcagttatttatgactgatgtaaaagagaatttcaaaaccagtcttgagtcccatacagtgttagcccctttaacattaaaaactgaaaatggtgattcccaaatgatggctttgaattcatgcacaacttcaataaattctgatttgcagatttctgaagacaatgttatacaaaactttgaaaagactcttgaaattattaaaactgctatgaattctcaaatac

SEQ ID NO: 38800 - DNA, 1087 bp, Homo sapiens
tatatgcaacccggtcgaatctcctccgacacatttttaataagcataatgacaaacataaggctcatttgattcgtccaagaagattaacaccaggccaggaaaatatgtcaagcaaggcaaaccaagaaaaatcaaagtctaaacatcgggggaccaagcacagcagatgtggaaaggaaggaataaaaatgcccaagaccaaacgaaagaaaaaaaataatttagaaaacaagaatgcaaagattgtgcagattgaagaaaataagccttattctctgaaacgtgggaagcatgtatattctataaaggctagaaatgatgccctgtctgagtgtacaagcagatttgtaacccagtatccatgtatgataaagggatgtacttcagttgttacaagtgaaagcaatataattagacattataagtgccataaattatctaaggcatttacatcacaacaccgaaatcttcttattgtattcaaacggtgttgcaactcacaagtaaaggaaacgtctgagcaagaaggtgctaagaatgatgtgaaagattctgacacgtgtgtatcagagagcaatgataattcaagaacaacagctacagtttcacaaaaggaagttgaaaaaaatgaaaaagatgaaatggatgaactaacagaattgtttattacaaaattaataaatgaagatagcacaagtgtagagacccaagctaatacttcttcaaatgtaagtaatgattttcaggaagataacctctgccagtcagaaagacaaaaagcaagtaatttgaagagagttaataaggaaaaaaatgtctcacaaaataaaaaaaggaaagttgaaaaagctgaaccagcatcagcagctgagttaagtagcgtgcgtaaagaagaagaaactgctgttgccattcaaaccattgaggagcatcctgcatcttttgactggagctcttttaagccaatgggatttgaagtatcatttctgaagtttcttgaggagtctgcagtgaagcagaagaaaaatactgacaaagaccatccgaatactggaaacaaaaaaggatcccattcaaattcaag

SEQ ID NO: 38801 - DNA, 1020 bp, Homo sapiens
tagataaaacactttctataaggaagttggatgttttgattttactgtttatagatgttagattgtacagatttgtctgtatttctcaccatatctaatgatacttttttcattagattggtcttcaagaacagtattagttataattattttggttattcagtatatagttagctcttacagtttagctttattcaccatatttatactgtggattcacagcgagaggtagaggttattccaggagagttgatgaccttcatttaaagtccaactaaaatcagtagtagaaacataagaaaacatctttgcaatatttacttttgtttctgtttgccgtaaatagtaacattgtttttttttattttgtgtttgttataaaacagttgcattcacaatattattggcctgagatattgatgatattgtgatggtatgaaaatgtgtacattccctgtgcaacatcagatttgcaggaaaaatgaagcacttactgaaatcgctggtactctgaataaataagcatggtcaaggagtgaactattttcttttggaaatttctttttaatttttattattaaagtattttatttttagggccttttgggttttattgaatagttcatttcacctgtttaagacttactaccaataagcataaaacctgacacgttaaaatccctgccctttggtgagcccactgttatttattaaaataaaagttattttatgggtgattaatacatgggttttctttttcctaaattaacaataatttaaataactgagtaattttaatattaaatttttgttaacaactgaatgtttccatacagttttcttagaaattgacctagctcttaaaggtgggcacttggcaaaactgccctatatagcacagtagcaagtaggtttatttctgatcattgtaactatgagccactgttaagtgaaaatgccaatgtattggggcttttcttttgctcattagcttaagaaaatttataactagacatttct

SEQ ID NO: 38802 - DNA, 1048 bp, Homo sapiens
tggaaatggtggtgtgagtggaaacggggagttaagaaaactgagatgttccaacagcacacatgttgggagcataatacatgttctcttacagaggaagcaatatagagcaagcccacattccagagccctgagaaggcaaatgaaggctaagaggtattttcagggaaaacaaagctacatgtacacaatgccctattcagcagggaataaatacttcaatgtccttggttttcagaacacaaacaaaattgtattaaataaaaaggattcttaagcctaccggaaaggttaatgtctttatgaattattaaaacaaagccccaaagattaaaaaggaaaaaatatgtttccctatgacatgtatcattgggcgtttgtctgtattactcaagaggatatttatgtaatcttactaaacatttgaaagtaccttgttgggcattttagaggtaggaggaaggtaagagactgtgttgctaaaagaaaggcaacaaaaaaaaagtgactgatctttgaatataatcagaggatgatggcatcaaatgtcataattatgacttttattttataaatgtccatcctatttttttaaaaaaattttttttcagatggagtgttgctctgttgcccaggctagagtgcagtggtgcaatttcagctcactacaacctccgcctcccgggttcaagcgattctcctgcctcagcctcccaagtagctgggattgcaggtgcccaccaccacggctggctaatttttgtatttctagtagagacggagtttcaccatattgactaggctggtctcgaattcctgaccttgcgatccgcccacctcagcctcccgaagtgctgggattacaggcatgagccaccgtgcctggcccctattttcaaaggatggaaagacaatggcattcttattctttacaataagaatatacaaaattaaatctgaaaaaaataaacctaataaacactatgaaatcagagacctatcactctttcatatgtatatatttggttcttgtaacaattggagaaag

SEQ ID NO: 38803 - DNA, 1067 bp, Homo sapiens
ttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaatatgtatttgctatgcctgtctgtataatgtacttcatatagtttaaaatgcacttcagtgatacaaaatcccttttaaagactcttttgtttttgttttccctgtgtattttggctatcacaaaactagggttcttctgtttttaacttatgcatttaatgacacattgccatcttttagaattttttactattcaacagaataagctgatgtttggtggcagaggagttattagttgcgtgaactgtcaagagattgcagtgcaggagggcaacagaaactgtacaaggtgcagacttgagtcatgtaagatctatgtgaatgaaccaaagtaactagagtcagtcaagcacaaagctgtgaaaagtagtgtgtggaaagaatcatactgaattttaggaacaagtacctgactatgatactttttacagagtgactacaagttgtaggacagtctttgtgtgtgctgagtgtcaacagc

SEQ ID NO: 38804 - DNA, 1024 bp, Homo sapiens
ttatctctaaataacaccctaattggatgggcacagtggctcacacctgtaatcccagcactttgggtggtcgaggtgggcagatcacttgaggccaagagttcaagaccagcctggccaacatggcgaaaccccgtctctactaaaaaaatttaagcaggcatggtggcatgcgcctgtaatcccagctactcgggaggctgaggtaagaaaattgcttgaacccaggaggtggaggttgcagtgagctgagatcgtgctactgcactctagcctgggtgacagagcgagactctgcctcaaaaaaaaaaaaaaaaaaaaaaaattttaaagtaccctaataaatgggtaaaagaaactatataacctttaaatagtagctggtagcataaaagtagatacatatagataacatgaggacgtttactgtacatacgtatgtatatataataagcaaatcaaattgtactataggtttccatctctcttttatccccgtaagagttttcagtctgaccttgagccttgtaggtattttcctaagaactctcacaatacttctctgatcctctcttcctttaaaatggtaaactaagggtgatttcatttcactcctgatatttgaaaatataagaagctggagagcagaggtgtttggaaaaaaaaactaaaatgtagggggagatcaaattggaatcatcttctaaaaacatcaattccaaaattgtttcttagcatttagtaagtgcttagtatgaatgattcattatgatctctaaagtgacttttcatacccaggacagtgtatctccattcttagatataccttaatgattgattccttatgccttatggaatatctaacccaaaccttaagtggataagttaaatctattgttagaaattaatcttttctattcagtgacctttgtcattgaactgttttaagttaaaaaagaaagaaagttgaaattgtctgttctttataagcattttgaaatgtccgtagaagagctagtgagta

SEQ ID NO: 38805 - DNA, 1094 bp, Homo sapiens
aatcctggcagtgcactatatagaactttgaaaaaaaatattaatacagatatccaaacacagacccactggatttaatactaatctaacacagagccactaaattaggacctctacggtcaggactaagcatgtgtattttttccttcacgtttaaataaccttttttatttcaagatagtttaagactcacaagttgcaaaatagatcagagttcccctgtacccttcatccagcttccattgatatcttacataatcctggcactttgtcaaagctggaacactggcattgaaacaatactattaactcaggtacagaccttatgtacacttttttcccccggcatagagttttatgaaatttatcatgtgtgtatattaatgtgccatcaccacaatcacaacatggagctgttccatcaccacaaaggaactccctcgtgttaccccttagctgtcactctcttctccccaaacttgaacccctgacaaccactaatctgttctctatcactataattttatcactgagaatgctatctaaagaatcatagattatgtaacccattgagattggctttcttcactcagcacaatgcccttgagattcatccaagttgtttatcaatagtttgttccttttacagtatgtgcatttttaaaaaaagctttgcagggatcctgttgtacaatcagggttgagaacaactaataaaaccaatgggatttaaacataaaagaggatagtgatagcctacacttgtatcacatttttatgaagttcaatacgttgatggtccatgcttagtcacattttgtcctagaaaatcttttctaattatttctacacaatgttgggcttttgcagtatgtgtccatctccaccgtaatatatgctgccctgtgtttttaagattcgctgatgaactagtaggagactctgtgccgccaaacatatacttttaattgctagtgacagaaacataactcagaatagactgcatgaaatggaatttcttgactcttttaacagagaaacccaagggaaatctggcatcaaggctttcaatctgtccatgcttacccttttag

SEQ ID NO: 38806 - DNA, 1025 bp, Homo sapiens
tatttttaagcctagacacttaatatttgaattgactagccaaatcttcatgcttttaatgtcgtaggtgtgtatctaataattgctgaagctggaatttccttcgtgtgcagtcagccacacctcgctatacctgtcaaaccatctcaattatccactccaattgtcatgcctctcgtgggttagttgtaaatggaacacaactctagcatgacattgcgacttaaaagagcatatccagtatttcgatgatcattctggaaatatatttcctcttcaaagtttttacctgtcagtgaggcatttaaattggggcattctcttgtttctgaagtctgataaaatcttgaccttagaatatttattggtaatatttattcattcacaaaattagttcttagcatatcctatatgtcaggcattagtctagagctggggctagaaaaatgaataagattgggttcctgaccccagcccaggctcacactgtagtaaagggaaacagacatgaacactaggtgacatggagtgttaggggcgctatggtagaagtctgcagagagtgcaatgggcgtccaaatgaggaagtgatcacttgcacaagagtgggaggcttggctggaaaggcttctctgaataggatgacatttgatctgtgttttgaagggcatcgttggcaaggtaagtaatccaattaaaggaggttgcctcagctaaagcacagtatgctcaaaggtgcggatcatttgaaaatttgagttcaggtgcagtaggggtaaggtaagtatccaacagaattttctacaatgatggaaatgttctatattgtcactgtccaatacggtagcctctagccacatttggccagtacaactgaagaattgaatattaactttcatttaattctagctaatttaaatttaaatagtttcatcagttagtggctaccatattgaacagtgcaggtttagagataaacagaggccagttgcaggagggtcttgcatcccattgaggaggactga

SEQ ID NO: 38807 - DNA, 1050 bp, Homo sapiens
attgctaataactgaagttttatactggagaatttgtgaatggagtgaacaagaaatagtttggtctgatgttaaactgccagagaaaatcgtacttaaaaacatttagtatttaaaagttgaaatacgtttaaaaactggtattccatgtcaaagcccaatctgttttgcacatacctaaacttatttgattacccttccacttagatcagtagttattttcaagaatataatatatattcccatatactcactatgcaaaaaggtattttttcaagttaatgacaatattataagtcagaatatgtttgtaggctatcaatatttggtttagtgtttaaatattcactttgttgtttttggaatcaggaacctgtacagtagctaaaataaagtactttttagtttatcagccctaacttctcttatttatgaaagtgttgataatctaggacatgagatggcaaacttttcctgtgaagggctggatagtctcttgtcataactactcagatctgctgttgtagggaaaaaaaagtagcctggataatttagaaacaaatgagcatggctatgttctaataaaactattcatggacactagaatttgaatttcctgcaattttcacatatcacaagatgttattacattttttatcaaccatttaaaaatgtaaaacaatcgtgagttcacaggcctcatgtaaactggcgacatatatagtttgttcaccctttatctagaagatgggaagtgccttctcttctactgattaaaggttattgctgtatatttttgaagtcatatttcttcccttgtgtaggaaagttttagaacaaaggaagtattatagtgatctccttcacttccttttatataaacactgattttttggctcctcagatcttttggaaagaaagtttaagcagttaaaaactatttcttctgttttactttttatttaaaacctgatatggtttttaaaaattgcctacaattcagaaaatattctttaatgcactcgggaaaatatttatattgaagaacct

SEQ ID NO: 38808 - DNA, 1048 bp, Homo sapiens
gcatggtattccatggtgtatatgtgccacattttcttaatccagtctattattgatggacatttgggttggttccaagtctttgctattgtgaatagtgccgcaataaacacacgtgtgcatgtgtctttgtagtcgtatgatttataatcctttgggtatatacccagtaatgggattgctgggtcaaatggtatttcttgttctagatccttgaggaatcaccacactgtcttccacaatggttgaactaatttacactcctaccaacagtgtaaaagtgttcctatttctccacattctctccagtatctgttgttccctgactttttaatgaccgccattctgactggtgtgagatggtatctcattgtggttttgatttgcatttctctgataaccagtgatgatgagcattttttcatatgtctgttggctgcgtaaatgtcttcttttgagaagtgtctgttcatatcctttgcccactttttgatggggttatttttttcttgtacatttgtttaacttatttgtagattctggatattagccctttgtcagatgggtagattgcaaaaattttctcccattttgtaggttgcctgttcactctgatgacagtttattttgctgtgcagaagctctttagtttaattagatcccatttgtcaattttggcttttgttgacattgcttttggtgtttcagtcatgaagtctttgcccatgcctagtcttggtattgcttaggttttcttctagcgtttttatggttttaggtcttacatttaagtctttaatccatcttgaatgatttttttataaggttaaggaagggatccagtttcagctttctacatatggctagccagttttcctggctccatttattaaatagggaatcctttctccattgcttgtttttgtcaggtttgtcaaagatcagatggttgtagatgtgtggtgttatttctgaggcctctgttctgttccattggtccatatctctgttttggtaccagtaccatgctgttttggttactgtagcc

SEQ ID NO: 38809 - DNA, 1044 bp, Homo sapiens
gaattgccctccatactgcactcaacaatccttactattatctcaaggtaagatgaacatttagttttctgatagtttagctcagactctgggcgtcattgtcataaaaatatactaaatttgcagttatgttttaatgagcagagagtcggcaattcagggttgcacgtctcatatatttttaaaaattctttagactgtagaaaaaaatttctaaccccataaagatagcaattagtagtcaactgttgctgccagtttttgaccatgtgtaatctttgcccttcacatgctaaagtcagatcataggcacaaagacttgagagtataatgttaccactcttgtgaaaataaaagaaatgtttcctgtaaacataacagcagacagggattaaacaatatggcctaataaattactgaaagaccgaaatggttgtttctagtgggaaagagaaatactttgggacttcatcttggattttaaaacaaagaaaggtctattctgagagcatctgcagagctgagtgtagaggataaccagcagtctgccactaaaactcctggggcagcacacttcagctgcccttgctaaagtccagacacagttatcaactcctggaagctctttaaacaatagttcaagacagctcacaattttagaaactagctttcttatgaccgggcaaaatgatcactttaaacattcaataagctgtatatacatgaaagagtggtaagttaaatacccagaaatcttgccacaataaatacttaagaaacaactccgtaagacctatgaagagcattccagtgtactggcttctcattgcaaaacggcacacaaacatgcagagtattacaagaatattgagtaggacgatataagtcaatggttttcagtgatggtgaaaaccactgaataatttcatacttaaccaaaaaatcagttaattttaatatataaaccataaattaaaacttacaaaatctgtcttcttcttggctggtgggtcacagaagagaactggtatgatttcagttgtc

SEQ ID NO: 38810 - DNA, 1033 bp, Homo sapiens
tgtcacatgaagacgttaatataatctgatgtccttatgatgagatcaccaagatgagtactaagagaggaggcaagcagcccaaggtcaagctcgggggcacacctatgttttagcaaaatgcagggaaatgaagattgggccaacagcaagacagagaaggagcagccagtaaaggagaaacgtcaaagcaagtgtagtattttgcaagccaactgaagagtgcttcaaggtcaaatgctggctgctgattagatttaacaatgtggaaatctttgctgccttttactaagagtaacagagaggagacgaactctaatcacctatcagatgacctaaccaagtgtccaaacttaacagcctggaaaagccgtaactgttgtgatgcaatatggagaccatagcatcaccttgcactcttgcacaacaagtttaacccgaaacttgcgaaaactttagacctttcagtttacagaaagttcaaagggatatcagaagttaaaattaatgacagtacaaagaaaaactcaacaagacaacaggcctagtatttccagaaagtaggaatcttaattgaatcgtgtttgggggatgagggtagctatttaaaaaagagacacatggaaaaatctgaaataaggactcgatgttaaattagggaagtattttaagtgggaaagtcaacttttctgtttgaatttcttttcctaataaaacaagttggtgaaaaaaaaggaaggggtaataaactggaggaagtttagaaaactgagttttgcttttataaaggggagcactaaaataatcactagcaagggatataggatcaaaagattttttaataacatgcttattatgcttttggaaatgatttagtagagaaagaaaatagatgcagtagagagaggagaggactgctggagctgtatctttgcctgagacataggtttgcatctcgtgctccttacctggggcaaatgcaggagcaagagaattgtgggagccatgtatccatgagtagacatagactatt

SEQ ID NO: 38811 - DNA, 1033 bp, Homo sapiens
tgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggtgaggccgccagggggccgttggggagtcgggcccttagacggtcgcggccgagctctggggctgcagaccctgcacccggggggtcgggcgggtgggggcggggtggggggggcggctgtttactcgggagggaagtttccgtgacgcccgctccattcttgctttgggggaagaagggggaaggggaggcatgcgctggcgcttctgattggctcccaggagtcggccaatgagaagcgccgctgcgccccagcaacagccccgatttagaaggctggcggcgttccagggggtttcggcgttccgggcgcgcggcggggtgggggcagggacagggcccgcgggagggctgacgtcagcgcgcgctacgtgcccggcgctccggcgcccatgaaggaggcgaggccgggtgggggcagctggggaaggactgggcccggctttcggcctcccggctatcgggagccccagtcctagtcggtgaaacgcggagacggcctctaacgtcccgccgtagggggtggagtgggctccgagcggctgggtttcgtttggttggagttgtgccaaaatgtgaggtgcccggtgtgggacgcgcagtccagttggggctctgcccgcctcgggcctgacctacttagtggttccaagttaagagttggcaggagccgcacaaaactgattttattacttttgccactgtggtacttcgtgttagtgtg

SEQ ID NO: 38812 - DNA, 1057 bp, Homo sapiens
ggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgca

SEQ ID NO: 38813 - DNA, 1042 bp, Homo sapiens
agtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacgcgctgcccggcatcggccacgcctgcggccacaacctcatcgctgaggtcggggcggcggccgcgctgggcgtgaggggggccttagagggcctccccaggccgcctccgcccgtgaaggtgaggtggggcccgggtgcgggaccctatccgactgcccgggtcgggggcgacccgggaagggcgggactctcgtgcgtcccgcgcgcctcggtgccctcccgcccggggcaggtgtgtgtgggaccgcgctaaacctgcggtcctcgcctcggcgcaggagcagagctgaacccccagtcaaagtcagttcgcgttgccgacctggcgacatcttgcagattattgtttcctcctctctagttataaacagctctgctgagttgttcccttaggaaagaacttacacccaagcctggtgtttgttacgggttatttttggtaactgagagaggcaacagcaatttgctgacaaggttgtgccatcaatctcaggaggaaataacttcttgtaggtaatcctacggcccctttttattcgtctccaaataaatcttttgtttgtggcagtcctagaaaatgtgattcaagtcattggtatttggataggaattttcagtcgctagaaccaccagacccctagaagtatacaaataaaggggaagtgaatgagcattatacatagatgagttcatccttaagtcttaatttttttgttttatgattttaagaaatacctcgactctttaaacagggaaatgtcgtttatgtttgtcgtaggg

SEQ ID NO: 38814 - DNA, 1033 bp, Homo sapiens
gtgcttttccgatttgtctggtgctgaaaccttttatttgtctttctttatgttgaagaactcactttttagtacctaggagcacacatcattgaagtggtttggattttttataccagaaatttcaaccatagtagtaactatagtagttaatggtccaggcacaaggagccagtgctcagctgcttcagcaaaaccatgtgttttcctcagaagtagctcggtactgagggaatgatagcagaaccatcacagcagtgcttctagattgtacccgggtatcccacctcttagcaccttaccaggccctgttttcaaagggtgatcattttaactattagggtatcttccttcttatcactggaaattggtactgtggcagtaggaggaatctttgaactttggtttcaagggtggtggtaaactagtccatctctagaaaacactggggattagaaatctctgcccttgcctttgactagaaggggcctgcatatgcaggcaggctctgcagctcattacccttctgggacttaaggttaggcttcgtggtcttggttctgaagtcagcgcacttgaccccagaccttctcctagtatctgccttcttagctttctcactgatcatctcttttttttttttttttttttttttttgaggctgagtctcactcaattgctcagactggagtgcagtggcacgatcttggctcactgcaacctccgcatcccaggttcaagtgattctccttcctcagcctcctgagtagctgggattacaggcgtgcgccaccacgcccagctaattttcatatttttagtagagacagggtttcaccgtattggtcaggctggtcttgaactcctaacctcaagtgattcacccacctcggcctcccaaagtgctggggttacaggcatgagccatcacacctggccttcattggtcatcttttaagatagaaaagagaggtcaggtgcagtggctcacacctgtaatcccagcactttgggaggccaaggcaggtggatc

SEQ ID NO: 38815 - DNA, 1052 bp, Homo sapiens
ataactccagaatacttaaccacatatacttaaatagacttttcttaactttgtgtgttccaaggatctacggattttggaaatgttagttttgtggttcctggaattcatccatattttcacattggatctaatgccttgaatcatactgaacagtacactgaagctgctggtaagtgttgttggatgtgactgttttggcacacacactcttcttctggtagtagctgcctttctgtttaacctactatttcactacataacatcacctcagtaaatactgcactgtggtgggcagttggagagccagttgagatacgggtagctaacctgtgaaattaaatacagcttaaataagtaaggaggtattttattttctctaccttttagggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtcttt

SEQ ID NO: 38816 - DNA, 1054 bp, Homo sapiens
ctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgct

SEQ ID NO: 38817 - DNA, 1976 bp, Homo sapiens
acccctcaggagccccatcggcgaagcctcagcaagtggcatctcccggggtccagagagtcggcgtgctgtctggtttgggtccagacatcagctcacccaagcttatcttgggcttttaagtgtgttgcttccggtagatctcggggactggaggggaagtgcagcattatttgtgacccaagagggacttgaatgtctcaaagctggtcaagaatgtttcccccgcgaggtagcatgagatgggtcacgtggtagtaaagagccacttcgggcccgtgagatggagttctgactccaccacttgttaggtgtgtgactttggaaaacccacttctttaaaccttagtttttagaactctaaactgcaggtattgtacataacctcgtagtattgtgttcatgcagtgaagtgatgggaatgaaatgcttggcattgtactcttgtgtgttagacaccttttgcgaacctgttggatgttgaattcattcatgcttaggttctgttaggccagtgtaagtggaaagaacttgggcaatgaagacaaacacacctgggtccaaggtggtcccatccatggtatactgattgggggtttctcatccccaaaacaccaatagcagccttggcggggtttttgttgttgttgttttgagacagagtttcgctctgttgcccaggctgtaagctttgacctccttagctcaaccgatcttcccacctcagcctgggaccaccacacctggctaattttgaatttttttattttactagagacagagtctcactgtgttgcctaagctggtctcgaactcctcctgtctcagcctcccaaagtgttgggattacaggtgtgagccactgtactggtctgcagccttgttcttgagtgtagtaggtgtgtctataccgatacatgttacactttgtcatctttagtatttgtttagcatatggtaacaaaaaattttttaaaaattagggatacaaattaaaattggggagtattttctgccctctaggtcatactggacatgggggaagggtagaagagggatgaagaggaattaaagagaccagaaaacaactagtcgcagtgttgggaggtataaaccaatggtaatttttaaaaatgtgaatttattaactccttgttttttcatggtggcaccaaaaattaatcttagtctcccacttaaactcatcagcctccccaaagcctttccagataagcatatgctccatgtaaaagcagactgcctgcgatccaactcagcttagagacaaggcacacttccaactcccaaggcctccttcttgtatagagatgctggtgctgccactgtgaaatacatcatacactcagacagtataaaccttagagtgcaatgtaaagaataacaatagatcacacccaagtacgagtcacccggctgaagaactagaacatcgccaggcccctggagcccctgagtacccctctccattgccttccactcacttctcgcctcccacccaaggaaccactattctggatgttgtgttaactttttcccttgcttatatgaaaaaccctgaggaaaggaagtttcccaacaagcatttccacaataacctggagcattctttatttttctttttttctcaaggagcattgttattgaacttaaaagcaggctattgagggtaagatacaaaccacaaaaaagccgaaagtctcaaagtcgggggatcttttagtctctgtcttcttccaagtttctcctgtctccctggcacggatcccgaaggtgtgttctgtctgtgtaggggagacccagtctcttccaacatagattgatggctgtgattttaaaagctttgcttgagtccctaagaagtgggaaaacagtaatttgggtgcgtgcgttttagaagtttttttaaaaatgcaaattatccagaaggcattgtgtgggatttgaaggattaagct

SEQ ID NO: 38818 - DNA, 1052 bp, Homo sapiens
acggggtttcgccatgttccctaggctggtctcgaactcctgggctcaagcaatccacctgccttggctccccagagtgctgggattacaggcctgagccactgcgcctggcccatcagcttggttttatacatttgagggaggcatagacaccaatcaggctgggtgaggtggctcacgcctatagtcccagcactttgggaggctaaggtggtcagattgcttgagcctgggagttcaagaccagcctgtgcaacatagtgaaagcccatctattaaaaaaaaaaaaaattagccaggcatggtggtgcatgtttgtagtcccagctattcaggagtctgaggtaagaggatcgcttgagcctgggaggtcgagactccagtgagccaagactggcaccactgcactccaacagagtgtcagaccctgggcaacagagcaaaaccctgtctcaaaaaaaaaaaaaaaaaaaaagacagcaatcattatctgtgaggtgtgtattggtttggttcaaagattttctcattggcaattggttgcaaaagttattatctaaagatctggaatcagtagacagaagtctctgggttacgataaggggttgtggagaccaaggttcttattatgtaggtgaagtctcataggtggccaccattagagaccacagatggcagatgttttctgtttaaacctttaaaagatgctggactctcagttgatctcattagcacatggagggactagagggggtaagatctagttatgttaatagagactctttgcagaagcaattttccccccacaaaagatggctttgtagggccatttcaaaatatggcaaagaaacatattttgggataaaatactttgattttcttctttatctgtcatgtgatactagagtcagattggaaattggtaccttattgctacaaagaatctgttttgtcagtttgaagatctctgttttaatcttactgctggtcagttgtgcctgaactccaaaagggaaggtataatgaagcacatctgcttcccccacccctgc

SEQ ID NO: 38819 - DNA, 1051 bp, Homo sapiens
aggacattttaagaattatgatacgttggccaggtgaggtggctcacacctgtaatcccagcattttaggagaccaagtcaggaagattgcttgaacccaggagtttgagaccagcctgggcaacatggtgaaaccccatctctacaaaaaataaaaaattagccaggtgttgtggcatgtgcctgtagttccagctactcaggaggctgaggtaggaagatcacctgagactggaaggttgaggctgcagtgagccatgattgtgccactgcactacagcctgggtgacagcaagaccttgtcaaaaaagaaaaaaaaaaaaagaattatactacatctactctgtctgtgccgtataaatggaacagcaaagcccagatgacagtacatctatttacaggtggtttactgaatatgttaagcccactgttaagacctactgcttagaaaacaagatttctttcaaaattactgctcattgacaatgtacctagtcacccaagagctctgatggcattgtacaaggagattaatattttcatgcctactaaacacaacatccattcttcagcccatggatcaaagagttaatttctattttcaagtcttatttaagaaatatggccgggtgcggtggctcacgcctgtaatcctagcactttgggaggccgagatgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaaaaaaagaaatacattttgtaaggctatagttgccaaagaaagtgattcctctgatggatctgggcaaagtaaacagaaaatcttttggaaaggattcacctttgtagatgccattaagaacattcatgat

SEQ ID NO: 38820 - DNA, 1030 bp, Homo sapiens
gtgtgactcattttattgtggtacttgctttattatgggggtctgtaaccaaaccacagtatctccaaggtatgcctctataattcaaattactaaaattcagccgggtgccatggctaacgcctgtaatcctagcactttgggaggccaaggtaggtggattgcttgagcccaggaattcaagagcaacctgggcaacatggtgaaaccccatctctacaaaaaatacaaaaagttagtagggcatggtggcgtgtgcctgtggtctcagctgctcggaaggctgaaatgggaggactgcttgagcctgggaggtggaggttgcagtgagctgagatcacgccactgcactgcagcctgggtgacagagtgagaccctatctcaaaaataaaatgaaataaaattcaaagtacatcctcttttcaggagctcatccttgtcaggaaggtagaaatacctttgtggactgcattctctaaagtttgcaaaataaacagccatcttctattattaaaatggtagctctgtatcatttctttctcccctccaaaatgtgtgacaggtctaatttctctctagataccataatttccttccattttattactaaatcctggagaaaagcccattttgaagaaaacagagcttacagctttaaaaactgattgttattttgatataccaaaacccagttttgcctttatgctcagtgcatttctgtcattgtacgtcctaaactaactaatttatattcttcccttggtacttaaagaatcaaaaaccctaacactgtacttgtaattgactggttgtgttaaaagtgaccatgtttttgtgcatctaaaaatagaacataaaatattgtatctgattttgctccaggacttctgtggtttcttattataaccccctctgctaccctttgaaattcctttaatgtcagggacatttactttaagagtaagataatacatcttaagagacttttaggctgggcatagtggctcacacctctaatcccagcacttt

SEQ ID NO: 38821 - DNA, 1053 bp, Homo sapiens
gtgtgcacatccacccacagtgaaagtgaaaccaaccatgagttgaatgaagtattatgggagtgtttgtgggaagcctgacaaacctaaagtttgcctctcattttctagtgtagtagtggattcttggtacggttataagctgttctagacagtgcgaaatctagtgttgatttcactttgatttgaaattatttgtgtttttactttggctcctttacagccagagtaaaacttaacttatattcttgtattccaagtttaacttattttccaagtttagcttaacctatattcttgacctgatcagaatttttggactttgggtcaaccataaagaggctcaatatataatgagaaatttgtctcactttaagttgtcagaaagcagcacccaaaacgctctatgtaaaacatgaatagatgcatgaaaatacaacttatttaagaaacaaacccaaggagcccaaacctaaaatctggacctttcttacttaagcaaaaatatcagagtcatgcacgtatgactcttattccatgactgtcttcaaattgactcatcacatccctgttttcaaattaaatagttgccatattctaaattctgtttatgaagttaggaggtaaacagaaaacaatctaaaacctgcttatttcaattgattctgtttgttagcatatctgtactggcatgaatatgattggaacatgcagagttgtagcacacccttatttctggttgattgccaaaaataaagacatcaaagaaaatagaaaaactgggcaacaaatcataactgcataggtttttaaatttagtagttattctagatctctctccatagcttttctgaatgaaactgtccctctcacagcccccagcctcccactgtcctagatagatgaggtgattgttctcaccacctttggatttgtacatgtgtggcattgttttcataggacagattcccagatgtggaaatgctcaaagagagtgaacatttaacaaatactgccagattgtcctccagaaaggttgtacccatgtgcaca

SEQ ID NO: 38822 - DNA, 1058 bp, Homo sapiens
ccctttacttggaggtggaattccaagcagagaagccagaggctgcctgtgctgtgatattgaagatagaaatactaccctgaagttcctggcatgaaaaatatcacagtacaggcagcctctggaaatggaatgaatataccatggttagaaaaatgcatcaggctgcaaaattttcaccaggcagtcctactattaataatgtcatatgatatattttttaataaagcaatacattaaaaaacgaatagtaactggaattgaaaaagtcctggctgtatcaccagatgtgtcttcttcagtaagccattgaatttctgagagttctcagaaatcgtgtaatgggggaagagcctaacgccctcctcccaggtccctaatctcccaggagattaaaggggctgtgggatgggaaagcactttggaaattgtaaatagctacaacaaagttaattgctattctcattagagctatgaggcttttagtggctttaggcattaataatagatgagctagcatccaggactgtgggccgtagttttaagtttctgttgattcttgttgtattttgatttattaggtccaacttaatctatttcaggccaaggcaatgggttgtgagctgagtaaataataaagataatgtgatgcacttaacacagtcagaagaggactgtccccaattagtcttttttttttttttttttttctagcacagaaaaaagcacagctcttactgtatctgaaagacactttggtaggaatgctcatcaagacggggcttgcacctgaggccatttcttaggagtagcttttgcctgcatcataatttcagaacatgtgatacttgggatgcttttcgtcattgaggtttacttgtctttatatggaacataatttgtacctgcaaaatcaagacttaacgattaattgttttcccttatggaagcctaaggcttgtttctacgtatttccagggttttgttctttaaggaacacatgcttatgaaaaaacacaaatactttcagcaaaaagtcttctgtgtctcccttcctc

SEQ ID NO: 38823 - DNA, 1022 bp, Homo sapiens
gagatgagcctgtgactggatagactgagtagagcagatggccctccccagtgtggatggggatcattcaacccctcagggccagtcctgatggaacaaaaaggcagaagaaggttgacttctccctgcctgagtccatgagctgagacatcaatcttctgcccttcaactaagacttacaaccatcagggatcctggttctcaggcttttagactgagactcaaatttacaccactggttttcctgggtttccagcttacaggggtcagattgtgtgacttagcttccaaaattgtgggagccaattccattctagattttttttaagacacagcctctgttgcccaggctggagtgcagtggtgtgatctcagctcactgcaacctccacctcctgggttcaagcgattctcctgcttcaacctcctgcaagtatctgggtttacaggcacgtgccaccactcccagctaatatttgtatttttagtagagacggggttttgccgtgttggccaggctggtctcaaactcctggcctcaagtgatcaacccatcttggcctcccaaaatgctgggattacaggtgtgagccactgtgcctggcctcattctagattttcaatatccatatctatctgtatatctcctatttgttctgtttctctggaggaccccaataacagtgagaataaatttgtttttggtttgttttttggagacagagctttactgtgttgcccagactggagtgcagtggcacaatcatagcttactgcagctttgatatccctggctcaagtgatcttccccacttagcctcctgagtagctgagactataggtgcataccaccaaaacgagatgatttttctgatttttagtatagatggggtctcactatgttgcccatgctggtctcgaattcctgggctcaagttaccctcctgccttgacctctcaaagtgcttgtgttacaggcgtaagccaccacgcctggccagattgctgttttaagccaccat

SEQ ID NO: 38824 - DNA, 1038 bp, Homo sapiens
tgtctgacagctcctatttttagggagtttggcaagagtgtggtttttcttgtagctgtaggaatttaggaattcggggctgtgcccgccaagccctgaaccctctaccctctgcccatgggtaacttttgtttccttaaccttagtgttcgtcttagtcgataaagggacatctattttagtctctcagatcacactgccatgagctgctggcttgtttgtgaggtaccaattatgtgtgtacacacactctggttgccaggggcttttaatgctccagagtggtctaatggtctaccccatccagtttccccataatctctggtgctgacatccagggagccacaaaagttgaacattcatgaaccaaagaggtggcagtttgagccttccattccctccttcagccttgctcctataccttttcatctatgaactctcaagaaagagtaacagcagctgtcagcccacagtagtcctgttggcaggctctaaaatgtgtcttctcaaattgcagccctggcctgagctggagagagtacctagtggaattctgcccatttcacagtggttcagatctgcaagaaacatatgccctgtttaccatttcctgatgggtatggggtgagggctcctaaactatggtattagtcagggttctccgagaaacagaatcaagaggacatacagacagaaatttattttaaggtagtggctcacacagttatggaaactgagaagtcccatgatctgccatctgtatgctggagacccaggaaaaccagtggtatagatctgaaggcctgaggggcagggagcctatggcgtaggctccaatccaagtctgaaggcctgaaaaccagaagagccaagggcaggagaaaattcccagctcaactgtcaggcagagacttcagccttcaagtgactctcccaccttggcctttttgttttattcaggccctcagcaggttggatgatgctcacctacattggggagggcaatctgctttattaagtccagcaattcaaatgcta

SEQ ID NO: 38825 - DNA, 1043 bp, Homo sapiens
catagttataaaatctaagtggacataaaatattgattattttttaactcatccagtgcctagcaaggtactcacatcccatctgtgccgaatgaggggaataatgttattgactgtgaatttcttacactttgatagcaattgcaaggtattaggtactcttgtaagagctctacaacaattaagtattttaaacctcaccatggctattatccccattttacagatgaggaaactgaggcaaggaatgatcaggtaacctgccctaagtttcccttagaaagtgtcaaaactgggactcaaaccctggccatgtggttcgagagtccttgctcccacaggaggcaaggaggaaagttccccttggcccttgaaggctcactgaaaaatcagctgacaaatggcagataaattgtagaagaggcataaaaatttatttaacatgtacatacaggagccttcagaatgaggacccaaaaatgcaggggaaattgtccatttttatgcttaggttcaaaagagtgtggatagccatgtagaaatatgattggacagaaagggcacgatctaatgctgattgcatgggaaacccagcaaagcctgtctgtctacattcttcttggcctttctgagctgagcatttctgccttctaggtatgaggcaggaccctctctggaatggagtgttaagacctacattcaactaggtcagataatttctttatggcttgcttttacgcagaaaggggaggaggggaaggttagagtaatatttttaagttttatggctggctttgagggtagcagattctggtttctatgacctgccttgggggaagagggattctagtttctatggttagcctctggggaggaattgaggggccagagataggagggcaggaagaggtcagagaaaaacttttgcttgtgaggccttccttttgggttgttttttgagccccaacactggtaaccatcatgtttccactatgtggtttataagtttagattgtgaactttctatgggctgctgcttgtta

SEQ ID NO: 38826 - DNA, 1016 bp, Homo sapiens
caggagccttaaaatggtccttttttggcctggcatggtggctcacacctgtaatcacagcactttgggtggctgaggtgggtggatcacctgaggtcaagggtttgagaccagcctggccaacatggtgaaaccccatctctaataaaaatacaaaaattatccgggaatggtggctcatgcctgtagtcccagctacttgggaggctgaggcaggagaatcgcttgaacctaggaagcagaggttacagtgagccaagattgcaccactgcactccagcctgggcacagagtgagagactgtcgtgggggcaggtgggggcgggggtgggccttttttggccaggtgcagtggcttatgcctgtaatcccaaacttttaggaggctgaggcaggcggatcacttgagaccaggcattcaagaccagcctggccaacatggtgaaaccctgtttctactaaaaatacaaaaaattagctggatgtggtggtgcatgccgtcatcccagctactcggaaggctgagacacaagaatcgcttgaacctggtaggcggaagttgcagtgagcttagttcgtgccactgtactccagcttgggtgacagagtgagacccggtctcaaaaaaaaaaaaaaggtcctttttacttggtacctacctttcttggactctatcctaaaaaggtaataaaacctgctattgaaatgaaatatggaaaagaaaaaaataagcaataaaaccagtaaaattttaccgacaaagatgttcatgacagcagtagttatatttttttaactgtggggagggagacttagaattatggttcattcatacagtggaatataattaatattaaaatcgtagttttgaaaataatgctttccactgttaaagaacatcacaaagagatataagatcatatatagtacatgtcccagtgcttaatataaatttgtgtatttaaaaatttaagcacagaagaatatcatcagaatattaacagtggttatctctg

SEQ ID NO: 38827 - DNA, 1079 bp, Homo sapiens
catgtttcctatgcccaggaagttatgaagacttcaacaattaaactgaaaccaggggaagcttgcttagttttgggtttcattataaactcttagcctcagtccaggttaatctgaagtttgaaagctcagattaagcaagccatgccaagaaactggacgatgtgtaagcctagactctaaaattcaagatgtgtgaaataatataagtcaaaagcaagaaaaacgtaatcccgtctgaactcaagtagtcattcatataaatttgaacacacctgctgtgcctagacaagtgtctttctgtaagagctgtaactctgagatgtgctaaataaaccctctttctcaaattcgtaattctccaactgttgacattttaatcacatgaaaagttatcagatttttgaggagaaatattttcatgatgtcacaagatccaatatatcttatgataaaatttattgaaaagtcagtttatttaaataatgaataattggctaacagctctggaaacaatgagatcaaatgagaaagattcaaattgtttgttattttctgtattttcagtcaaaaaatcagttatatagtgattttaaagcagattaatggaaaaaaattcatgtaacaattacctgaaaatttataacctattcctaatcaaacccaattatatcagaatacctttctgaatttgagatttttgctctacattttataatgaataaggctattttttgaaagtatttcattttgaattctgtcattaacctcaaaagctttctactgctttgcggtgaaggcaaaatattcgataactcaacttaggccccactgttccccaacttcatggaggccagaagactttactttgttccataatgaaatataaacacagaacaaagttgtaaaagtagcatggatatgttgaaactttggacaagcttcttgtcctttggaatatgggatttatattcatctcctcaatatcccatgtatgcacagaaacttcagttctatttctatagacacaggaacctagtgactattgaacgtaattgtaataaaatgctgctcattga

SEQ ID NO: 38828 - DNA, 1099 bp, Homo sapiens
cactattttgcaactcccagttaatccattaatcttggcattaagtatcaatggctgctaacatagcaaaaggggcaaaaaaaaccagactttagatagctcttgctgaaagaacataatgctacctatagtcttaccaaaaggatcaaacctctgatccagctgtcaatttttttttttggggggggtgatggagccttgctctgtcacctagcctggaagtacagtggcgcaatctcagctcactgtgacctccaactcctgggttcaagcgattctcctgcttcggcctcccaagtagctgggattacaggcttctaccaccacacctggctaatttttgtatttttagtagagacagggttccaccatgttggaccaggctggtctcaaactccttgcctcaagtgatccgccagcctcagcctcccaaagtgctgggattacaggtgtgagccactgtgcctggccccagctgtcgattttttaaaatgaagatgatagaatatgttaagctgcaccatgaatttataatcagaaaaactcagactgtgaaagattctacagatcaaaaactcaggtttttcaagacataaatttaagaaaaaagtatgggaggggaaactgtgaattataagaaatggcaaaatgatttaaatgtttgtgaacctccaaaattcgtatgttgaagtcttaataccccagtgtgatggtatttggaagtgagaccttttggaggtaattagatttagatgaggttttgaggatagagtcctcataataggattattgcccttataatgggagggaaagactagagtcccttctctctctgccaagggaggatacactaagaaggtggccatctacaagccaggaagggagccctcaccagacaataaatctgctggctccttgatcttggatctcccagcctctagaactgtaagaaatttttgcttgttgattaagttaaagaggttcagaacgtgcaaccccgaaacagaccattttgacatactgattattttgaagtaaagaaaaatcagaaccagccaactcagtgaaacgtctttacctccccaattgcctaaaataa

SEQ ID NO: 38829 - DNA, 1378 bp, Homo sapiens
ccgagtggaggtcggctgcccctgggaaaccagagagtcggagggagtccatctggagcggccaagtaggtcggggaagggccgcgcctgacgtctggccgcaggtagccacgttccctccgcccccggtgcagcttcagggcttgcaccctgcgtccctctgtggtccttcgagagggtctgggcggggactatgggtgggcgcgcccaggaattgtcccttcggcctctcgtcctgcccctcccccccaccatccagtctctccttggaatatactcttaaaatctttcggatggagttctttggagaaatgggtttcctggagtgtcaggtgatcattgatgttgattgtttctgaaatgtttatttaggcatcaaaccaacatgcctaaataagtttttcatttctacagcgcctagattcattcctagcacatagtaggccctaactcagatgtgaatgtaggattcgtaggagctgagcatttgtgcttcaggcatcaagttgtctttgactcttcgactcttccttggtctttttccattctccacacctccagcagcaaacctttcgcctctcctcaaggcctttcccccccatctccctcagcgcctctttgactggagggggacagaggctttcatggcagggattctcccatctcccttcctatccccgctatgccctccaattatcttttcctggcgttccgttttacaagagatggccttctttccaaaaacatttatattgtattgaatattcttgattttggccatcttgctttacagacagacctggggtctaatttcagctctgccacttaccaggtggttgccttgtgcaaatttcttgatcgtctgtgttttcctcatctgtaaaatggggaaaagaataatatggacctcatagaactctggggaggatttaaactaagtgaataatgtatttagatcatttaggttagtgcctggaacatagtaaatgtgccgtatatgatagcttttgttagtatttgccccttacctcttcttctggggtcttgctgtattagcctttcccatgagtgtaaaaatacactgtcttctctggctttttcctgtttttctctacaaatgcttgtgtttttctctaaattttattttttgtcttttagcgtctacattaaggacacattctcagtttcgtaatgatttttctttttcttttttcctttttttttgagactatagcccaggctggagtgcaatggcaagatctcggcttactacaggtttgacctcctgtgctcaagcaatcctcccacctcagccttccaagtagctggaactacaggtgtgcaccagcatgcctggctaatttttgtattttgtaga

SEQ ID NO: 38830 - DNA, 1079 bp, Homo sapiens
cctgaggatgggagttcgagaccagcctgaccaacatggagaaaccccatctctactaaaaatacaaaattagttgggcgttgtggtgcgcgcctgttatcccagctacttgggaggctgaggcaggataatcgcttgaacccaggaggtggaggttgtggtgagccgaggttgcaccattgcactctagcctgggcatcaagagcgaaactccatctaaaaaaaaaaagttaatttgtattttggtctgttttataaaattatcatttactctgtacatagcttaatgacaattttttgtttatttgttttgtttttgagacagggtctcactctgtcacccaggctgcagtgcagtggcactatcgtggcttactgcaacctctccctgccaggctcaagcgatcctcctgcttcagccaccaagtagctgggactacaggcacaggctactacagtcggctaatttttgtattttttgtagagatggggtttcaccatgttgcccaggctggtctcaaattcctgggctcaagcgatccacctgacttgacctcccaaagtgctgagattgtaggcatgagccaccatgcgtggccatattaacaagtttaaaatttttgttttatagttttgactttttcctggaaaatattaggcactttttttgataacacaaatctgcttttaataatgttagagagaaaggccaggcatgggggcttacacctgtaattccagcactttgagaggctgaggtgggtggattgcttaaggccaggagttcaagaccagcctggccaacgtggcagacaggcaaaacccggtttccactaaaattacaaaaattagccaggcatggtagtgcactcctgtaatcgcagctatggtacactcctgtaatcccagctactcgggaggctgaggcacaagaatcacttgaacccaggaggcagaggttgcagtgagcagagatcaagccactgcactccagcctgggcgacagagtgagactttgtctccaaaaacaaagaatgatagagtgaactttttcaatgtgtccaaattcgaaaattgct

SEQ ID NO: 38831 - DNA, 1074 bp, Homo sapiens
gatgatggtatatatgtcatgggttcttctaggtccccactaaattactaaaatatcaagagggcatctgtgctcatataccctattaataaacagcccttatactatctctcaattgtatattcttttctttctcaaggggattttctccattaatttctctcttttattggttggaggcaatattttgctccagagaggttcatattttcatagcctaacctctgaaaaagttgtctaaacttgtaaacttgttttcattttctttctttctgctaactcactttttattttttttaagatggagtctcactctgtcgccaggctggagtgcagtggcgcgatcttggctcactgcaacctccccctcctgggtttaagcaattctcctgcctcagcctcctgagtagctgggactacaggcacgcgccaccatgcctggctaatttttgtatttttagtagagatggggtttcaccatgttggccagggtggtcttgatctcttgacctcatgatccgcctgcctcaagcctcccaaagtgctgggattacaggcgtgagccactgtgcccggccatttttttttttttttttttttttgacagagcctcactctgtcgcccaggctggagtgcaatggtgcaatctcacctcaccgcaaccttcgcctcccaggttcaagcgattctgcctcctgagtagctgggattacaggcgctcgccaccacacccggctagttaaaaaaaaatttttttattttttgagatggagtctcgctctgttgcccaggctggagtgcagtggcgtgatcttggctcactccaacctccgcctcctaggttcaagcgttctcctgcctcagcctcccgagtagctgggattacaggcacccgccaccacgctggctaatttttgtatttttagtagagacggggtttcaccatgttggtcaggctggtctcgaactgctgacctcaggtgacccacctacctcggcctcccaatgtgctgggatcacaggcatgagccaccgcactcagcctacacccagctaatatttttgtattttta

SEQ ID NO: 38832 - DNA, 1025 bp, Homo sapiens
ctaggcttagtgtaacaaaactaccagaaatgggtggcctaaacaaccaaaatttgtctcacagtcctggaggctagaagtccaaaatgaaagtgtcagcaaagttagtttcttttgagagctctgaaggaaggatctgattcaggcctctgtactcttagatggttgtctacttcctatgtctctttatatcctctttctaaatgtatctctgtgtccaaatttccccctttttataagaacaccagtaatattgcatgcccaccttgaggacatcactttaacttgattatttctgtaaagaccctttaaataaggtcatattctgaagaacaatgggttagaacttcaaattatgaatttggtcaggagaggggacacaatccataacagggttcatatgaggcttacatattgttttaggttgtgtgtttttctaatcctctcttataacaatctgcctatatttctgagttttttaagttttgggtttttctacacatttgctactgattagaaaaagatatatgaaatttcagagaaattatggaatttctggaagatgaagttattaccagaagccaatataggccaggcacagtggctcacgcctgtaaccccagtactttgggaggcgaaggcaggagaattgcttgagtccaggagtttgagaccagcctgcgcagcatagtgagatcccatctctacgaaaaattaaaaattagctgggcatggtggcttgtacctgtagtcccagctacttggaaggttgaagtgagaggattgcttgagcctaggacatcaaggctgcagtgagccatgatcattccgctgtactcagcctgggtgaaagagggagaccctgtctcaaaaaaaaaaaaaaaaaaaaaaaaagctaaattgagctatctacattttattgctaggaaacctaccagtttttttaaacactaatataaaaccttaagacttagatttttgtttgttttaaacagtaaatatataccattctcctaggaaagaat

SEQ ID NO: 38833 - DNA, 1026 bp, Homo sapiens
tcgcgaggctgagacaggagaatggcatgaacccacgaggcggagcttgcagtgagccaaggttgcaccactgcactccagcctgggcgacagagcgagactccatctcaaaaaacaaaaaaaacaaacagtgaattgcctcagtatttaattttttgttatatgtaatatttaatatggacatgtcaaataactaaactttaatatacttttatcttctataaatgtgtttaatatatttttctcttctacagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaa

SEQ ID NO: 38834 - DNA, 1048 bp, Homo sapiens
gaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacac

SEQ ID NO: 38835 - DNA, 1051 bp, Homo sapiens
cagcttgagcaacatggcgaaattctgtctctacaaaaaaatacaaaaattagggccgggcgcagtggctcacgcctgtaatcccagcactttgggaggctgaagcgggcggatcatgaggtcaggagattgagaccatcctggctaacatggtgaaacccaatctctaccaaaaatacaaaacttagccagacgtggtggcatgcacctgcagttccagctagttgggaggctgaggcaggagaatggcatgaacccggggggcagagcttgcagtgagccgagatggcgccactgcattctagcctgggcaacagagcgagactgtcttaaaaaaaaaaaagaaaaaaaatacaaaaattagccaggcgtggtggtgcaggcctgtggtcccagctacttgggaggctgaggcaggaggatcacttgagcctgggaggcgaaggttgtactccagcctgggtgacagagcaaaactctgtctcaaaaaaaaaaaaaaaaacctaaagttacctagccaggcatggtggcaggcacctgtagtcccagctactcagaaggctgaggcaggagaatggccgtgaacctgggaggcggagcttgcagtgagctgagatcacgccactgccctccagcctgggtgacagtgcgagactccctctggaaaaaaagaaaagaaaacctaaagatatctaatctgtcatgtcttcatagctttatcatcctaaaataaggaaaatgaggacttcaaaagtggccaaaggtagttgaagatacattctagagtacagacctgctgtactgttgtacaatctagaacagtggctcttaaccagaggtgtgcagtaataccatggatatagcttttcacttcgaaaagctctattgtgaagttaaaaaaagaaaagtgaagtgaaaaaaagttaaaaagtgaagggaaaaagtgtgttttaacttcactgtttaaattaaaaacttacttcatttggaaggaactgctgtaagcacatcttagaaggaatgacaagtgatgaaacacagcaaaaaatcg

SEQ ID NO: 38836 - DNA, 1023 bp, Homo sapiens
aagcagagagacagaggcatttctctgggacactggagaggatataaccattaaagttaacagtgaatgaactcattccattacttttaataacattatatctgtgtttgtgtgctcaatgtaatgataacttagcgaaggagaattaattccacatattatctacataaaggataatgagggaaatcagtttcctctaaggaagtttcattaaatttgggtataagccaatctactttagattggtccctggctcttggatgactttcaagccttgaggctcctagagaacgaacaaggccatgtttgaatgtcagggaaacagacgcagaaggtttcagaggacctttgtcactgaaattccctttccttctggaaaagcaaactgctagtttgttgaccatcaggtacaaaatatattttttttctataaaccaacattgtatctgctgagatagttttaattcatgtgatttgtgactaaactatttgatttgtgggtctgatggctccttgaggtatttcaagtaataaaaacaacaaacaagctaatagtgaattagtaaatattcagtatcattttgtatttttatgttgtttttttttaacacaggaaatattttcttttttttaacacaggaaggttaaagcaatgtcttccaagttaaatgcctgttttgaaaatcagtccttgttaaattagtgttactaagtattgacatatataatgctagtgatccttgcagtgaaatttagaacatacaattttcttgtgggtttagaatgtaattaattttgcaagtttttaactgagcaaacagtttgatgtctcaaagacaacaaggcaaattcactaaaatatgcttattttaaattgaaaacaaaattttatcagaggtaaactgcacttaaattgctttatccgaaaaatgttagtgatccttaaaatatttctatgtacatgtagcagtcttatgtactaatacattagcgactcaaactagatggggaagagcaattcta

SEQ ID NO: 38837 - DNA, 1059 bp, Homo sapiens
ataggatgtaacattagagaggcaatagccaatttctcatttatgtcacagatctaaccatcgtgattcctctgatcccaggctttgccttcctccctgctaccgcacatggatttgtacaaactcgctttactgaatccgttttctctctcctggaatattgcttttgtgaaaacaatgtcagtcttgccattcagtccgttgataatttgtcatcgcttggccagatcttgtggggattcatgatttgtcaaacaaatgtagttattcagaaaacatgtttgctttcatggtgttttatttgctgtatgttttctgttaagtatatttcaaataattgataacatgtttgggaaatgatacataacattgtataaacatctgtgtcttagttgtgaatgtccagatatttgttctacaggagtaacttttactgataacttaacatcatatgctttgaaattgttaagtgcatagatatacagaaaaatgcaaataatgttaacaccttaatgttaaaatatatcatttttgtaggatatactggcttctgaagctcatgtctctcactgtttcttttattctgctgtagaaatttagcactacttgtatgattaagtgttgtgatgatgaaagctaataaagggcattttgtttgattcttactggcagattcccctgcacattggcggagaggatgaggcatctttaggcagcacgtgctctggtcttaacgtgtttgagttagtagtatttctttaattgtccaatttgttttatgttaccaggtggttttgattaatgatccaaaagaggtgaatttgtgtacagaagagagaaagaattataactgagatggttgcatttaggtcagtagaaatacataatcttgttactgatgcaacatttattctttccatattgagggggatgaagtagctaattaaaattccaacacttcctttctccttttcgatctttctaaatacttgtaaaagtctacagaaccatgaaggaaatgattttatttccagacactatggagattcatcaaaaaca

SEQ ID NO: 38838 - DNA, 1049 bp, Homo sapiens
cacgtttaagatttgttgttaaatggacatgtatgtgcagataaggaatgaaacatggagctgtacaaaccaagatctgtctttcacatgtcaacacaaatcatgcttatatcaccttctgtttgaggctttatgactttcaatatttacttttgttcgtgctattatgaagaaatgtttatctctttctatgttttccattttgtccactgccctttcatgtgatatcactgataggcatggccggtttcactctactggaacaagcagattggagagagcctggggcaggagcctgtgctgagtcagagacaggcatggagaggatgtgggtacaagtgggaggtgggaacaagccaattcctggcaagcagagcaaagtctttgttggtactgcaatagaaagaagtcagttatccaatatctaaatagggctgcatctctcattggctgtgtaaccttgggcagtgtacctaaccacatcaagttagggtaagtagtttggattgtatgcgaagcatattgaaaagtcaagggaggttttaaacagaagggtaacatgacctggattatgatcagaaagttcactcaggcttccagatggggagcagattgaaggaagagaagggcaaaggcagggagaacaattagaaggctagtgcagtggtccagtagagagatcatgtggctggggcctccgtgggtggatgggtgtcggtgttgaaatcatttagagggtgacaagagtacagattcaggattttcttttggaggtggagacaaagagactttctcattgattagagcaagaacagacacaaaaaattaacaacaaactaacaacttcttaaaatcacaggatgagcttaggtaatccatgctgttggagaactgtctttccattcactttctctttctctacctccttttccatcagtgtccccatgcagttcttagtggctgaggagctctccaggaggacattgtgatcagtttatttcttaagtcacttcctataatcacttcttatatcttacagtctccttggg

SEQ ID NO: 38839 - DNA, 1079 bp, Homo sapiens
tgagcatgtatccttttaatcttttcattgaacatgcaagaagcatatttagagcactttaatcttatttgaattaattgttgtgttggttcaattaatatgtttgaatttccttattcaggggcaaaattgtgataaagtatttaaatttctatttgcagcccttactgtgtggcatgcaaaaagcagcttatcttgtttcaatttgcaggccacagaatctattttccttttaatataggtacaagaaagactaagtaccttgccttactgctataagagagaacattctgggaccacaaacacattgaaagaagatgttgaattaactggggatgttctgctttattttaaatatttttactgcttggtaagatagtaagatatatcatattactctttgaattatttgctattgtgaagattcggcaagtcaatgaagaaatgccttttgaatttttttctttattattataaagtacctgctggaaggctcagggatatctaggttaatgtgtttctatttcagtaccgaaaaaacaaacgtgagctcttggaagggtcgtgttcacatcccggttgacaataatttcataggagcgagcacctgctgaaaagctgtgggttctgtggtagagcaaggggagtggggggagagaggctttaaacaaaaactttaactgtaaaagaaacaagtttttcctctgggaaattactcagagtgcaatacaagcatatttttctaattaaatagattagtttatgcctttggcacttaaaagaaagtccttagatccacagcctcctgagttacaagtatttcccgggttaattctctcgaaattaaatctggccctgcttcttgccattctgttacattttttttttctattcctttttctcttttcacctatggttcatttccttctttctctctatgatctgtccacctttctctttcctatcctcaactcttctgtctgttgaaatgagaccagctccaacattgaaatgagaccagctccaacattcctctccatcttcgtaccttgagtcagaatgaatcactgcatagcccg

SEQ ID NO: 38840 - DNA, 1018 bp, Homo sapiens
tggcttgggcctcttccaagttgttctttccttttcttttcttttcttttcttttcttttcttttcttttcttttcttttcttttctcttttcttttctcttttcttttcttttccttttcttttcttttcttttcttttttcttttctttcctttcctttccttccctttccttcccttctttactgttctaaagctttttaataaactttcatacctgatctgaaacttccctcggcctctttttctgctttatgaccctcagtcgaattctctcttcagaggaggtgaagagctgaagttgtgtggacctgtacagatacagtgctcgcaactcgagggaacttggatctctgccaccctaacaatgataggtaggtgtccagtttcattttctgcatatgattagccagctatcccagcagcatttattgaataggaagtactttcttattgctcatttttgtcacccttgatgaagattggttggttgtaggtgtgcggctttatgtctggcttctctattctgttatcttgatctatgtgtctgtttttgaaccagtaccatgctgttttggttactgtcatgctccattcttcagtgccattgaataattatgcagagtgttccttttcaagaaatattctatctcattgctacctgtcaaaatcctacctcattcttccaagcacatcccaaatttggatattggcttttctgtttttctctctcctccaaaaactcattgcattttgactttattaaagagcttttagatcacacagacctatactggaccttagagataactattatacaactatcatagtcgaattaacatacagaaaacaacattctattttgccactcatctgaccaattatggataattctatcagaatgagatttttgcaaggctgtacctgaatcctttttcacctcttgaagactggataagtgcatctgcagaaacctctgtcgtaatactcatcagatgacattgaacctccttgctgg

SEQ ID NO: 38841 - DNA, 1049 bp, Homo sapiens
tcacccacctcccaccctttctcctgagtccccaaagtccgttgtatcattcttatgcctttgcatcctcataacttagctcccacttatgagtgagaacatagaatatttggttttccattcctgagttactttactaagaataatagtctccagtcccatccaggttgctgcaaatggcattaatttgttccttttcatggctgagtagtattctatcatatatatgtatgaaatgtatatcatatatattcatatatctcatttattccatcatatatctgtatggatatatatataagtttctttatccactcattgattgatgggcatttgggctggttccatatttttgcaattgcaaattctgcttttataaacatgcatgtgcaaaaatcttctttgtataatggcttgttatcctctgggtagatacccattagtgggactgctgaatcaaatgttagttctacttttagttctttaaggaatctccacactgttttccatagtggttgtactagtttacatttccaccagccgtgtagaagtgtttgcttttcaccgtatccacaccaacatctactttttaaaattttttgattatggccattcttgcaggagtgaggtggtatccattgtggttttgattcgtatttccctgataattagtttgttggccatttgtatatcttcttttgagaattatctattcatgtccttagcctagtttttgatgggattatttgtatttttcttgctaagttttatgtgttccttgtagattctagatatgttagtcctttatcggatgtatagattgtgaagattttctcccactctgtgggttgtctgtttactctgtcgtctgtttcttttgctgtgcagaagctcttttgtttaattaaatcctatctatttatctttgtttttgttgcatttgcttttgggtacttggtcatgaagtctttgcctaagccaatatccagaagggtttttctgatgttatcttgtagaatttttatgttttcaggtcctagatgtaagtc

SEQ ID NO: 38842 - DNA, 1034 bp, Homo sapiens
atcattcagttcaaagaatttttttaaatttccatcttgatttcattgttgacccaatgatcattcaggagcaggttatataatttccatgtatttgcatggttttgaaggttctttttggagttgatttccaatttcgcttcactgtggtctgagagagtacttgatataatttccattttcttaaatgtattgagacttgttttgtggcctatcatatgttctatcttttagagagttcaatgcactgatgaatagaatgtgtattctgcagttgctgggtagagtgttccgacaacatctgttaagtcaatttgttctagggtgtagtttaaatccattgtttctttgttgactttctgtcttgatgacctgtctagtgctgtcagtggagtattgaagtccctcactattattgtattgctgtctaactcatttcttaggtctagtagtaattgttttataaatttgggagctccagtgttaggtccatatatatttcgaattctgatattttcctgttagacaaggccttttatcattatataatatccctctttgtcttttttaactgctgttgctttttttttttattatactttaagttttagggtacatgtgcacattgtgcaggttagttacatatgtatacatgtgccatgctggtgtgctgcacccactaactcatcatctagcattaggtatatctcccaatgctatccctcccccctcccccaaccccacaacagtccccagagtgtgatattccccttcctgtgtccatgtgatctcattgttcaattcccacctataagtgagaatatgcggtgtttggttttttgttcttgcgatagtttactgagaatgatgatttccagtttcatccatgtccctacaaaggacgtgaactcatcattttttatggctgcatagtattccgtggtgtatatgtgccacgttttcttaatccaatctatcattgttggacatttgggttggttccaagtctttgctattgtgaataatgccacaat

SEQ ID NO: 38843 - DNA, 1048 bp, Homo sapiens
gagtttctaggaacaaagagatggggttatggatgaccgctgttgacactggattatgaacgtacatcttgcaggctgctccctataaaataaaggatgaaggggcctctctgagctgtgcaaatagttgggtggaggggacaaacctgtcaaccagaaggtgcagatcaaagagaactgattactggggatggaccaccaagagaccaaggtgggagtaggggacatgagagttttaaaaggtgtgaaatgaaaatgggcaagacagtctggggatcttggggaatttcattaatttgtgatcagtgctcagtgtttgtgcaagtgatgcaacgggataatggagactaatacataaatgcactttcttaaggaaaaacataaggtggattgagacggaaagcacagactcttagaacctatgctctgaattgggggctcaggggtgtgaaataatatgtctagaaattaggacagttactgcaagatggacccttggatcttcagaacttgagagaacagctctctcttcttatatgaaaggagagaaacagaagatgaaatgatatgtaagaagtatttgaggctggatgtgaagcgttgacattctttcatccaatacatatttattgagctcctactttaagtgcaaattgctgttccagtgcttgagatatatcagtgaataaaaagacaaagaatcctgcccatctcaacttgtattcagcatgggtagcctaaagaatagttaaattacttagtatgtagaaggtgatgaacagtgttgaaagcaggcaagtggggcagggtgagggaatggcagtgccaggtgggtggttgggtcactgtattaaatggagtggtgagtaggcttcatggacaaagcatggtctgagcaaggacttgcaagaggtgagggaggttaggatccattccaggctgaaggaacagccatgctaaggctttaaaggcaagagtctcttcacagaactgcagctttaagtgtggctgttctcaaataagctaaaggaagaaaagtaggagacaa

SEQ ID NO: 38844 - DNA, 1051 bp, Homo sapiens
gtgctgggctccacggctactatgctctgcactggagcaggcatggggagaggagagaggccagggagcaggagcaggcatttctgagcctatggggacagggggcttcccaggcccctgaaagtgtagggatgcccagatctggagccgaggctgggtggctgaacctgcgcctgggagcctggggttcctgccctgccaacttggtaggaggcaaggctcccacctgttcctggcccccaccagcactggggtgcacacagccctggccacgcctctcccgctgcagctggcatccccgcagtggctgctccagactggccgctgccaccatcaatatcaatactacaaactgagtaaaatggaaatttaagtaaaaatagaaagacatcatattaaatagaagacaacaacaaaggtaaagatttgtcctgatgggtagacattattttgaaagattctaaagcgggaataggaagggtgcataccagacagaaagtatagtttaaacaatgaacaagttgggtggataagtgaatagatgatagttagctaaataaagagttaaagatactctgattaatgtaaataattttataattttaataatcaccaggtcattcataaaaagatttataagatattcttacgcagctagctcagagtcatagagttacaatttaaaactatttctgaaagacaaatgactattttaaaattttggatttcaatttttctttaacacttttttttgtatcaagtattattctcctaaataaaaaatatggaaataaaatataattcaatgttattctctctttgacgtctttttaaatgacagtattttccctttcttccttcctccctccctccctccttccctctttcccttccttccttcttttcttaccttttattaagcacctaataggtttcaggaactacataaatgtaggagaagaagcaaaggaaacttgcaatgatctttggctttttccaagcttagtagagaaaataaaagccacaaaaaacccaatagtttcctttatca

SEQ ID NO: 38845 - DNA, 1031 bp, Homo sapiens
tgcatcctaactgctgaattgttcaatgggcttttgcaaagttaagtaccattctgaaagataggatctgtacagttttcttaaactgccatgagtgagctatgagcctaaggtatagtcctcatcccatggaagaggtgaacaagggcctcatttttagtagcataaattccaagaatctgccaaggccgtaggaaacagttaaaagagaaagacaggaagtggcaaggaaattgatactaatcagaaatttccgaggcctctcatatggaatacgctgaccctcaaagtttctttttggcaagaagagaccatagagtttctatacctgaatacttaacctaagtatgggtgggttgaagtagagttgaagagatgtggactctttgtgagacctgtagccaaatacagttttcaaacttgatttgtcagtggcaggtgtggccacacaaataaaatctgcttttaagtttaattatatcagtacaatctcaagtaccatgtttacatattcaagactgatagttgatggatttttcctatattaaccatttaagtaagataattatttgccattctgtgacatttaattacaatgctatgactaatttatatagttggaagaaaaaattgctttatatgtcatttaagatttgtatgaacacatttaaactgcagaaaagattgcttagaaaaatgcagagctggctcccaagagctcttgattaccttctgtatcaagaccatttttttaaaattggctgtactatcacagcataatttcaaggtgaccacctgtcaaagagcttctgcgggaaaaaggcaaaatgtctccctgtcttatttgtacatttatttttataaacatttctaattttccagagggtattataggctaaaatttaatgggatggtaatagttagcaatgagtaaataacatgaattctcagttgatgtaaatttcatgccaggtttgaatgatgaaggtaaaagctagcatggagactagaaacacatttaatagcagatg

SEQ ID NO: 38846 - DNA, 1047 bp, Homo sapiens
tctctttgaagtatctaatgtcaacatccttttacctatccttttcctacttttcttactcaaattcttgttagtacattgtgactattagtatgtcttttaaaatatgagatttaaaatgagttagcactttctctctcttttttattcctaaattatactttccccaaatcagccagtgtcagtttcctatccacagctcgaacttcactcttgtatttaaatacatgttctcctgttcaggtccacgaataattgctgattgtctatgttattgtcagcttgtttctctttctcatcctccttttcttcttaagtccaaattttatcctcttcatttccacagaatagctcaggctttatgatcattccttcctataatatcacaattgtccctaaatggtctccacatcagctgctcctcttacttccatcactttattgctctgcaccctgcccaccatcattactcaaatgatgaattcatatgcttgtgcactgcagtcaaacccaaaacagggcccttgtctacgtaaagactctcaaggcgtgagctgtattttaaagttccaattgtaattatctgattatgattaaagtgaggaaagataagcaggctttggtctgtttttaagtcaacttattttgcgtgtgatattcctcttcctcctcttccttttcttcctcttcctcctctttccctcctcctcctcttttcctccttccatggctcctcatccttcctcttcctatttatttctcttcttccttcaaaaagagattcactaatgatttcatgttgatggtgctggaggaaaggtaaatgaggaagtatgaagagacttagccccagtcacgggattgggctatcatatgctcataataacaaagtaaccaaatagccatgggtaccagcagcaatctgcccagaatccaggaggagtctttagcaccatatctattaaaagctttctagacccatgaatgctatacttatatcctggtaattttctactttggaattaagtttgggatcaggagttgggt

SEQ ID NO: 38847 - DNA, 1047 bp, Homo sapiens
acaattttaatttccttgagcattttaaatagagaacatatttatatgttatcattttccaaatacaaatagatagtttatattttgttttcaaccttttatttgggagatgtctctttttgctgtttgttgctcttcctgattcactatgttgactcgttttattgtatagtttacaactttggtatgtactttctgtggcaacactgaaagccttgagatgaaagtatattcagagagaatacatatttgcttttggctggtgtctatggtaaacagtccaggccaactctaataaaatgtgttgacctcgagtttctttgatattatctatggtttatagttaaacccgaaaccacaggttggtaaaatggtgattacgaagaattctttatcccaacccacactctgacccccaacacgggtaaattttcttaattccctgggcttgtaattagactatttttcaagactcactctttcacgcatagcataggcttttgaaagtcttagtttcatatgaagtgtttctcaattccaactcccaactttcttcttggcctcatgactccatcaatcctaaacatcaacataatgctgctactttggttccatctttcttcatttttggattctagggatttttcttattgtgtttaatctcagatatatacctacaagaattatgagttttttggtctcctttattttaaagtgtttttttttttttatataggagattttctaagacatctaatccaccacattggtagaaacaaaaaaaggatatatatttttaaatctactaaatatttcacagtctcccatttacattttcagttttgccttaatgacatatgactctacataatcattaaaaaaatcccaactgacctcatggtttgaattgttgtgttttgcatgtgataacttttatgtctcaaattagaaacctgattctttctgcctgcatttttttaggttggtatctatagggcagtttctcaaaggtagtgtcatgactcttaaaaattcactttgattaaa

SEQ ID NO: 38848 - DNA, 1010 bp, Homo sapiens
tgcacctccccctattcttgccagtccctccctgtctggttgaactgatttctaggagatttaaaaggctaacatattttttttctcctttatttttctctttttcctttttcaacagctagacactgaatattaggaaaatcaaaggtgacggcatatacagggagattagaaaactactgcacatgcctggggagggggcaggctcacaaaagacttgagaagacctgtttacatctcgagctagtgcttggcacagagaaagcctatgataatcaaataaacaggaacaaaaaaacaaaaccaaaaacaaaaatccaagaaacaaaaaacagcaaaccctaggaagggggaaaatctgatctccacagttaacagattattggattcaaatgttcagttttcaataaaaaaattacaaaataaaacaagaaacagcaaagtatgaaccgtttaaagagaaaaacaaataataatccaacagaaactgaccctgaaaaaacctgatgacagatctactagacaaagactttaaaacaattgtcttaaatatgctaaaagaacaaaagaaatatgtggaaaaagtcaagaatatatcaacaaaatagcaatatcaataaagaaatagaaaacctaaaaatactaaagagaaattttagaactgaaaacttcagatttgagcagggagaagaattagtgaacttaaaaacaagataatgaaaattatcgagacttagcaagagaaagaaaggaaattgcggaaaactaaccagtcagggggacttgtagaacaccattaagtgagccaatatatgcatacggtactcccacaagaagaacagagaggaaaagatgagaagaaactattttaaaaaatattgcccccaaacttcccaaattttataaaagacatgaataaaaacagccaacaagcttaacaaacaataagtaggataagctcaaagagtgccaccaagacacattatcaacaatctgttgaaagccaaaga

SEQ ID NO: 38849 - DNA, 1173 bp, Homo sapiens
ttattggatttgtttaaagaaaggttcctgacacgattttccaaatgcagcctggtgagcagtccctgccatcaggtgatgtatctgacttaatggtattctttcagagctggagcaataaacattaagggaccttaattgtattctttgcagtgggagcaataaacattaggggccctattgtaccctgttccaaaatgtcccccaagcccaatttgggaagtgtcttgagatatagctctaatttcaaatcctctctcccattccatgtattttgaaattgggagactgaacaaaaacaatgaaacgaaattaataggcatactgccacatagcagcccctcatattatttacctgacgcatcagggccctaatagtgggggggaaaaaagatgctgagtgatctgacttatttttctatggtgacaacttttgataaactgcagctactagccacagagtcacaggggtaaaattgttcacctggtacatagagaagatccatggcacaaaggattaagttgccttgaagactgagaagactgtgggattttaagttgaatcaaacatgaggtgataattcatgatcatctctgactctatttcatctacatatttctgtttttgcttttttttttttggtgaaactgtatgctaaaataacaaatttcccatgaaattacaggagtcccattttaccatttgtaacatcagatgttcaacatgctatcaaggaagaaagacagttttaaaattattttcttaagatctccactggtcacattcatttcagcgagtcgttagactgtattgattttgcctgaattaatggtacacttgttttactcattttgttattctaattttgctctcctctctttttcacaattctgtgagtctcaggtattggcctgtgaactggtgttatgatagtatatcatttaaaatgataaccccatcatttcttccatagcatattttgtcataattcccaatacatgagatatttagctaaggtaaagtgcacatggaaaatttagagaggaattgtcatcagggtgaaatgctgtgtactacgcagaaggcttctggtttggggttctgaacaatcaaaattaaatagacataaatgcaattaatgatattacgtgaaaagtttgatactatgtccg

SEQ ID NO: 38850 - DNA, 1088 bp, Homo sapiens
tcaatacctacatttctcaagaaattgagacaggaattagatttaagtaggaaaaagagactcttttatagcaataagtggtaagaataaaagatagatgacattgtgcaggttgcatttttagtgttgggaagataaaagtttaatgtgatggttttctttttgaagtagcagatgaactgaatgtgagtggtagaagggcagaggaaactctgggattagaggagaaggttcaaaatgcaataggacaagcaggtgattttaaggactcatttaagttttgtgaatcaggggccactctgcaatggatcttcttccagtagcactcaaagctcaggagcagacaggatgagtgggaagcagttctccccagtagagtttgccaggtggaagcaacaagaagatagaggaacaaggatttagggtgttagccagaggaattttgaagtaacacaccatgaaatataaacaggataattagaaagtgaagaaaaagggactgatggattgggataaaagtagaaaggaccatcaacttaatcttagtaaggtcaaataaggatcattgtgagaggaattgaacacagcatctgaaagaagaggaggttgtaggtggagcctggggaaactcttgtcttggagaggtctgtagatccaaatctaaattggatacagctcataatgttaggctctcataaggtcttacatttttccttccttgatttttcagtacttgcaattctgtgtatatatgtataattttaaaaatttgccttttttttactagattataacctctgtgaaggtaaagacaacattttaaaaaaattatttatttttaccattgactctttagcaattagcatagtaccaagcatgtagtaagtgtttaacaaatattgtcaagaaaaattgaataaatttttaattaccaaatgatgttgtgtcttttggttaaataatgtgaacattttttaaggcatttaaaataattcaggcctaggatggtggctcaggcctgtaattccagcattttgggaggccaaggtgggcagatcgcttgggtccagaagttcaagaccagcctg

SEQ ID NO: 38851 - DNA, 1065 bp, Homo sapiens
tctagttttattagatgtttcaatcagatctttccttctggaatctgaaacttcacagaatgttacgagtcactgcatctgaatcactctgatagcaaaaacctagagaaaggttcccaaatttctgtatttgaatcgtgagaccttgtcagttcagaactccttttgattctggatactacgcatacgttcttcctttaaattctcctacttcttttttctcttgagtgaggtttgagccttatggtttatgctttatatagaaccacaaaaaggaagactgagcaggaaaatatcagagaagtaagaggggaaaggtataaatgttatatcatgaaagcaagttgagagaaaatttttagtagaaaagaaatggtcaacaatggaaatattgtcaaggagaatgtgaaaaaccagggaaggtgtgctgagtttggcaattagatcattgttgaaccgtgaaaatgaaggttcaaggaacaaaggtatactgtaccaatttaaagagcaaattgaataaagaggaaataaagacatttaagatatctgatgtaaaataaataccattttagttcaatgtgttaacaagtcaaggtatagctattctactcactaagttgcagataaatggccaagcttaagaaaattgaagtggaaaaatgttatgagatattcaataaataaagactttaatagctcaaagatcatggaatttataactcaacaataaacctttgctggaaaagaataagtgaataagaagtaagggatgatggaacttatcagttattttgagttgatgaaggaggtagaaatggaagctactatcatgagtctgttagtaccttcattagaactcagatcttgctgcataatttgggtggccaaatgcaaaacaaaaaatgaggggcccaagattcaaaaattaaaacagttataaatatatcatatcatgttcagggaaacattatttagaacataaggctaaaaactgaagaatgattaaacaccttatattcacaaatttatgttttgtttgtttatgataatcgtttcatcttaatc

SEQ ID NO: 38852 - DNA, 1031 bp, Homo sapiens
atactctcttgaaagcatagacctaatttataatttcctcaccgaagaaaccactgtttccttttgcctagagagtacatttcaaactctagcacttcttaaattttctgttgaaattggcctcaatctattttaattttgcacttacaggcatcccattctatctttctttccactagaagaaaacaaatgatttttattttctgaaaaattcaggcacttacacttcttgtttattaagtaatcaacttttgtatttttagtgaagaaatggttgtatgtgggaaacaatataacatttccctggtggtacatggtctgagactaccatctcaatgattagctaaggctctttttttgaggtttgcaacagatatgcctatataaaaatctttgtgacaataaatgatattatagcaaaattcaagtctttatgtgtgcctataacagatatattctactgatttaattaaaatacactgaaattgaatttaaaaaccttgtatctttccttcgcttgatgaattccacagaataagtaccagaacaaaattactaggatcttcatgtcaaattttcatgaaaataaaataaatgtattaattttttaaatgtgtaaatatatattaagtgtctctgaagaaattctgtatctataattaagcataaagaagtaaatgcaagtttctaaataaccaatagctttgtttattaaacctctactaatttgtgatcattttttcagaaactatttcattatatttatgaataaagagtttagcatataaatgattaaataaatctatctagttacttaccagtaagtcttatacaattcttgaaaatacattgcagtttaatttaagttatacaatttgagctaagttcaaagttattaaacgtttacacttgtctctatgaaaagaaaataactttaaaaactagttttagttaactttattatctattgtaaatgtctactgtctaattataatgttaaaggatttctcatttcttcttgttagttacca

SEQ ID NO: 38853 - DNA, 1050 bp, Homo sapiens
tttgaagcttctacagaataattaactttgctctaatctgtggtcacagctcatatcccaaaccctgacaaattgtctttgttcctaagaggagaccagatgaaagaagaggactgtgagaacaacaacccaaaagcacactcaatggacagagatcactaatgccatgtttatttataaaagatgcaatttagacacaaaacttttattatgtattttaaaataaaaatacgaaaattgatataaactatgttgtcacattggatacttctaaattagtgaactgaaaaaataaactgaaagataaaaaattagaataatctaaaaatattatttaccataatcatatatgattagaacaatgacagttaaataatataattgatagttacacaaaataaaccacaggttatatatttgctttttttcagaaggttagtataatgtttgatattgaaagttaaaggattttacctcaattttgttgtagttcacttatttttgctttatttatattcataaagttattagtgttgcttaaagagactggaaaatctagtattcattccagagtaaactgggattatttaaagattattttcatgcttgaaagtcagataaaatgagttttaaaactatatttccatttagaaataagtatttgtgtgtgtgtgtatgtaagtctttgccctcaaagaattcttttttgctctctagtagtattttggtacttttctctgataaatcttcaattttagaatattttgtacattgttcttcattctaaccaattattttgtaattttaaaacaatcaggcatttttctatttaatctggttgctttaaaaataaagtggaaaggctaatgtgtggcacatttttgtattttcttttttgtaaccaacttgtttatgcatatcatgtttgtcgtgcaatttacctataaaactattctctgggtttcataataaaatatttatatactgaatatattcttcttccacataatcttacctctttatcctggcatctcttagattgtgtatcta

SEQ ID NO: 38854 - DNA, 1030 bp, Homo sapiens
tccctgattctctgtttttttcatatacgtaatttctgcactcctggttgagatattctactttttgatggtgatttcattctcaaaacttttacgtgcataattgaattaacatgcttaaagttaaggaaagcctttaaaactgactgcttccaaggcagtgaaagcatcagcttaactctctggctttcaactttctctttacttttggccttggggaaatccccttgatttctcaggaccaaagctgtatatttaaaatgatatttgttatatattacccagaatgtcttagtgttttgaagtaggatgatattaatgatatcttatcttccatattattagaattaaaaatcttggtctcctgcttctcattctaggtttatttttttctttacttgtattctgtgcgttgtcctaactccaaattgttcctaaatttaaattttaacatgtagacatgccagtgagaaattgtggaaggggaaggaggaggtgctagctgaacttttgaatctgaagattaatgtctacctctgttgctttttgtaatgggctcaatttccttacactgtgctttgcagctatgtgagacatctgtgggatgtccagctccatttctgttcggaccatgtgggacctctgtatcctcagttcttcctggtcttggaccccaatcttatcagacacttatatgcctccttctgagatagtaatgctctaccttacttggtgaggtagggtgaaatcccttttcaaggaaataatattttcttcttcaactctgaactgaaactcaggattctattttggcagtaccatgacatttttttgtataatgtcacatacgcccctatttcccatcctccattctgtctcagtttccttatctgtaaaatattctgttttttcatagtacctaaaagtgaatttaaccagtgacacaatcataaattatttgggttatactaacaccacattgagctttttaaagaaatgttataaatcccatgttagtttttgttaaatt

SEQ ID NO: 38855 - DNA, 1033 bp, Homo sapiens
ttattttgttcctttcattttctgcataaaataattttttcgtaggtcccatgttgagaaaactttttgttgtcattcttattttcattggtgatattcttcttataagctgggctagtaatcttacaagattgtaagtgatcgcttataaaatgttggattgtctccagacacttttctcaccagcatttctctctaggatatgccttcctctggctagccagtttccctaaagcctcatatgttataggttattttttctatgtttcgttctagttgccattcttattttcagagtggataggggacataaggattatttttccattaactttgattttgttgtcctagatgggacttacttatttgtacatggcggctagcacaaaacttaggtcttaaaatttagttctccagcagtttcttaccttcaatttcttaatttccatatgcttctcttttggtaccattattatttatttctctgccttaaagagtctgtttatttatctagaaatttgtgcaatctttctaatgactgtccatttctttgtatacgtaatgaggctttgaattaattcatcttaaatattccgtctccagttagtgattttcatgtaatttatgcttctaacacataatttatcagttcaaaaataagtaggcaggcactacagagaggaacagtaattattttactatgttagaatcttctgttaaaaggtattgatctacacaaaaacagcatataaatgtttatagcagttttactcataatgggcaaaaattggaagcaaccaagatgtccttcattaggtgaatgtataaaataaatacaatggcatattatgcagcagtaaaaagaaatgagctatcaagttatgaaaaggtatgaaggaacctaaaaattcaagttgctaaatgaatgaagccagttctaaaaagctacatactttgtaattccaactatatgaccttctggaaaaggcaaaattataggcagcaaaaagcttagttattggcaggggtgagg

SEQ ID NO: 38856 - DNA, 1106 bp, Homo sapiens
ctgtttcttaatgcattgattaaagtttaatagttatcaaaatcacctaatttttaaaaatagctttcgttttgagttctggaaagaaaactgtcaaaatcagtatatactattagttatatttaaaaatatttttttaaattctttacagataatattatacttgttacccttcacaataccacatgagaaaatatctgagacaaaatgtatacaaatatattccttatggcataatttattgcatttctgactgaaatcaaaattctgatttgatggcaattgaattttcattttacaatagataaatgcttgtgctacctaaagcacttagcacacagttaaattatatttacatcctagacccaaataaataggattgtgtgtatatttgggatatctattgaagaaaaaaagaaaaccccttaaagataatgtacatgcttcatgtcatgtctttaaaataatttaatcaactttattgtcttagtatttagactctggataactctacaataatgaggaaattcttaagaataacaaaatcactgtaccttcctctcaattttgctgtgaacctgaaatggctttaaattaatactcttattttttatttaatttaattacataaattaaaccttaccatgaccaaattgtgttaggacggcctgctatctacagcacagtgtgtcatttgcagatttgtggttacctataccacgctaggtgttttgacatgtttagtgtttctgctttacagtgctgaattccatattttagaagctatgaaagtccttttatgaaaaagttactgattgcttctcagttattaggaaaacagttgtttcacaattattatgtagatatgatgcccaaatatcatttttagtatatcttgtcgatctttaagttgttactattgtgttattcatgtctttaaatcagataccaaatattttttaggaaagaaaaatgttattactgtcattaggttgtcttttaatactttaagttattttgacgaaaagtaatagagaaaatttacttagcattttagattctagagacatggaaatgaaaattattttatgtctagagtaggtcct

SEQ ID NO: 38857 - DNA, 1073 bp, Homo sapiens
ataatgactaaacctcctcgtaaatgaactaatagtattagaagaaaaagataccttatctatgaaatactcttagcaggatgttcctggtttaaggttgcttataaaacatcaatccagaatctgtggatttatggaaaatgagaaatataaaagctggctgacaatttagggtgtattaggccattcttgccttgctataaacaccagaggctgggtaattcttaagaaaataggtttaattggctcacggttctgtatgttttacaggaagtatggtgccaacatctgctcagcttctggggaggcctcaggaagcttacaatcatggcagaaggcaaagggggaacaagcgcatcacatggcaaaagcaggaacaagggagagagtatggggggcacactttacaacaatcagatctcatgtgaactcagagtgaaagctcggttattaccaagggaatagctcaagccattcaggggcattcgggggcatgatccagacacctcccaccaggacccacctccaacactggggattacatttcaacatgagatttaggcacagacaaatatcctaactctatcatggggtatgaaatgtaaatatttaataacttatgcttcactgttttgtgagatagatgaaggcaatgaagcattgcagggtcatggatggataaagttactggatctagtgagtacataaagtgggaagcaaaaagttttatctttggagacgtaatttggtgaaggatcctgaagatgccacctataccctgcgcaccaggcagatgcaccaaagtatctcagccaatttcattgagattcagactggcaaggagcttatggtaaagtctttataattgaattaaaaacttaagtaattgtttctgttatttaaactcactggaaaagcttcaaaatgagacaatgatttgaatgaaccagtagtctcttggttacactattagggataatagatatccccatcgatctagaacttataatgtcacaattgctaccaaagttcacaggacagttagtgtaaggaaatccagaactactcacatt

SEQ ID NO: 38858 - DNA, 1172 bp, Homo sapiens
taaaatattttttaagagtagtgacaatgtttattggtaccaattggagatgatattttatatttattttgttagtttgtcacctggatgcaaaaggaaggcattttaattcctttctatcttacaacattgtaaagcatcaaaagaagtaacatctcaagaaagattagaaaggatttggatcacgttaacattctatgcaaatattagtaacatatcaactgtttctaaaaggaaagaaaattagtatttaaggagagtataaagtgcgagcactgtgaagggcagatatctattaccaaaccacatggagagaaatatagtctctctcctaacttcattccattgtattgcaatcagtcaattaaggtgattttttttttctggatgtctcaatctagagattttgtagcattttgcaaatgggtatgcttcactactatccacagtgttctcccctttagtaattcatattgaatatatccatattcatatgcattttataaaacagttaacagaatctaaataagatatagccggctaaatctggaatgtgagtgctaccctaggttattagttcaacaaactaattttgagagagccacttaacctctctggaccttgtttgtaagctttcttctagcactattactcttatctaagatcgaaattgatatatgcatgaaattcctaatggaatttcaatgtccatctcaaagtaattttttaggatattccatacagatttccttctcatttctctgtgtagatatttaaagtatgaaattgattatttaaactaatatgtggaaagaacctaatccagagcttggaatatagaaagtgctcaattaactgacattcctcctgtatttcctccctccccttagttgtctatgacttttgaactcactgctcactgacatcttaattgcctgcagaaaaatcaatcatattttaggcattattttgaaatattttagagttttctgtactattcaaactcttattacaaaaatctaaagatatttattgatgcaaaaaatttagggagtcattggaaatacctgaggcaatcccaggctaacaataaaatagcataattttaagtaagctagattgagttcatttgaacatttagttattttttagctcatagttaacatatgtcc

SEQ ID NO: 38859 - DNA, 1023 bp, Homo sapiens
agaagccagcgaattttctgtaaaatgctatctgttatatgaatatgtaatttactgctttatataaacttactagcaagtgacagtttaattcttcagaactgaaaataactaagcaatacacctctaattttttatttggccaatgcttttcgtattatttcagattgattcaaaatttaagaataagcaatttctttctttctttttttttttttgagatgggagtctccctatgttgcccaggctggtctcaaactcttgaactgaagggatcctcccgcctcatcctcccaaagtgctggaatccaggcatgagccaccatgcctggccggcaatttctttaaaaatatagttctaagtatataatttcaagcttaagaaacaatacaaactaatcattaatagattttgtatttgttttccaggtaattaatgtggacctgattcatattgaaaatagaattggtgacattattaaatcagaaaagcatgttcagttagtgttgggacaactgatagatgagtaagtacaataaagtacaaatttaagagcactttgtttattttctttcttttttttatagtgtttaaatttaggccaattatggccagttagacatttcatttataactcttacagtgttgattttcatgataaggtttatttcacttaaaaagtaagtgtttaagccacatatggtggcatgtacctgtaatcccagctactcagaaggctgaggctggaggattgcttgaccaggaatttgagaccagcctacgtaacatagcaaagatcctgtctcaaattaaaaaaaaaaaaaaaaaaattcagtgttaatgtatggaatacttagaaataatataaacttctatttttttcttaataagaaaacgtaaaacgtaacttttacgttccttcccgtataatcttaactctgaaagcaaatttgttccaaaaatgttaatgaaaatcaaatacaaatttccacttaaaaaaatcccagcatgccagcctgggc

SEQ ID NO: 38860 - DNA, 1030 bp, Homo sapiens
atttcactaattaagtttgctaattaaaaaattagccaaatgtggtggctcgcacctgtagtcccagctactcaggaggctgaggtaggaggattgcttgatcccaggaggtcaaggccacagtgagccataatcatgccattgcactccagcctgggtgacagagtgagaccttgatgcaaaaaaaaaaaagaaaaagaaaaagaaaatgtattgtttgattaatcttacatttagctacactaatgagaaaaaagtatttgttagaatatgagtgatgagtggtgttcatgtacacacacatttcattacttttggggcatacttcatttcaacggaaattaaacataaaatgaggaaacagaaaaaacattcctaattcttttttctattattttcttgttttcactattaggaattatttggatcggttggcagaagaggtcaatgataaattgcaagaaagtggtcaggtcaccatatcagaactgtgtaaaacttatgatcttcctgggaactttctgacacaggtattttttttcctaataatacaatgtgtctttttaccaaaggattttaaacgaagactttgaatggaagggggaaaaaaaaatgagacttcctcaccatcatttgatttattgcaggtgtctgacttgatatatgttgtaccaatatatttggggggtacttctagtacattaatggttctgaggaggcagtttaaaaatgattgtaatcatcctaaaccaagagacaccctaaaactaatttatagactaagttctagggctgctttgatgcaattagcaaatgtacaataaatgcatggatttatttaatgcttttgataccagctatatagaaactgtaaccagacaattaaatttctgattgcccagttaaattttaagaaataattgatgaagataatttatagggggtactactggcttcttgtgagtaaaggtcaaggatgctgctaaacatcctacaatgtacagaacatcctgccaacaaagaatttttt

SEQ ID NO: 38861 - DNA, 1825 bp, Homo sapiens
tggaaaggacataagcttttgagatttttaaaagaccttgatttgaatactgtctgcaccacttatttgacatcaggaaaatcatttcatctcttttatgcttcacattatgtatctgtaaaacaggaaatattgtcttttttataggcttcattgaaatctagtgaaatatcttaacacaatggagaaactaaataatgctagttctttttatatttactgaaacaagggagaagccaaatctctctttaggtatctatcactttaagaaactccaacttgcaaaattggccaaaccgtaattgcatgagattaatgtataatacaagcagatttacttactcatattaagaaaatgagcttccctaattccatttaaaataccatttatagtatagatctgttttatgtagtatttcaggagctgaaattatattttacatgggcaaacatatgttaatcacaggacaaaaaatatatttttaaaatacttctttaaagtatccagctcaaatccaaatgatttcttataaaactgtttctgaatacattttagaaacgtagtttttaatatgtttcagttccattctgaatatagcagtattctaaaagctcattaagtttgaaaaaaacatttttctatatcataaaaataatgagctgagctgacttgagtagatttaacttatcttaaaatgtgaaatatgtccagacttatttcagatgtacctgatgccagtcgtagtatagctgtggagaaatactctgctgaacttgaaagaaggttaccaagaagtcagattatctgccatagatcttctggacggggataaatttgcattagagaggaaagcttttgaggtcttatgtttccctatgttgcagaatctggaataacatttatacttttagtattagaagctccagaaagggtcttctccaatacccatttgtatgtcttggctctctatatattggaggctgcctatatctagaaaccatcatatcaaataatcatcatattgatagtcatttttatgttagaaatagccctcattaacaagagataatatgacagctcaaccttttaacatgtaagcaagcaatttgactcatttcttggctctgccatgagatagtgaactttgctagacactgaatcttcactttagttgatatatcttgtaatctatgcttgttgaaacttctcaatcacatgactgatacctcagcatgcagcatgacttgagtatgactatgcaaatgcatatgtgtaattcttttcttttaaattaataaaaatgtacatctttacccacaggcactaactcagcgacttggtagaattatcagtggacatattgatcttgataatagaggagtaatttttacggaagcttttgtagctcgacataaagcacgtatccgtggactattcagtgctattacccggtaagtatattttaaagtatatatatttgcacatttctttgatcatggtttgcatttttttcctagcagcggaatctttttctttgttttaataaagtctcatttaggaccccagtttattaaacagataaaagggcagcttttgtaaaatagaaattgagattccagagttctagaatgcagcctctctctccagtccgcatctccttcctctccctaccttcaccacccttgtgaccccatacacacttttgcagagtgcagtttaaatactgctgcccagatcagtatataagtgtcacccttgaatcatggaaagaacatgcaatttaaagtcagaagaatttggttcatagctttatcacataatagg

SEQ ID NO: 38862 - DNA, 1034 bp, Homo sapiens
gcacaagggccctcaatccccaggctgccaatcagtaccagtctgtggcctgttaggaaccaggctgtgcagcaggtgagggtgggcaagccagcattactgcctgagctgctcctcctgtcagatcagtggcggcattagattctcataggagcgtgaaccctattgtgaactgcacatgcaagggatgttggttgcacgctctttatgagaacctaatgcctgatgatctgagatggaacagtttcatcctgaaaccatcccccacaacccgggtccgtgcaaaatttgtcttccatgaaaccagttcctggtgctaaaaaggatggggaccgttgaactaggagatacatatacacatgtacatacacccctctatacatctgtatttctgtatctttatgtgtattgaaaactgtgagtttgtgctgatacttccatttctagtccaataccgtaagtttcatttcattctagtttccttcttttccatgtttgtagctttgttcactgactaagaaaaatctaactcctattatccttaatgtatttagttacttgattaattccccttatgtgactggtttcccattgctactgcagctccctttctcatgtgggtgttctctttattccatgtaggctctgacagtctgtgccacatcaccctcctaacacaagaaatgggtggttgtttctggggaaagaaactgggtagctgggtggtaggaatggagagggattcttcagttttgtaacttttttgtaccctgttcatttattactttgtcaaaaactaaaaactaaaaatatctttgttcctatttataaatatttaccttttttctttgactaattattgtggtgatggtaattttcatcaaaatcagctgtgtttttctcattcatagtagtcctgagtttcgctatatggaggtaccatcaaataatgagaggaaaataagttttgagcctcaaaagatgttgctaggttgtgtggcttccagatagtaccatttaaggcaccatatctt

SEQ ID NO: 38863 - DNA, 1023 bp, Homo sapiens
tactcaaaagcaaaaaaaaaaaaaaaaaagattttaaatggatccctctcagtcaccctaatctagcctcatgtcattccaaacattttcagtgcacatatgatctcatttttcttcaaaaatggaatcatatgacatccacttgaatattcccaagtaaggaaagagcctcccagacagaaaaaacattgaagaaaaacctaaagaccaaggcaaatagttacgtatcatggaaatctgagaatttagtggaatggcaatgtaaactgatccttgattgcaagtacaaattgatttccctgatatttcagtagcaaaattccaattaaggatttaaaatttggtgtaatttttgactttattttttcttttaaacagtatttttcttaaattctaattatcctatttttaagttcattaatctataacactataatgagtaagaagtttttttttttttaactttccataaaggcctacagctgtgaattctttgatttcaaaatatggatttcaggagcagcttctttactgtgagtttggtttaaattatatttacttaattagctgctgaatagactattaatgtaaaacttactaactttaatgttttttcctcttttattgttaatgtaactaaaatatttcctggtttaaaaaagtttctttgtatcaagttttatatatgtacctatctgttacactcaccaaacgtttaatattggttagccctagaggagtataatgaaaaaaaaagtaagcatttataatgaaaatatatgtctcacacactctattatacatgtacatatagagatttaaaattgtaagattaagaatagtttttactttgtttcttatgattttgttacattatctaatatgaaagtaaattgtgtttcactaacaatttttaccaagagctgatagcaataaaagtatattcttatcattcaaacaacatattaactcgaaaataatctttgttcattatgttgtttgtgaagctcttgggaggttttg

SEQ ID NO: 38864 - DNA, 1981 bp, Homo sapiens
ttgggattttttactcaagtaaaaatttaacatggttatcacttttcttctttccttgggcttctccctctaaccacaaaaataaatttggaaaaaggtgattctgtcatgtgaactgtcaatattttaagcatttttctttagaaaaacaaaaaggaaataatattacttttatcataaatatatacttttgtcactagagattataggaccttatgccatcagaaagaaccagtatccgaacttggaaatacttcatcgttgttatcataaactttttcaaagcagaaattatcaagaatgaatccagaggggggaaaaaaagattatatgacttagtatgcaactcacatatggtaatttgtgtggggtaggggatggagggttcattatctttaataatctcaaatatccaggtggcattggaattgggagtctcaaaaagcgaaggagcatggggcatcaattaagctgtggtaaaaccagccagtaacagctggagaggattgcatctgattgcagctgtgtaatcagttgtgaagtgacaagataggatttctcattagttaataatgggtacaaaaaaggtcaagagcagcaagagaagagacctattttgggcaaggagaaacatttgccttagagtgacagctctgaaacaaagctctatagttctaagcaacaaaaccaaacaagaataattagtgagtatataaacaacttttatgcttttggaaatgctatgtgtttttcctaccaaaaaaagcatgttttattttaggaaatgaaaaataatcctgtgcatttaatcactgaagaagatctgaaacaaatctccactttagaaagcgttagtacaagtaaaaaggataaaaaagatgagcgaagaaggaaagcaacaggtaataaattgttaacaaggaatattcaaagttttgtatttgttgcagtgaactttgcatttatcacatttattatgccctttgaaaggccctttgttttattgatttacctttaaacagctaatatcaaccaaatattttgctaatgtgttaagttttatataataaaatggaaatattggtgattatgttttctgttttcttttgtgaaaactttattttatcatcatgctcatctcttgtttttccccatcctctgtctatgttccagcccagtagcccttttttgttttgttttgttttgttttgattcctaaacttgccagggtcatattcacctcaaagcttttacaccaactgttccttttacctggaatgccctctcccagactgtaagtaactggtgtattcttttcattcagagctcgactttaaatgccacttccttagagaggcctcctaacccttcggaatagtagccacagtcactctctgccacctcattttgtcagtttatttgcatcactttatcaccatgatgtgttttattgtttgggaactgtgttgatctcatttattgttgtactcttgctacatacccaaagcaccacttgatatattttaggtgtcctataaacatactaattaaatgaaaaaatttctgaaggacatatttttacatttctttttctaatctaaagtcactagaaattattctaggtatcactgatatgcttgtaatttgcaatggaaaagtaacatgtatttccatagtttttatagtaggaacagtgctgttagtgctttatcggaactgaagaaattcaatattcaacatttttcattaataaatacacttctaattctttgagatagtttatttcctcttccagaatctttttcttaaaacttttcaatggcattatgaaatttctctattcttccaggaaaattaataaattacttaaatcacagtaatattcatagctatggatattttatcatatatttgaagatatagttataaatttgccttactcaattgatgacttatgtcagtataactagtctatttaata

SEQ ID NO: 38865 - DNA, 1050 bp, Homo sapiens
tgtttgtgaagaattaaaatgttatttcacctatttctgcttttggaaaaaaaatcctacacatttactccctactaagaatatattattcttcaatttatttgtttattctttcatctctctactatccttcggagttcaggtgttagtagcaccatatttgcatcgaatattttcatttgctaaattaaaaaaatctcagaagtatctttacctttttttggtaacattgcacttttatagcattactgagactttattttctaggaatataaggctaaaatgaaatttaagtcataattcaatatggtgaatattttaattcttgacaaaaatataacttttctgagatatatttattttatgaatgcacaaaagaaatatatatatgagttaatgaaagcttccaattgacatttttagactggaagttaactgaggccagctaaacgtgttaattagttgactgtcatttttaaatagagatttacaatatgagtttgaacttattaatattatgaatttcattgttgttttcctgtgagctgtatgaaactcaccacagtagagagctggatggtttcaatatctaatgactgaacttttcacctcaggccttgggtcacattaggctttggtttcaagtgattgacagccatttcatagtaacctgaaatgaattgggggtcaaaatcatccaaatgatggagagaaaatgcccccgttagaaaaaaataaaggcagaagtaaactaaccagtgtagttgaaactaattggcctccttattggcaaaggattgaacgggcacagggactgaattaatctcttgaattcggtggcagatccttgcaggttgaaattgtgaattggcaggttagcataaggggtggctgtatccccctagcatgtgatacttctgttctgtgaatttccattttgtggagctgtcaatctgaggcttttgtgagcattaaactttctttagaaacaacaccactaaaaaaagaatgaccccacctcctaaactaccacataaatcagcttgatta

SEQ ID NO: 38866 - DNA, 1033 bp, Homo sapiens
cccacctaaaatgttgcaaatatgtaaactatcaatagttttccttgagatttccttcttaaggttttatatttagaaagtctttcacacagaggtcaagttaaatattcatttaagggccaggtgcagtggctcacgcctaaaatcccagcactttgggaggccgaggtgggcggatcacctgaggtcaggagtttaagaccagcctggccgacatggtgaaaccccatctctactaaaaatacaaaaattagctaggtgtggtggcacacacctgtaatctcagctacttgggaggctgaagcaggagaatcgcttgaacccaggagttggaggttgcagggagccgagattgtgccactgtactccagcctggcaacagagggagattctctcctctaccctcccaaaaaaattatttaagttttctccttgttttcttgataatttgttttatacaattaagatttttatttgaaaattgtatgggctgggtgtggtggctcatgcctgtaatcccagcactttgggaggcccaggcaggtggatcacttgaggtcaggagttcgaaaccagcctggccaacatggtgaaatcctatttctactaaaaatacaaatattagccagtgtggtggtgggcacttgtaatcccagctatttgggaggctgaggcaggagaattgcttaaacccgggaagtggaggttgcagtgagctgagattgtgccactgcactccagcctgggtgacagagcaagactcttatttccatctggtctcgaactcctgacctcaggtgatctgcccacctcagcctcccaaaggccgagggagccaccgtgcccagccacaaaacttattttctattaccacacaaacacacacagagataccatttaggttcctgctgcctaaattttcaaatattgtgaattaaacaattttaatcaggaaagtcttataaactattatggctagatgagcagtaaatctcacatgacacattttaaaatgcaataagttactggttat

SEQ ID NO: 38867 - DNA, 1031 bp, Homo sapiens
gccggcctacacgtcaccgccccgctgcagcgccaacgtcggcacgtcgactcgtcgactccgggccctctgccccgcccgcgtgcgcgcgccgctccgcctcccgcctccagcctctagtccgctgggttcggaggagcagaggcggaaggtcccggcggcggcgaggatgcgccccagggcgggagcgggacgctccactttaccctggctgcccgcaacgggccaggcctgccgtctctacctctctacctgtgagttttttccctgcatttacttcagtctgccgcgtcttctccccgcccttctctgtaaggtaaatatgtggaggaaataattcctattaaaggtaaaggaaaggagagcaatttgaatgaagaaacaggtagttgctatcgtcgttttcagccaaagccctctggctgctagagagtatacatggttctctggtgtcaaggcctgttttccataagctttctggattctcagcttagttccctcaaagtgatctctgcaagtcggctcttcggtcagaagacctcctccaaaaacagaaagcccaaagattccctaactcgattgaaaagataggaagatacgaagaaaaactaacctaaagaattgtgtggtttatctgcaaagagttctagactaaaagccaacaatgcaaagatagtatgagttaatatgtttgttgtggctctcttctgccattcccgcttcctcaaggtaatgtgccccgatgcctggtagaactgttttgtagaggcagccaatagtgatccagttattgtctttactggtcagaccacctctgaagtgctgtgttcagcatttgaagactttaatcaagctggcattatatcagggaagagcaaaatgatgacgagaactcaaaaacagggcaagtgaagaaggattgattaaaccttccaggactcacctagaagagagaaaactactggactctctccaaatatgaaatgacctatcatgtgaagttgatttgtttcatgtgatgcaaacttcag

SEQ ID NO: 38868 - DNA, 1134 bp, Homo sapiens
attattttagaggcctttttagttttataagcatttttgaaaacataccaggttttatgtctatgtactattttgttgtgaaaggatatgtatcataggtgattaggaattttaaatgttcaactggacctatgtctactcaaaatttttaaaatatatgacatagttttttttgaagtgtttggaagtacatgtgtcactggattttttttttgaagtattctgaaacatttttaataatgtatatttggagaaataaaaaacaaattatttgtgtccttaataaatacataaaaatttatgctgaggaacctaggatactttttctcttaaaaatattgattgcatgtaacagcatatcaaaacatattcagttgcttcaaaataaagagaatatatatatgtgtgtgttttaaaattgagctgtgtatttgtagttatgtatatttatagttacataactctacttaaaatttattggcagtaataccatcaaactttcttgtagttcctgtgatgtcaccaaatcctcaaaaagaaacacatgcctaggtgctgtactttgtctctctttagtctctctttagacatgttgataaatgctgtgagattctgctatttgaggatggtatgtaaccattgatggtttaaaatgacagtcttcatttgattttctaatgttaatttgtaatttaaataatcatatttttatgatgtgaaaatatatattctgacccatgttaattgtgaaacattgatatagttcaataatgaatattttatttttaaaaaattaacaaaatatgtaagtattatatttgtgaattttgtcatatctcactgttgaagtttttaaaaaatgtttaataaaataggacaattttgatgattttatttttaaatatatttaagaatttctcgagtaatacaaacacagatttgtttcaaatgaagtaaggatatacgtggttaatacaaatttgttacgtctaaattcttttattttttttttgaggtggagtctcacactgtcacccgggctggagtgcagtggtgagatctcggctcactgcaacctccacctcacgagttcaagcgattcttctgcctcagcctcctgagtagctgggatta

SEQ ID NO: 38869 - DNA, 1149 bp, Homo sapiens
tatcagggagcctgaggtaaaaggatcacttcttgagcccaggagacagaggccacaatgagctgagatcactccattgcactccagtctggacgacagagcaagatggtctctaaaattattattttttttgagatctggtctcactctgttgcctaggctagagtgcagtggcaggatcatagcttactgaagccttgacttcctgggctcaagtgatcctcctgccttggcctcccaaagtcctgggattacaggcatgagcaacagtgccaggcctagaatattgtttaaagtatcagggtgtaaactgcagcttggaaatatttttgttatgcagatattttggttttaataattgttgtaacataagattttacctgtgtaagattttacctgtgtacatatgcatgtgtattcattataagctaaagaaaaaatactgttttaaataggcctgttgtgataatttaataccattttttggttaataattatttaatctttgtaagatagtatagaatgataaagattctggtcaaatcagtattcaaatcccagtttattagatacctgtaagggaagtaagttaccttgtcagtgtctcaatggcctataaatcggaggacaaaaatagtacccactttgtatagggctgttaggaggattacatgttattacatatgtaaagcacctaacacaaacttggcagatagtagggactcaatgtgtgttgtacataattagtattataaaggagaagtagtgtggtattgtgagaaaaaaaaccatgggaatgagtgtttggcttcggctctgccagttggttggtttataacttttggctggtcacttccagggagcttcagtgttcttatgggtaaaatgtgataaataatatttttcatctttattttagagggttatggtaagggtcaattgaaataatacacatgaaaataatttaaaaactgtaacaatctcaggttttagtttttatctttttttcaagagctatgtttttattaatcattttaattataagagtttttctggtttttgttttgagacagagtattgctcttgctcaggctggagtgcagtggtgggatcatggctcactgcaacctcaaactcctgactcaagca

SEQ ID NO: 38870 - DNA, 1185 bp, Homo sapiens
atgctcagctaattcttttcttcttcttcttcttttttttttttttttgtagagttggggtttcaccacgtcgtccaggctggtctcaaactcctaagctcaagcaatccgattaccccaccttggcctcccaaagtgctgagattacaggcatgagccactgtgcctagcctagtgtgctatgtcctgatgaagaaaatgatcatagaatggctgattgcctaatttcacacagttgagccagcagtgtcaccccagggtagtgctcttaaatctctgggttctagccacatgtagctgttttaattttatattaattacttactttgtgctaggtgctaaagattcaggtatgagcaaaaagcagagagggtttctgacctcgtggagcttaaagactagttaagggatcagacaatttcatcacacaaatgaaagtaaaattagtatgataaagacaaggtacatggtgctttgcatgtataatggtgaggggcctgacctagtctcagggtgagaaaggcttctttggggcagtagatttgtgatgaagaatgaagaacgagtaggcaaataaacaaggaaaagagcattctaacagaagaaggagttgtgggcagaggctttgtggcaggaaggacaatggaactttattgaacattagctttacaaagtgttaagatgacaaagatcagtaatatccagtctctgtctttaagagcttatagtcatgtgtatgcatgtgaccaacagttcccacagagtgtaaagtgccaagataacagcattgtggtagcaattgccaatgcttttagttgcagggaaggcttttacaaaggaagagtccatttgagatgggccttggaaatacctaggaaattgtcagcctgagaaggcatttcatattgtaaatgagcaaagatgtggagaggttaaagagcctcttggaaaggccaatgtctggttagagcatggggacttgatgggtgaagggcaaaagggaaggaggtggaagatgaagctcaagccaaggttgggaccagcttgtagcaggcaggcttatactttttgttagcccttaccctgaacattgctattggtgaatttatttaaagtattcactctctcagaagttgcattgcctatttgttttctgaataaaatttagacatcatagccagatat

SEQ ID NO: 38871 - DNA, 1103 bp, Homo sapiens
attaaaatttataggtttatacaagttttgatgaatctatatgtgtaaccatggtatattaagtaccttttagtgtcatttgcagttgagagagatgagtttttatctctttgagaaaggaagatgttttgtctgaccacagagtaatgaggaaaagcattttggtagcaaaaatgatgcaggtgttaaaacgtaggtgttaacagtcttttgatcttgaaattttgtgtgacatggagttcccaggaggccctctcaactttatcatcccagattggtttcagaggtgcacaaatgtatatattccttttatgattagaaggtcatatgctgacctgaatttaaatggcaaatgtacttcagggtctgtcgtgtgttacagatatttaaaactgatgttaaaggaagaagtttcattcaatatgaaaggaaacagcctttatgccttttgtaaatgttcctttttctacagtgatggattcattatctgcttatccacatatttattggtggtcactcatgtatcttctctatactctaggatacttcctctgcacacagactgaattaaccttttcatatcatgtccatataaattgttggctgttctactcattttatcagcagagccactagaaacagcccatttctaatctgttagtaattttattgctactatatattaaaatatatgccaaatgctgtcatattctgccatatattttcatgctatatattttctctcttgtcttctgggtgtttagcccattcttaagataatgccaagcagaactaaggttggacaccacaacaggttctggaacattttattttagctagtaaaaatacagtgtaataaaggatgcaggacatagcttttcacattataattcaccttagcctttgtttttttgtgtgtgctatcatttcccatccttctgaaaacactgctattttaaaatcattctactcatatttgcttctctcaccacttgggttttttttcctcccctttttctcaacttctacccccactcactctttctggtgttaaaagcttctgtagggaattgataatccatgtctttctgctttaaagtctt

SEQ ID NO: 38872 - DNA, 1031 bp, Homo sapiens
tctttgccgaattagataacagtttttgaatactgtaggaatatttcctaaatttttgtgctatttacaacataagtgctatagatatgacacactgttaaattttatctgcattattaacattttctccattactttcctaggtgtctagacaattaagaaaacaaataaagccctgatttgtagcatttccgaatttccatggtaataaatacttccaccatggccaattttaagctaccagtgtgaaatcactgaatgtggatttgagaaaaaatgcacagtgacaaactgtaggggagggaacaaaaatatttttgtcttactcttccaggttctcaggctggagcttgtaagttggactaacaaatgagagattaacaaaagaaaagcatacacatttatttaatatgagctttatgtgacacagaagcattcataggaaaattaagacctgaagcaactgttaagcctgagtgtttttaatactaggtttgatgaggagtggaaagtcaatgaaaaacatgacagtacaaagggatatgacctaaatatagtaaactgggggaacttaacaaggtgtgtttgttcgaattcctgtttaagtgtgttttgcctatacttcaattgattgttcttttttattgatttgtatgagttctttatatattcttgatagtacatatcttgatatgatacagtttttatatatttgttcagcaaatatcttctcaatatgtgacttgccttttttaccttcttcatagtttctttggatgaacagaatagttttaaattttgagtaagtccaatttatattttatattatatgtcatattatatattttcttttacaggtagtgttcttatgtcgtgtttaagacatctttgtctacctcatggtcatgaagacattttgctgtgttttcttccacacattttacaggtttagctttacatttacatctatggtccatatacagttaatttttgagcagctagtcaagtagatgtcaaggtttatttgtttt

SEQ ID NO: 38873 - DNA, 1062 bp, Homo sapiens
cactagcttgttgactagaagtgatgatagtgggcatctttctcttgctcgcaactcggggaaaatgtttaataactcatcattaagcatgatactagctacagagtttttataaatatgtcaaattatggcaattctctttcattcctagtttgctgatagtttttattatgaacaaatgttttatcaaatgccttttctgcatggatggagatgaccttacggtacttggctttattctgttaatgtggtaaattgtgtttttatccagatataaagcctgatttataagatttgttgagaagcctttcatcttttttctattccttggaagagtttttgaaagatttgtattttttttttttttttaccttaaacgtttggaagagtctaccagtgcagccacttggcctgtagtttttctttgtagaaaggttttaaactattgatttgatttttaaactacatataggaagactacctagatttttttttttttttttttctgagacagagtctactctgtcacccaggctggagtgcaatggcaccatctcaactcactgcaacctccgcctcccaggttcaagtgattctcctgcctccgcctccgctttgcgagtagttgagcttacaggtgctgccaccatgtccggctaatttttttgtatttttagtagagatggagtttccccatgttggccaggctgttctcaaactcctgacctcaggtgatccacctgccttggcctcccaaagtgctgggattacaggcgtgatccactgtgcccagccactacctagattttcttttcttcccatgtcaacctttgcaagttgtgtttttcagggaatttgtgtatttcatataaattttcaaggctgtcaccattaaagagtccataatagcctcacattttcttcatactttctatatgatctgcagtcgtgttcctgccttctgtccttatattggaaatttgtgttttctctgtcttgattaatcttgctagggatatatttattttatcttcgattttgttgattctttttttctgtatt

SEQ ID NO: 38874 - DNA, 1078 bp, Homo sapiens
caccaacactttgggaggccgaggccagtgaattgcttgagcccagaagtttgaacctagcctgggcaacatggagaaaccctgtcattgcaaaaagtaaaaaaattagctgggcatggtggtgcatccctgttgtcccagctacttgtactgagatgggaggatcacttgagcctgagaggtcaaagatgcagtgggtcgtgatcagtctactgcaccctagccagggtgacagcaagaccctgcctcaaaaaaaaaaaaattttttttaaccattctgttaggcgtgtggtgatatctcatcatggttttaattttcatttccttaatagctactgatattaagcaactttatatgtatttttgtgtcaccctcatatactctttgacaaactgtttcttcatatcttttgcccattttttactgggttgtgtgttttcttattgcactttaagaactctttgtgtaagttttttttgccagatacatgatttgtagatattttctccctgactgtggcttgtcgtttcaatctcttaaatatcttttctagaacaaaagtttttaatttgaatgaagatgatttatcaatctttacattttctgtttacatcaatgatccatttagagttagtttttatataaagtgtaaggcctaggtagaggttcatttctgccatgtgtaatatgaattgttcaaacatcgtttattgaaaagaatatcctttttcttgaaatgtttttagattagaaagtttagtttctgtcatttttggttaaaaattgaaatttcaaagttttgattacatggtattaatatgtttaacaaattccaaatatgatttcatcacttgagaacttatttgttcaattctaatgtttgtatataaggtagaatcatattttgtgaagagttactccctgtggcaaaaaaaatgtaaaataattttgaagattccactttaattattagtagactgtttataaaagaaaatgggattattttattctctcttaaaattctgcttaatttagcgtccacttacaactttctggttactcaaggtagtaaatatt

SEQ ID NO: 38875 - DNA, 1033 bp, Homo sapiens
gaaaagttttcttaacatttcaaacgaaataatttctgatttttttctatttagtttttcttaagttcattacaaaaagagtaaagaaatttaacgagtctatacagctgtctttataaaaaagtgaagattgttaataaaaaattaagaaatgttatatttcttctataaaactagcctatacttgggactttttgttctctttaaaaacatgatttactatgaagaaaaagagtgagtgacttccaacataatgaaattatgggtgagggtggtagaattattttctttgccacagttgatttctattatttatatgaaataatcatgtcagcctgtagtacataattaaatatataatataattttagtttatattaacagatatgttaaatatgtaaaaaggatttagactaaaatggtctggaaatcttttttatatatagtttaaatgtttttactccttaatacttggtgaataaaaatgtgcataattttaaagaacacaaagtgcatggatatgtagtgtatatgttggttgtatacatatagctttgtaatttttaactgttcatggtttctttttttacctcctttttaaattccgatttttttagagtagtgactgtcttttttgtttttcttaaccttccacatattttgacccaaccacatattccaagaagtgtcattcataataatgcagtgttgacttgaatttttaaaaataacttagaaaataatacattctgctgcttttatttcattttgttcaatatttagtttttataactacgttagtatgagtaagctttttgattttctacatgagttaaagtggtaatatattttgtttagaaagaaggctaatagactgttaaaaaaaagatgtttgatgttactacttttggcttggaagcttggggaatttctttagtttgatcatagtagaagaatttgttaacttatcatttttaagatgctacttatttagatttaaaaattgattgtgaaatttaacattccttgtagt

SEQ ID NO: 38876 - DNA, 1050 bp, Homo sapiens
actggcagaggctcgagttgaataactaaactattgcatccaaattttcagtcatccatatggtgactaaggaaattagtaaaaccagtagaatacccaagtcttcttaattcttctgtatttttaattctatcccaagtttctttattatagcctaattttaggatggttatccaagtcctttcttcttgtgattatttggccagggatctcttaatgaggcaattatagttgtttccttcattcacattatcttagcagatgctctccctgctgtgacctctgttcagactgggcagacaatgtgccattctcatcaccctctgccagacattgtgtggagctgagcttcatttggcgctgcataggtctcccaagatgccattggaatggtcagaagccaagtggcaaataatcagaattttaggttgattttctgattgctgattataataaataataaaataatgcctacagaaaaaaagttccagaagcaactctaataatagttcaagtagaaattatggatttaagaagtaacttagctttcttgctttagactgtggccttggtgaaattagatcatatatttattgtatgatttcggtacaagggtattgtgataatttggtagtattttagaaatttgatatcctttctaaaaaggaaattaatttagcctctaatattaagtatgtagatgtttaaatgaacattatgacattgttcagagtatcacttgtaaattttaacgtcacttaaattttaaaaattatgcttaaatgtcttaaacataaattatcatgatttatatctgctaactatgacatccaatctgttcctgtgtgaacagagtaagagctgatcaagatgaagactgatcaacagaaaattttgttacttgcactgctgaatccttccactgaatttgttacttgcactgctgaatccttccactgaaatactagttctgcatcccaaaccccagtaacaatctaggggaatcacaaagttttcagcagtctccagctagactttttaaattctaca

SEQ ID NO: 38877 - DNA, 1094 bp, Homo sapiens
gggagtctctggagaggcctgtggaaactgctgcctccgagtggaccagtggcaggctgctgttggtcagcagggccaacagttgggaaaacaagctgagcacagagcaccagagagagaacagctgggacctgctgggcaggtctgtgtctgttaccaagtctggccaggtccaagaataatgacttcttcacttccaaatcttgtacaagtttctcttttggttgactctacctcagaaccatccagagaaggagatttctgtgaaatacaggtgctagccgtaaccaaactgacatttcaatctagcatcattaatataaacaaagttagagtgggaaaagatatttccagtgcatgtaattgataaataattaatatccaaaaagcactacaaatcaaaaagaaaaaacaaagcctgacagaaatgaacaaatagtaattcataaagaaaaatattcactgaaaaactgtgtggcattactaacctaaatgagacatcatttcactcatgttgaactagcagaaatttcaaagtctgacagtaccaagcattgtgaagaacgttccacaatactgatgggattcttgacactaccacttcatagagcaatttggcaatatctggtggaagattgttcatatctttttactccacttctgggtagatttttcatggcagtgtttttcaaactgtgggttggggcccactggtggctttgagatctatttgatgggttatgaccagtattattaattttaaaaaatgagatagaataaaaatcatcagagcactttgcatgtagtaagagtaacttgtttcataaacttttgagttgtggtgtgtgtatttgtgcgagtactgaatcaagattgaaaatgttttctcaatgtggggcatggtcattttcacacaaagagaattatgcaaaaatgttacttagagcattgtttgtagtaacaaaaaactagaaacctaaatgtctgtaaatgagaatttttaaattatagtatattcttaggatgatatggcagttaaagtgaacatattagagctacatctcaaggataactccttttttaaaaaccctact

SEQ ID NO: 38878 - DNA, 1761 bp, Homo sapiens
ctagacttaacctggggtgttgagctcagccattgtgttttttttcttctttcttccaacaaacctctgggtaattttgatatattgtaagtttgagatcccttggcctggcatgggagggtgatgtgggaagaaatctgttgaatcacgtagtttataattccaggaattaaaatagttcagatacatctggatttgagtgctcaatcctagtgccaagagggatagaattcccagcaattctcacaaaagttcagaattaattttgttgatctagcctagaatgtgataatctgattcgctagacatgaatcatttgcccactctgtgctggggagtcaggtgaactcccacccccatctaaaccacaagaattaaaagtaggggaaagaggattctccagaagaaaaagtgccattatgagtagagacactgaattgggggaagggggtaggcaaaaataactgatacacataaaatagcactggattacagagtagccagtctgtaaactgttactgtttttcaagaagacaatgagcttgtactataatctaagttgatataccacttccttcattggaaggccttgctacaaaaacagtgtgacctgtactaaatattcctttcttcgtgtgtttagaaatttcctctgttatttgtttatatgtttctttacttttttccttctctcctggaaatctggttacatagctattagtgctcctaaagtttcatgtcttttctcagcattttcatctgtcgtcttgctttcttttgtaagatcattattttgaacattaattgaggtcttctagaacatcgactgacttctcagatgtgactgtcttctttcactgttttttttttctatttagtttcaaaatttgagatcatgtttttagttccagagagctttcttttctgtcctaaactggtttatgttaaaaattatcttcagatgtcagtgggagccaggttttctaaaagtgcagctctctctctcaggttactttgtccctatgaaatactggagtttttctcccctctcattgtggtttttcttcctttaacatgagtacagaggtggcttttagcctctcttaaacagagacaaacctctgatttatggaagtgatttgtgatttctgctcttgtgagctgacagtaagcaaactatcaaagcccaacccctctgctatgggagatgggggttgaaggatggaagaccaaggaaagaacctctgaactgtcctttgctcactggaagaatatattccatttgccaaaggaacaaaaaagtgaaaatacctaggaataaagcttaatgagagatatacagagtctaaatgaagaaaactgaaactggccagacgttatggctcatgcctataatcccagcactttgggaggctgaggcaggtggatcacttgagatcaggagttcgagaccagcctggccagcatggtgaaaccccatctaaaaatactaaaattagccgggcatagtggcgcacgcctgtagtcccagctgctcaagagcaacagagtgagactctgtctcaaaaaaaaaaaaaaaaaaaaaaaaaaaaaaagaaaactaaaactatacaaagttagtataaaagaaaacacatgagtaaaactaagctcagtatgaagcctaccctgggatatgtttgtttgtgtatgtgtgtgtatcctattcaaaatgaaatcttttcctccttttatttttataaacttaataagattgataat

SEQ ID NO: 38879 - DNA, 1032 bp, Homo sapiens
aagccagccaacttgccttcctaaacatgtcctctacttttctacttcggtgttatactcaggccatttatttgcctggcatattttctttcccatctctgcatctatttaaaccttactcatttttatttttattctaatgtatttatttattttagacggaatattttcttaaatggtactgctccttgcggagcagggctgactctgaggcagggctctcagagtcagcctaaaccttactcattttaaaataacttttaagtactatgttgcagccaggccaactcctttacaaagtcatccctctcgctctcagtaattgtgattgtgtcattgttctgttttgttttgtttttgattatgtcatttttggaaaagacataacactttctatcttacagcatttaacaaaatctacattttattagccattgctataccaggaagaacagtcgtcagcaacagttaccatttgaccccaatggactgttttaaaatatatttttaagtgatattacaaataatttagaaatatataaatcaaatcctgctttaaaaactgcattggaaattagcaagaatttaacaaactcaaatgtttcttgcatgtgtttctggtatgaagatactaattttcataatgggtgatttccgttgaatgcaagtaattctgcatgaatgatcctggaacatacctattttggaaatactgattcagttttcaaatacgtttctaagaggttccagcttattgttcttggtggttcttgcatttacatcctcaaaatgaaatacttttgaaagttttcagggctcgtaattttgttagaaggtggtcattttctttagcctatgacaaaacattttcatttttagacattgattagaatgatcaatttgattgatttttttcatttctatgttatttcctttcagtcagtgccttaagcatttgtccacttatgagccatatttcttatgtatggtttcttatgtaaatttcttagtacaaacctcataaaaggtaaa

SEQ ID NO: 38880 - DNA, 1047 bp, Homo sapiens
gatcaaaatgtaaggaaaccaaaattatatagcatccttaaaaataacttttatagcccaaatctaatggtaaatgcacagatagagggtaattgaagatcccatttgtgaaagtagaatactgacatcaggctcctggtcaatgagtgggcaaaatggttccctgaattggataacacagtgcataccacggtgactgataaaattgatgtgtctgcaggagagccagccctattactgaagcctttaacctattttctgtctctttgaaaatgagctcctgagtggaagttatcctcaaggaagtgaatttaattcaaaagaagatattttatagatgggcaactttaatttaagaattcacttatctattgtagaggagaactgtgtgggaaaatatattattataagtaatgtggttatatttttcaaatatgtcattttttagtgttattttgagaacctgaattttaagcattagcaagtaaactttattatttaatcttacactctcttagaacatatggctgaaacaatattgaatctgcactgtaatactttattaagatatgtaattatacaatgaataatttaactacaacatgtgatttcttgtttttttttctctttttgaaaatatgattcagtctgtcctaagataaatacttgttaatcattgcaaagaataaaagcccatcttataaattcattattctaaagtatataaggtaatattgctaactggagaagcaggcaatagttaccctaatttttgccaattaaaaaattcactgttcaatttatgccaggagataaaatactaaatatcctatatacactgcttagtaggttgttagtaccttagtagtttgtctatgaaatataaggtagaataaattattaagtttgatgttctcacacacatacaaatatgtcatcataattcacttcttgttgtgagtctggacttaagccaattttctcagttaacactttttttgttgttgttgttggagatggagtctcactctgtcgccaggctggagt

SEQ ID NO: 38881 - DNA, 1027 bp, Homo sapiens
ccagatgtgtggatgatgcagcaattgtgttgggtatttatataattctatatcatttgcaacagcttctctataaaacaatatatctgtcattcataagtattgctccttacaggtgcactggccggacctgaccccagggactctaccacagtacatgaacctattaataaaccattcatgcttcccagtttggcagatgtgagcaaactatgtataggaattccaaaggtaactttttcctttcattactttacagaaatactgtcaagtccaatagagagcacagacttgggaggcggattgggtgggtttgaatctctgctctgccacttttattaatcatgtgagttgagtatgtgacttaatctcttttagctcaatttccccatctgtaaaataggaataataaaaatactgacttcagagaggtttgtgaggatcaattagacagtcatgttaagtctgtaaattgtttctgtaatgggcaagatagcaaatattttagattttgtggaccatgcagtctttatcataactgcttaactgccattatagtgagaaagcagccacagacaatatgtaaatgaaaaagtgtgtctctgttccaataaaactttattttcaaaaaccagctggcttgtcacatctggcctatgggccatagtttgcccatccctaatgtaaagaaaggactttagcccaaagccacaacttgcatagtaatgcctcaaaaaatgttaacatctttactgttattattattactactgcatctattacagtagcaattgagtaatgaatacatgaatgttataatgttaaattactaaccttttaaaaatattaagcattgcaatatattaatactttaaatcttttaggaagataagttaccctgcagaataatgaagtttcacaacctcagcactgttggtgtttggggctggtaattgtttgttgtgggagactgtcctgtgcattgtaagatgtttagtagcatccctggcctctacccctacatgca

SEQ ID NO: 38882 - DNA, 1038 bp, Homo sapiens
aaagcacatggggggctgaactttccctcttagaatggcaccaatcccactcaagagtggagttgttatggcccaatcacctcttaaaggccccatctcttaatactgtttcagtggcagttaaatttcagcatgagttttggaggggacaagcattcaaaccatagcacagggtaaatcccatctccattactctatcttggatggaagcagttcttcttctgagccatatttaaagtaggaagaaatttaatagaaaacaagtatttgttttgttttgttttgtttttttttgagacggagtcttgctctgtcgccaggctggagtgcagtggcgcgatcttggctcactgcatcctccacctcctgggttcaagagattctcctcctgcctcagcctccccagtagctgggactacaggcgcccaccaccatgcccggctaaatttttttgtatttttagtagagtcaggatttcaccatgttggtcaagctggtctcgaactcctgaccttgtgatccgacgcctcggcctcccaaagtgctgagattacaacatgagccaccaggcccagccagtatttgttctttataaaattcaggttttggaatatggtgtttaaaccacttaggtgttgtcagtgtgtaaattatatgtgatgcctgcattggtctctctgtagacctggtggtcaaataagagtaaggacctatgatatttctgtaccactcttttagagtaaaacatatttcacgtttttatcgtattttatttggccctcagtaaaactggagcaggtatatccatttttactgttgtggaaactgttgtggaaaagaatggttagttctttttttttttttttttttttttttttttttttttgagacggagttccgctcttgtttccagctctccacgctggagtgcaatggagcgatcccagctcactacaacctccgcctcccaggttcaagcaatgctcctgcctcagcctcctgagtagctgggattacaggcatgagccaccacgcccg

SEQ ID NO: 38883 - DNA, 1025 bp, Homo sapiens
gtgagtatccctgttgcactctcaaaccaagggttgccaataggactgcagtttattggacgtgcgttttgtgaccagcagcttcttacagtagccaaatggtttgaaaaacaagtacagtttcctgttattcaacttcaagaactcatggatgattgttcagcagtccttgaaaatgaaaagttagcctctgtctctctaaaacagtaaacatatcttacaaattaaaatgacttttaggctgggtgcagtggctcacacctgtaatcccagcactttgggaggccaaggcgagcggatcatgaggtcagaagatctagaacagcctggtcaacatggtgaaaccccgtctctactaaaaatacaaaaattagccaggcttagtggcgggcatctgtagtcccagctactcaggaggctgaggcaggagaatcacttgaaccctggaggtggaggttgcagtgagccgagatcatgccactgcactgcactccagcctgggtgacaaagcaagactgtgtctcaaaataaataaataaaataaaataaaatgacgtacagagattctatattctagagagtcaaatggtcttgctcaattcttgtaattaggttcttgttaatacagtcattccatggaattactttttaaaattcctgtgacaattaataataaataacgtgtcagcatttagtaagcatccactaagtgtacaatacttctacaataacacaagatacctgttcctcaaagacaatgcattctgccataatgttcattaaagagtttacagtaaaaataagattagggataaacttctcaaaaattgtacatctgtgtaactaaagcactaacaaaaacatgaatagtccttctagaggtaacttggatagcctaggcaggcaacttatcatgtggtgaaggccgcctcaggggttgttaaaaatgcacagaaacaattgagtgcgattattggcttctgagcgctgagcagagcaggtggaagaggaactttgagcacagg

SEQ ID NO: 38884 - DNA, 1050 bp, Homo sapiens
gcaattgttttgagtatatttctatattttaaagcactttacctttaaaaaaaatagatttgaggccggacgcggtggttcacgcctgtaatcccagcactttgggaggccaaggcgggcggatcacgaggtcaggagttcaagaccagcctggccgacatagtgaaaccctgtctctactaaaaatacaaaagttaggcatgttgatgtgtgcctgtagtcccagctactgggaggctgaggcaggagaatcacttgaacccaggaggtggaggttgcagtgagccgagatggcgccactgcactccagcttgggcaacagagtgagactttgtctcaaaaaacaaacaaaaaaaatagatttgagggtacaagtgtagttttgttacgtggatatactgtatagtgatgaagtctgggcttgagtgtacccatcacccaaattgtgtacattgttgcttttttttgttttgtagcaaagtggaagatgctttctacaaaggtgaactcaggctgaatgaggaaaaattatggaagaaaagcagaacggtgagatactaacctaaaatgacagccagatgttttcgtctcttactctgctagtaactcaattaatgctgtcccaaattttccctctggctcctcttctttctctgaggtcctttgtggtcctccacgtcaagctggtgggaatcagctacaggcttcagacacacaggcactttcacttttgcagccttaatgatcttctgatgaagcttctcccttttaaaattttagaatacaccactgttagaactggcagaaatccattaattaaacttccaggtcattaatgttagccctcatggaatcctcataatcagatttcaaagaaacatttgatccacgtagaattgttctttggccagtggtatctgagcagatgtgtaattctatacagctcagcagtacccagtgagtgcttgctggatgcacggctttgtgtgcagagcagttatagaaaaggatgtgttctgtattttctgacaagtccatatcaatactgtt

SEQ ID NO: 38885 - DNA, 1048 bp, Homo sapiens
ctgggaggcggaggctgcagtgagctgagatcatgctactgcactccagcctgggtgacagagtgagactccgtctcaaaaaaagaaaaaaaaaagtcctttcatattgaggtcttagatatgtcattaaaatccatttacctgtcaaaatcacttgtaattgtgtttgtctactaattactaatgtaattggtgtatcatataaagtttgccttattgtgcccctgttctcctttggttgattgttttgtgatacggaggggtccacatttatttcccaaggaccaaagacatattttacgtaggccaagtgggaaaaaaagggtaactaattttgtaaatgtagagtttacgtttgaatatatgcccagtggcttaggggaggggagatgatgatgaaggtatcagtaaggtagtatgagtaagtgacaagtacatggggttcagattcagacagattgggttcaaatctaggctttgtcatgtaccaccctgtgaacatggacaagttacataagctctcttcacttcagttttctcatctgtaaaatggggatcccagccctacctcatgtggttgttgtggagatgagataagaaaatgtatgtaaggccgggcgcagtggctcatgcctgtaatcccagcactttgggaggctgaggcgggcggatcacctgaggtcgggagtttgagaccagcctgaccaacatggagaaaccccatctctactaaaaatacaaaattagctgggcatggtggcacatgcctgtaatcccagcttctagggaggctgaggcaggagaatcgcttgaacctgggaggtggaggttgcggtgagccaagatggcgccattgcactccagcctgggcaacaagagtgaaactcctgtctcaaaaaaaaaaaaaaacaaaacaaaaaagaaaatgtgtgtaaagcccttagcatagtgcctgcctcacaaaaccagaccttttttctttttttttgccctagagttatcatgcacataaattgtgcataaaaaggtgtgcatccaaatgcaaatt

SEQ ID NO: 38886 - DNA, 1030 bp, Homo sapiens
ctgaatactttaaaatgaaatgaaatgtgaaaaaaagagggaatatacttctctttatgcatttatgtggcagtcttgaataaagtgtcttttacctcaaatgataagtgcccttattctcatttcttaccatgtttgcacatgtgaagtaaaaggaagagcctgtccatacggcacagacaggtttgtgtggagcaacataagatcgatcccctaaaaccagcttgatttcctgtgtgcagaaatgtcttatctttctttgaaaacaatgaccatttcctgtcctccaggatggtttgcttttcagttagttttccaaatttgagttccattatagtcagggaaatatgatatatattttcaggcaaatcttgaaattcctaaggggttataagaactggactctaaggaaccattagcttaacggagaatatggaaacagtcacgtgatctgctaacctctatgtatatagctgagtaacccacagttaataagcatgttactttttggctcttataattctgacatggagttgtacttgcagggaaatgggaatgagaatgtggtttgcattatggtcattatttattttatctgttattcaatattcttggggcttgcatatgatgatgtgttccaaatagccattgagaaaacaggatttaatcaaaattgctttggactttatttatttgtccaacttttaaaatatgattattaaataaaattacctagagttaatgggatttggatgacttactatttatgtaccagatgcaattctcaaaaaaaaaaaaaaaagaaagaaaaagaggttcactgaaccctcagttttcccaatcacttaggataaggacaggaggaattaacgatgaatggcagaaatgtgagtacttaataatgtaatgatataatctcatcatagctaatagtttttgagcatgtattatgctagtagatttatatcatttaattttcacaactctttgtggatgctattattaaccttgttttacagatgagaaaact

SEQ ID NO: 38887 - DNA, 1031 bp, Homo sapiens
cttaaactacatacataaagtactaaccataatggaaaaagttaattacatataatacaattaagaatgtttgctgattttaaaaaatctttcaggttgcttggtggatacaatatgtgttgttccagtgatggatacactgaaggccttgaattcgccatagtgcaatatatcaatatagttaaattatactcatatcccatgaatttatacaaataaaaaaagaaaaaatctttccaaagaatgaaaaagcaaatcactgagtaccagatgaagtttgtaatgcatttccctgtaaaagacttatattgacaatgtataaagaatctctgtaaataaaaataaaacagctcaatagaaaaataggcaaaaaatgtaaacaggcccttcatcaaagaaaatatccaagttatcagtaaacatgaaaagtttttcaatctcattactcattagggacatcagatttaaaatcatagtgagagaccggtaaacacacatgagaatggctaaaatgaagaagattgacaataccaagtttgaggaggatatggagcaactgggactctcatgcatagctggtgagagtgtaaatacatgtaaccactattgaaagctgattggcaatatctattaatgctgaacatacacatatgcaataatttatacaattaagtgttcttgaaaatgtataatgcaataattctatcttaggtatgtgctcaacacaaatgtgtatatatgtgagccaaaggcacataaaataatcttcatagcagcatttattcataatagctaaaaactgggaacaacccaaatgttcaccagcaatcattaacatacacttgggattccttagatgggcttaggtgggtaagtgtaggtcatgaagttgactgtggaactgtgtgtatatcatatgtgcacaatttaggaaaggctgtttttttttttttttctcaaaaagatccttgtctcaaaaaatgctaagaattcctgcctgcatacgagacctagatttccatagtttttaa

SEQ ID NO: 38888 - DNA, 1067 bp, Homo sapiens
aattaggaggagtttaaaattttcttagaaactatggaaatccaggtctcatatgcaggcaggaattcttagtatacacaatttcacagtcaacttcaggacctacacttaaccacctaagcccatctaaggaatcccaagtgtatgttaatgattgctggtgaacatttgggttgttcccgatttttagctattatgaataaatgctgccatgaagattattttatgtgcctttggctcacacatatacacatttgtgttgagcacatacctaagatagaattattgccttggctccctccattcccccactgggtatccaacacccaaggtgcacctagtaaggatgcttttcttctccttgtgctgaggtcccaggtcagacattttattctagtgagcaaaacagatatgctcctgtcttaacctggctcatagtctggtggaagagacagacattaaaacacacacacacacacacacacacacacacacacacacacacacacacacaaactcaatcaagtctgagaattaccaagtccagagtgctgtcggatctgaccaggtttggggtcagggaaggtctccctaggatgaggtttaagataagatacaaaggactgaattcatcagtaggactaaactggcaaaggattttagggttgtgagggaggaagcagcacatttaaaggctgagtggagggagggcctcaaggaagtgaaagaagccagaatccagaaagcagacaggtgtgaggctggcctggtcttaggagccatggagaccatgccaggagtgccactttcttcttgagggcagtggatgccactgaagagttttgagcaggtgagagcagtggtcatattggtgtttcagaagaattttctagatgcagaatggagagaaggaactacatgacagtgagttagaaggctacttgtagtttgggcaagaggtattggtggcttcactgggattgagggtaacaaactccatgaagataaggcacctagaacagtgcctcacatataagtagacttgataaatattcatcgaatgaatg

SEQ ID NO: 38889 - DNA, 1028 bp, Homo sapiens
gaacatgagattgcacagaactaaaacaaagggattgtggttagctgttattcccatttataaataggaacagtggtgccattacagcagcagatagctcagaatatagtttcctcagtgtaagtggcctaggagaggctggccaaggactgtattggatgtggggagctagatgctttggagtagaagtctgatgggatgaggctgctgttacccatcaagagttaactcgtccacacattgaagctactatctttgtggctgaaaactgtgtctgctaaacagaaggaaaagagaagtgttcagaagaattgtgacacagtctgaggctaaatgcttcaagttcaggtggccaaaggagtagaagtcttgaagactgcagctttcaccattattaattaatctatttatttatgcattcaacaaatatttgttgaacagtaactatgggagttgccgtggccaacaaaacctggtccttgctctcatgaagcttatagtccattgagggacagatgtttatttaaataataacgcaaatgtgaagtcgtcactgtggcaagtgccatgatagtattgggcacagtcccatgagaacctttatcagggtgagttgacttgtcagaagatcttgaagcttccctgagtaagtggggctagcactcaaatctgaaggataaagaggtgttaagtaaggaaagagagaaggaagagcttattgggctgaggacaccacagtgtgatttctaattttggcattgatatgcgctttctttgctaatttcatgttctttatgaaggaatggcgctttacccacaaacaagagaacaattgaacaaacaaatattccctggaatgataaccccatttatccatttgtttgcaaattcattcattcattcattcattcattctaccaatccttggggattagttgcttgcctgctggcctctgcctgctctgacttttcgatcagcttcatggactatagagttagcacattaatactaaatcatttcggagagt

SEQ ID NO: 38890 - DNA, 1079 bp, Homo sapiens
ggacatggatattgctaatgagaggtatctgaatctctcttcagatgccagatgggagagatgacccttataaggctagctacacctttacctgcctcaggtgactgtgaaccagggactgcagttcagctggagtcagcagcctcctctccagatctagtagctcctgaaagccacacataatgacagtcatttccaaaagaggctgattttaaaactgtgctgaaaatggctaacagcaggctgaaggttaaagtaaaaaacttaaaaaccataaaatctgcctggaggctatttaagcaaactgttttagaggcacagatggttcatatacctctgagccaaaaacaaaaaggaaaaaggggacagtaaagctggcgtgattaagcagacaagtatgaaagttttattagtactaaaaaggcatcctttagaaagtaaaaaatccgtctcaggaaatttggaagacgtattaaagaccaatgggaaatggagagggcacacagatgacatttcggaaagcaaccaaaaatagtgaagactgtacgcatggacattggatatcagaagctgtgctccaaggaccttaggaagcagtgtaagagaaagatgccgtatatgggcaattgggagtagcttccctgtcctgtatcaatctgtgatgtagagcaggttttataaggattttttgcaacttaaacagtggtttgaatctttaaggaaaatcagttgaagcaaatttgagaagcttaagtgctgtaaatcagagggtccaaaacatatgaaggaaataaagtatgatgttgctgatagcattaaaaatagcacgtatacttgagagtggagaagtcactggggtgcaagggcatccagcctctctcaagggtctgctttgctgcatcctggatgcagtcctccaggtatcttcccatgagcatgctggcgcctgcactcatgtgcacacagaaagcctctggatttgaaatgggtgagtgtccattatcataattttgagaaaagccagactctaaggaatgacagaacagtacaaagtttgcagggtcactatttgaggaggc

SEQ ID NO: 38891 - DNA, 1044 bp, Homo sapiens
ttattcagggggcagcagtgggggagagggtggcctgatgtcctggttgtctatcagagggagcccagaaaaagacagaaaataactaattcaaaatgaccctttcacagttaaaataatggtacgtgccttagaataaccattcttttctctcctctagtttgtctggtggtttctacttagcagcttcctgccttcaccctaccaatctgtttttaaaaaacaggatttcaggagccttacttatccttccccagcccaagaggtgttcagatatgttcatgcagctctctcctgggtctcctgtgtagatcctggtagtaaagataggagtagccctggaaggatttgagaattttcacaggggtctgttacaggactgtgtgaagccagggtgagaagtcaaccaagtgtgaatcttgaagtccacctgctccctttccagggtctcacctttgtccacccaatgacggattccttcctctctggattctctccttcaagtacctgactgtccaggcccaccctccctttccccaaaacctgacctctggagccttcctgacccctaacaggtagcatcctcttcatacacctatggatactcacggtttctcccatttttaaagttttcactatattagatactgggctaagcattttatattgtttaagcctcataatgccctgatgacaaagatgttagtgtccccattttacaggggaggcaactgagactcagagaacttaacctactcaatcagacagcccaggagtgaccgggctgggaatggactcaagtctttttccccaccagactgtggaggtgggtatacatggccatgttcacggcctctgttgggttctgcttctcatcttgtctcctattgacgcaactgaaatctctggaaaagcccaaccaccttttcaggcttttttacttgagagactcagaaatgtgtgcttccagctgggaagcagcagtgagaccattgtcaataatatactcgctttcagtttcataaacacttctgatgcatgccc

SEQ ID NO: 38892 - DNA, 1016 bp, Homo sapiens
gttcagagtagagaaaaacagaacattccaggccttggcttaaggaagaatgagagctaatgaatccattcgacatatatttacaggattgtttgttatataagggacttcatacataatgcatggtctctgccgtcaaggagtttcagtctggtagaggaaataagacatggatggtaaccaaggagtctcagacagacctgggactctaggagaaggtgagatatcagaaacagggaacaaggtgcacagttgcttaatctaatcaaggaatggacttttgaggatgagaatttgttgggcaaagaccagaggatcaattcaacagggacgtggaggagagaaacgtggggcaaaaagatgattggccaaagtccaaattgagtgcaagatcttctgtgaggccaagaccatggtatctaaccaagtaggaggagcaggtgttgggcagaagtgcatcgaatagttggtgaaggtctaggtgtgaggcaggtgtgatcagatagctccaggagagccgtgctgagactcgggtatggagaagactcctgaggttcagaggcagaacactcaactggtagggactggagtgtaaggctgaatatccagcgatagcgttaaaggatagaaacccattcatttattcattcgctcactcggtcatttatggaacccttataatatgccaggcactagtccaggatctggacatttgaagctggtcagaacgcagtttccacactcaaggacctgtttgattagtgggagaggcagacacacacatggtcataatgcaatgcaataaattggtgtggaatggaaatacagggacagagggtgcagagcttaggcaaggaccaggaggaagagtcactgatggcttcctaaaggagctgcagtctgaacgaaggcttaaaggtcacataaggatctgccagcagaaggagagatggaatctagctccaccagaaagaatgggagtgaaggacaggagacccagttgaagggcactaaga

SEQ ID NO: 38893 - DNA, 1040 bp, Homo sapiens
gtgcaatgaacaatgcgcactgaaaaactaaggtggtggtaattgccaacaaaattatttgattttggtttgcttgatattgttttaaatattacaccacaatgaatttgcatgttcaaactaaacaatgtaaagaaaaataaatcccaaattttgatacctaaaaggcgtactgcgtatttaaacaaacttcttaatattgttgttatttctggattcccgtttgttgaatgatctgagctgttatgctttttagctttttttcttccattatttgtaagtccctaaataggccattatatttcccttcaggctagagatgaagatggacatgctgaaaattttccccagcagcactatgctaaggaaactccaaggcttgccttcaagaataactgcgaactacttgtaagaataacatacttacaacaagtctagaatgttactttagcacagtgaaaacagtttttgaaagggtttgttcatgattacataattgatgaaatattatagttttctgtatagagttctaaatgctaattctgatatcactgaatattaattttaagatctcaaattgtttgcaaatcttttatatctgattatagagcttgaatggccctgtctttattagcttgttgtgtttagtagtttataagcagccacttggagaatggctagtaaagttaaaaatatagagaaagacagttgatatatgtagcttgggaaaaaagaacctcaccctcacccctcctcctacgtcctcattgtacactattttaggagacaacatggtaatattttgttctgctagggaagatagcagagttgacacgcagtactccctttagaattcaagtattcctccactctcttgccaaacttaatcgtctctcctatgcagaaggagtcaaagcagtgacagggtgcggggatgtttacaagtcgtgagagggaggatatcagctgtgacattgagactctgttccaatgcagggttaatttgctgttcattttagcatttacagccagacaagatg

SEQ ID NO: 38894 - DNA, 1059 bp, Homo sapiens
ctctccaattacactttattatcatgctcatctccgtaaatcaccctattggagaagaggaggatggggggagggagaagagattaacttgggacacctaaatgtgtgatcatgaggttgcagggcagtggtgaaatgtccagtgaacccatgagctgggccacctactaaatagagctggttgcctcattggcagaatgtcaccaaattttcttgataaggacgggattccatttgtaaagtgagaatgaaacctaactcttacatgcatatgtcaactgaacccaggccactgagtcctatttgcctggcagggtgtctttcctgttcatggggtctccttcctgcagtttggcaccaagcagcatcccccagggtaggcctcaagcgtcactgaccagctttgctctctcccccttttggggcccagcggcttagctgatgagttgctcacctttgcaggtaatgggaggcttcgatagggaagagggtggcattgctaaagtgagtgacactgcacatctctgacctcatagacagactcctgcctaatgccaagtgagccgccaagagtgagttaaatttttcaatattgggaaggggaactaacatgtgtgcctgtcataggcagaggtggcctcatttgctcctcctgccaattctggtggaataggcatcatctgtatctcaccaaggaggcagatgaagcttagatactgtgcccgaagcagagctggtacgtggggaagccgtattcaactcaggcctgttggacacagcccaagctctcccgtctatccaagcgggcatcaaacaggccaaaattcagttgagtttatcaacttcttatggagaggaagaggagagatgagcatttattgagcacctaacttgtacactgctccttccagggactagggagatacaaaggtaaatgatggcgtgcccccatctggtgggagtgcaaactccaggaggaaggaagcgggggccaggagagtggatctcgtaagatgaataattgctcacatttgtatgcaggctgtcttctaagtgttt

SEQ ID NO: 38895 - DNA, 1042 bp, Homo sapiens
tgacaaaaaaagtgacggccttcagaaagtcagaaagcattgggaattgtcactttaaacacattctaatatcactcattcaggtgaggctgaaaagaagaagaatgggagggtgagagattttactattataccatcattggagtgagaagtgaccaggtcaagaatagtgacactaacatatgagtagcttgggaccaaaataacataaaaacataaaatacacgatggctatttggatgatatatgtttctgaataaagaatcagtcttgtatgtggaccagaatcattaaaaatatcaacctggctccagccaatttcagaagatgtggtgatgaaattgcccactacctcttgagattgaagagttctttcaatgatgggtcccccaagaaattacagcttttctttaaaatcagaaatacagaaatactcaggctttgtcagctacgaaagggtgacaaggcaagtgatttaagatgggggaaaaaccacctctcctccactaaatcacatttcctcttgccctcagaagttccgtgtcacctcacagcacagtctcaacctgccacaatttactcacattctctggcccttcctggtttgttttatttatttatttagttatttattattttttgagacagagtctcaatctgtcacccaggctggagcgcagtggcgcgaccttggctcactgcaacctcggctgcctgggttcaagtgattctcctgcctcagcctcctgagtagctggggttatagccacgcgccacgatgcccagctaatctttgtatttttagtagagacagggttttgccatgttggccaggctggtctcgaactcctgacctcaggtgatccacccacctcggcctcccaaagtgctgggattacaggtgtgagccaacgtgcccaggccccttcctgtttttttgtgcacatgtggtgctgtttttcttctatgccttcagaaacccagaccgttcatatggttggggaaattggaagtgtatccactaaataaaggaccgtatggc

SEQ ID NO: 38896 - DNA, 1032 bp, Homo sapiens
gatctgccattgcactccagcctgggtaatagagtgagactttgtctcaaaaaaaagaaagaaagaaacggggagaaaacccaattaattaggtcctagttcatctcttatggtccaatgggaaatgcagattttaaatgttgagatacgatacatttctatctctgcccagagagttatccctcacaactatttctgcattttttaatatgtcaagtttaacactataattactttaaataacctgatcttccccgccccccttttctttagattttaaattattagtaattatttgtggagacgggatctcactgtgattcccaggctggtctccaactcccagcatcaaagtgatcctcccgccgtggcctcccatatgtgctgagatgacaggtatgaaccaccgtgcttggactgatctgtcccttgaactgcaaatttcttttctttcttgctttttttttttttttttttttttttttttttttgagacggagtctcgctgtgtcgttcaggctggagtgcagtggcgcatcttgtcttactgcaatctccacctttcggattcaagcgattctcctgcctcagcctcccgagtagctgggattacaggcgtgcgccatgacacccagctaatttttgtgtattttcagtagaaacggggttttgccttattggccgggctggtctcgaactcctaacctcagctgatccgctcgcctcagcctcccaaagtgctgggagtacagaagtgagccaccgtgcccggccaacagcaaccattcttaataacactaagaaacactggaataaaaagaaattacttggccgggtgcggtggcttgcgcctgtaatcccagtactctgggaggccgaggcgggcggatcacctcaggttgggagtttgagaccagcctgaccaacatggagaaaccccgtctgtactaaaaatacaaaattagccgagcgtgatggcgcatgcctgtaatcccagctactcgggaggctgaggcaggagaattgcttgaa

SEQ ID NO: 38897 - DNA, 1043 bp, Homo sapiens
ctcttgtcgcccaggctggaatgcaatggtgcaatcttggctcactgcaacctctgcctcctgggttcaagcgattctcctgtctcagcttcctaagtagctgagactacaggcatgtgccaccactgcccagctaatttttttgtatttttagtagagacagggtttcgccatgttggccaggctagtctggaactcctgacctcaggtgatctgcccaacttggacccccaaagtgcagggattacaggtgtgagccaccagacccatcccctgattaggtattaatgtgagtagaactaaccctcctatatatgaattggtatagtttattttttatttatttgtttatttatacatattttgtttctcttttacatgttacttgccaaggtacaatttattagtagtacatattactagttaagaaaatatttgtctttggacttactgtctgtttcccttaatactcactggttatagcgtttgaacttactttttttttttttttgagactgaatatcactctgtcatccaggctggagtgcagtggagcgatgtcggctcactgcaacctccgtctcacaggttcaagcgattctcctgcctcagcctcctgagcagctgggactacaggcgcacgccatcacgcctggctaattttttgtatttttagtagagatggggtttcaccatattagccaggatggtctcgatctcctgaccttgtgatccgcccgacttgacctcccaaaatgctggaattataggcgtgagccaccacgcccggcctgaacttacttttaattatccaattagatgaatatctttatgtgaacttatttcatgtttcttggatttttgttaatatttattatattagaaaagaatgtcatgcctatccctgagactgattatctttatgataatggaggattttgtggtgctggtgggagtatagcagtaaggccaaccaggggtcactctcatcgccatcttggttttgcctggcttctttactgcaagttgttttatcagcaagg

SEQ ID NO: 38898 - DNA, 1043 bp, Homo sapiens
tcctcccaccttagccctccgagtagcaatagttcctagtagtagtaatccctataggactagaggcatataccattatgcctggctaattaaaaatttttttttttccatctgtaaagacagaggtttcactatgtttcccaggctggtctcgagctcctgggctcaagagatcttttcacctcagcttcccaaagtgctgggattacaggcgtgagccactgtgcttggccaaaacaatttttatttatcttatttttattttttttagagatgaggtcttgctatgttgccaaggctggagtgcagtggccattcacaggtatgatcatggtgctctgcagcctccaacttttggtttcaagggatcctcctgcctcagcctcccaagtagctgggactacagatgtgtgccactccacccagcctcaactttaaaaaattaggtattatttatttatttatttattttgagacataagtaaatatgctctgtggatggtagtctcaggcctgttgtgttaacccttttctgcacattatttgtactaaatataatcctctgaagtgaggctgttgggaaataggggtggtgtgggtatgtgaatgagggggatatgaaaagggtgggactttgtgcccccctttccacttttctctttaataaattgaggattctatggaagattttgtatgtaaaaaaggtacagctattaaaaaataaagttggaaaaccactcctttaaacaatgagacgaatttcaagccaaagattgataaaatcacatttggattttagtaagatcagccctggagttggcagaagatatttgacagatcatggtagtggtaaatttggcacagtggtggtgatcagagtcatacatcagtacatggaggctatacattgatttgacctaaaatagtgggacatcttgaagggagtggcccgccggtcaaagctggattaaaagattttctgatttgcaattggttaaggaaacaaagctttgtctaaaaatttcgggtcaacagaaaagaat

SEQ ID NO: 38899 - DNA, 1034 bp, Homo sapiens
cctcgtgctctgcctgcctgggcctcccaaagtgttgagattacaggtgtgagccactgcgcctggctcataaattccttttctttataaattactcagtttctgaagataaaactctgactttggactgtaaacctttgtcttgggtatgaaaccttgacattgttgaaagaagagtggaaactgtaagggacaacaagtttcaccacagcacagtcttctttctctgataggccatccgaacagctaaggagaagacagatcactcaagaacttaagttgtttattagctacagcatgtttgctgctttgatacacattcagccattttggaggaaagctaagcagtactgactgcccattttcgtgaactttaaataacaaatactatttctcaaggtcttcattttatcattaaattcagctaattactacctgtttaaaaataaataaataaataaatttcagaatatctgaaactcaatttcagatattctgttataagcgacagaaaatgaactaagacatgtgctaagtaggatttatgattttatgaactttggattttgttttcaatacagttgtttaaacttcattataggctgggtgtggtggctcatgcctgtaattccggcattttgagaggctgagatgggaggattgcttgaggccaggagtttgagaccagcctggccaacatagggagaccccatctccaccaaaaaaaaaaaattagctaggcatggtggtacatgcctgtggtccacctaattgggaggctgaggtgggaggatcacttgagcccagaaggttgaggctgcagtaagccgagatcgtgccactgcactccagcctgggcaacagagagagactatctcaaaaaacaaaacaaaacagaacaaaacaaaacacaaatagacttcattatggtggacttattttttttccctcattatactcctaagaaactttctgtaagtctatgctataatattaaaataaagtataccttcttcataagataccaaatttat

SEQ ID NO: 38900 - DNA, 1034 bp, Homo sapiens
ccttctttttctaatttgtttactgctaccttgcattgaatgtccgttttgtatttccagatttagctaatctaataagagagaataatttagttcacaaaagtgaacattagagattgccccttaaaattcttcaggttcttgaaattacagaaaagaaggtcaaactattctttttcttagttcattggctaattggtacttttgagaccaatgtatacttacttcttattttgaaagcagttataacagacacttgatcaattttatgttcctgcacctttgggcaccattaatgattctcatcttgttgtcaggtctcattctttgcctcctgagaacatctacttccagtaccttcactttcatattaagtcatcgctaaaatcaacaactttgttcctcctgttaccttaaccacctgaccataaatggagatggttaaagaagcataactgcttccacttctgtaaaagcactttttttttaaaaaccctatgaatgttgttggattttagtttagaaaatacagccatatggtaactaattgaagggaagcatattacaagttattcatctgagtgtttgaaagcaatagaaaagatgtgatagtatgggatgttcatatagtttgggtaggtggcaacctttgtttggaaacatccttataatatagagaggggaagagaaaggaattctgaaatgggaagtgagacgaacattttggtggctataataagtttagttcagaccacttataaaatatgtaatcggccaggcatggtggctcatacctgtaatcccagcactttggtaggccgaggcgagtggattgcctaagcccaggagttcaagaccagcctgggcaacatggcaaaaccctgtctccacaaaaaatacaaaaattagcctggtgtggtggcatgtgcctatagtcccaattactcgagaggctaaggtgggaggatcacttgagcctaggaggtcaaggctgcagtgagccatgattatgccactgcactccagtctgggca

SEQ ID NO: 38901 - DNA, 1065 bp, Homo sapiens
gatggggtttcaccatattggccagactggtctcgaactcctgacatcaagtgatccacttgcctcggcctcccaaagtggtgggattacaggcgtgagccactgcgcctggccggtagttctgttttaagttttttgagatgtctccaaactgctttccacagtggctgaactaatttacattcccaccaatggtgtataagcattcccttttctccacagcctcaccagcatctgttattttttactttttaatacaagccattctgactggtgtgagatggtatctcattgtggttttcatttgtgtttctctcgtgattggtgatgtggatttttttttatatgtttgttggccactgtgtgtcttcttttgagaagtgtctgttcatttcttttgcccatgttttaatggagttatttgttttttgcttgttcagttgtttaatttgcttatagattctggatattagacctttgtcagatgcatagcttgcaaatattttatccctttctgtaggttgtctctttactctgtggatagttgcttttactgtgcagaagttctttagtttaattaggccttacttacaaatttttgtttttgttgcaattgtttttgaggacttagtaataaattgtttcccaagactgatattcagaatggtgttccctagattttcatctaggattcttatagtttgaagtcttacgtttaaatctttgattcatcttgagttaatttttgcatatggtgaaaggtccagtttcattcttcggcatatggctagccagctatcccagcatcatttattgaatagggagtcctttccccattgcttatttttgtcaactttgttgaatatcaaatggctttaggtgtatagctttatttctgtgttccttatttcattccattggtctatatgtctgttttggtaccagtaccatgctattttggttaccatagccttatggtatagtttgaagttggttaatgtgatgcctttggctttgttccttttgtttagggttgctttggttattttggctcctttttggttc

SEQ ID NO: 38902 - DNA, 1066 bp, Homo sapiens
acaaaagtagcagacaactcctgaattggaaagagttgttgctttcccccacaaactgtatgtggtaaaatatttctaaaattatcaagttttagtctaagtctaggaaatctacccaagatattttattaaatttatttaatttattaaattaaataaaaatatatttttattttattaaaaaataaaaatatatttaatattaaatatattaaaacatatattccatatatgtttggaaaaatttatttaagaaaattggctgtagtaacaggcactaaagttttatttgtaatggtgtttttgtgctgtgtcgttgcaattaataaatatctaagatgaaaatggttgtgatgtggatttaaaatacagtccttttccatcttcataacagaatgtagaccttgtattagtcagggcctatctatagaaaagtaattttaggtgtatgccttttaaaatattttctctaattatctcatataaaataaaaataaagatttttcgcgacatatgtaaattatatatttgtagttatctggaaaaaaacaagctattgcttacatgtaaaatatatactgtttaggacttgaattctcttctcttagaacaataaatagttatttttggttaaatcacaagatatcaattatttgatgacaaaaatggcttaaaggaagtgtgtcttaaatatggattagctagttctttgaatgatgagataaattagtttaattacacgtggcaattttcttggctagtgatgtaatgtgaaataaaattctccctttcccctccctgaaaactcaagccaattaatagaacttttaagctctttgtcataggccaccatggaggtctgcagagaagaactttaatccaataaacatttcatttagatcatgaaaagaaagcatgaggagaagctcctgtaagagagggtgttactatgattccaaccatgaagagatgtgaggaatttgccaaattaaccaagaggtcctcatattgaacgcataaatgtgtcaaaactaacagaatcattatttaatttgcttgaactcta

SEQ ID NO: 38903 - DNA, 1038 bp, Homo sapiens
ttttcttcctgtgtttgtgtttcattttgggtagtttcttttgcagtgtctaatctgttattaattataatccagtgtatttgtccatgttagaggtggcatttttcctttttaaaagctaaacttgggtttctttcccttttcttttcttttttaaaaggcaaagtcttgctatgttgcccaggctggtcttgaactcctggactcaagagattctccccccttagcctctcagtagttgggactatagacacacaccaccatgctgcgggggtttcttttttatatcttctttgttcttatactcatgccttcctctaccttattgagtatatgcagcatatttataattgcagttttaatgtctttgtctactaatactatcatctatgtcatttctgggtctgtttctattgataagtttttgtcctttttatgagctgattttcctgcctttcatgctttttttttattgtgtttcagatactgtgaattttatattgtcgggtactggagttttttgtattcctttaagtactttgagactttgttctgggacacagttaagttacttggaaacaattttatcctcttgaggctaggctttgtaaagcagaaccagagtgcctttattctagggctaattattcctgaagcaatacccttctgagaattccacctgataccctatgctttagtaggactttcctctgactagagggaacatgaactattcctggccatgtatgagctccaggggtaatgctttgtgattccagtgggtcctctcccacctgcccgtttcaagtagttgcttatgcatacacagtttagtactcaactaaagactcagggaagccctctgcagatcactggacttctgtctctatatctttttttccagtattataccttgcaaattctagctgtgctagcctccccaaatgctgaattctattttctcagcctcctaaatgctgagtgtatttgtgtccctattcctgaagtctggaaactcactaggcagtaaattgaggc

SEQ ID NO: 38904 - DNA, 1768 bp, Homo sapiens
cattcactctggcgtttgggaggaggtttgggggctgggccgggccgtaatggcttctacctgtaaatgaacccgaagagagactctctaccgttccttatcatcctcttggggcacgggacacgtggtagggagagaggtgtggaaaggcctatgatgtaatgacttcctgcagttgggtatccaaagagattaactcctctgcccctgctgggctgctgatatccagctgctttcctcttcctaggcacctccctggccccttcccccaagacagtgtgtgtcagtaccaggccaaagagtcctgtgcgattggagatatacatctcttatcagctgcccatatttgcaatttagcttagatttttttttgttttgttttatgtaaaagaagtagttgcttcctccttccctttcttcattgtcattggggagccctctgtcttcctgggtttcaggaggtataaaaataagaacagtttaatcttagtggagaattcaatggaagcactggagacgagcctgtagatgaaaaagttaaagaacttaatgtagagaatgttttattttgcttctagaaaacccttgcaaagttaaatacggcttatatcagagaggctttgtattagatactttaaaagcaaaacacgtgtgctttgatattaatccactaatgtgtctcatttcttttaacaaatgcttacattatgagtcttatatttggtttaattcaattgctttgtaaaagaatgccaggtgtatgatacgagagttctttacagaaaggatgaaagttagacaattccatttgaaaagagcactagtgtgatatgttttaaaactgggtttccaagtggatgggaagggttaatcagtgtatagtatcaggaaggcgtaagcggacaggatctgagaacatggatttgggggttcgaaatgtttttcagatttctctcacttgaaatttagtcttgcatgtttgaatttggtgaggagaatacgttagtgaaaagttagttaactttaaacttagttaaaacgttaacgtaggaaggcgttttcacctttcctgtgatttttaaggttacaaaaataatttaatttcacaaatatttcttgttattttgtttatagttaaatataataagtttaatgaactttatttttggggggaagatttacatgagataatggtattaccaaaagtagccgcgaattgagattgggctagatacattttcatatagtttgtaggacttgcaatacagattttgggactagtcataaactttatggttttatgtcatcgtttttttgtcttatggttttttttttttacccttctctgctatctcatttctcttcaactaaaatcttagaaaatactgtaaattgaaattctcaaggcttaatatgcttaatacagggcacacattttatgattcttttaccttaaaattttttaccaattccatttctgagtgtcacatgacaactaatccttgacgactaaagggatataattttgttagagtttttataagatgatcttcatcaaaagatgcagccatgcaggaactttcaaatctttgatgatggagaaggccctttgaaactggagctggttttatattttgattatgactaataggcaacctttttttgtgtgtgcttgtggtttagtggaagaagagggaaaagggagagatcaggagctaattgtgacccatttccaagtgtccaagtttaggagttgattcttgtcatg

SEQ ID NO: 38905 - DNA, 1050 bp, Homo sapiens
aagaaggatagcattttaacaaaaagaggaagcccttggttacttacatttgtcagatactgtgtcagggagaaggatgatgactatctcacaggttcccttacctcgggcattaaagtagaaatgaacaatcagatgtggttaagaggggaaaaggttacatttcctttaattcagattaagcttgcactgcacccatgattgaacaagtgagttctctcagttcctcttgtcttggggagacctctaaggacgccagggcttacctggtaaggcctatctatcacttatttcgttatacacagcacacatctgcttttcccatgggtcagggtgtaatcaaattaggcagacttgagtttctgtagtggttcccataatttcacaagtgtgggggatactgtgttaagatttctgctgctgctgctgctgcagaagataattcttcaagagtccgagtcttctttcatgtaagaatgtgtattgttatggcttcttgccaagataaaaagatgagggctgtcctgtcacataatgcttatttgtgtcctcactgtttctgttctttagattaatacatccagttccttttcaacacactgtattaggaaaatgttattttaactgcaactctgttttaaatttttttttaatttgaaaatgactaagtcataatcattccacattggctcataattttgacctcagtcaccttttggagtaactcaccaaaaggccagttatggtcgtgtgtgaagaatctgtctgcttggcccgtgttgccaaaatgtcgttttgtaatttcctttggcaatagtgtcttcgtcagtgattctcaactaatatacttcctctttctacagccccagtacactagagggactgtttttcctctttttcaaagctgtgtcattgacctctgaagtgaagaaattggcccttttagactttgatctgtgagtcccatgtaacagagactctttaaaaaagaagctaagtgtgtgttttgatatgtttatctccttcttagaaaatgaaatgaaactacag

SEQ ID NO: 38906 - DNA, 1061 bp, Homo sapiens
tggctcatgcctgtaatcccagcactttgggaggcccaggtgggtggatcacctgaggtcaggagttcgagaccagccttaccaacatggtgaaaccctgtctctactaaaagtacaaaaagctagccgggcatcgtggcgcatgcctgtaatcccagctactagggaggctgaggcaggagaattgcttgaacctgggaggcggaggttgcagtgagccaagattgtgccgttgcactccagcctgggtaacaagagcgaaactccatctcaaaaaaaaaaaaaattagctctgttgtggtggtgcatgcctgtagtcccagctgcttgagaggctgaggcaggaggatcccttaatcccaggagtttgagactgcagtgagcacgactgcaccactgcactccagcctggatgacagagtgagaccctctctctctcttttttttttttttttaaagcgtgtgttcataccactgtactgtagtgtctactgcctaccattgtggtttcacagctgttcatctcagtgctgtttgcctcaagttcttcaagctcttcacttgctgtcttctgcttctcctcccctcttctaggctagctcgcactggagtcgctgtgtttctccttttgtgttctccatcagcactctctacttaccttgctaaatgccttttctttcaacgccaccttaccctgcccaccccatggctgctacctgtttattttgtcattttgctaagactgttgaatatttttaagcacagtataagaggctttaaattagggaatgtgtctgccagacaaataagtgtttctaatatttggagctgctttttggattttataatcaacccatatggatagccttagttctggggctgtgactctgaaaggggctgatgtgactcaggagtgagctggtgtcatgagtggagtcttttggatacttgcagctctgaaggtggcatcagctttagacctcctagcatcgatgttgatgtgatgtggtgtaaatgtgagatgatgctgtgctatctggggtttcttgcagtgccttgtt

SEQ ID NO: 38907 - DNA, 1024 bp, Homo sapiens
agtaatgataataataaagacttatgatattggccgggcgcggcggctcacgcctgtaatcccagcactttgggaggccgaggcaggtggatcatgaggtcaggagttcaagaccagcctgaccaagatggtgaaatcccgtctctactaaaaatacaaaaaattagctgggcgtggtggcacatgcctgtaatcccagctactctggaggctgaggcagagaactgcttaaacctggaggggcggaggttgcagtgagctgagatcacgccactgcacttcagcctgggcgacagagcgagactctgtctcaaaaaaaaaaaaaaaaaaaagaagaattagcgcgtacctgggtctttaatgggagagtaggaatggcttgagaattctgtcagaaacctgttggtttggtgattctgcagttctctttggtcactgccaggtgtgaccatggtttactatgggtcagaggcacagtgtattatttagaagaatagagtgacgcatggtaggtagaaatcttttgggatggggccttatcgcagaaatttctgtgttgggacagtaggatatctgtgctttttataggcttcaagcacgtagatgaatgcaggcagcaacatcaagaaaagcagatttcaggaaaaaaaaacatttacaaggagttcttggcagaagttttgctgccaaatcagaaatcataatgaaagatattaaaattattttgtgaggtggtcgtctctttgcagtgcagttactgacgggtttaagagcaggctgccaagatagagacagaaaatgttgcataatgcaagttgctggccaggttagtgtttatctctactgaagagcctacttgcttttgtcttcaaggtaaaaatatgtatgaataagacctaaaatggtggttttaattggccacaggaaggcagtgccgtaagataaaatgtagttaacagaatagaatgctaattatcccattttgttctgtgtatgttggaaaaaaattacagaactctcagtt

SEQ ID NO: 38908 - DNA, 2059 bp, Homo sapiens
tccttctcactccccaaaaggcagaggttaagaagaaagttaaaatatcaagacacactaaactgtttttgtggtgagtcaagctgcagtgcctcgctgactgggaaacaatgggctgggcctcctagaatatagtaggctggagaaacagaaaatacagcttgactgggccttgccctctcactccaagcctcaacaggatgctagagctttagcatgctttctgctgtgctgggattattttctgcaactagacaaaaaacccacaaaactccacatggtttgttctcaagcaactggaatatggaaaggcttgaaggaatacttacactttttgatggaaggtaatgaccttagttcttcagtatttattaggtaagcatgggttctgcagtatagcatttaaaaattcatgttcctcagggtttcctaagacaaaatagagtgtgtttggtccagtgtgatggagaagtttgatgcaaatccgtcttaaggaggagaatggaggctgtcatggagtcctgtggactgtttcgcaagtagttgttttccatgttccagttttacttaacttcagaaaattattgtttttgaaaataaagaaaaaatctaagtggtagagagaaatataggctgtatttaaactggcctttataatttttcctgggcacacgcagcccacattttggagctctgtgacataagcaccccctgccccggagctgggagtcttgaccgggccaggccttggctgccctgggctacacagacacaagcacaacccgaatctttgtttacttcctctccaagtgctggggacattcagtactaagaaggactgtgtgcttgcacaaacactcctgccagcattctctcagccctgccattcctgactgtcttggaaagttcttcgtttaaggcaggcttttgttcttagagtgcatgcattattccccagtcaggcagccttttccgggtttccagtgcagacttgcaggtccactcccctgcagcctagcccaggggtggaaccttagctttagttgccattaagagcaggaggaggagttaggcaggggtgactggctgttcatgtgagttcctgtgactgatgtctctgaagaaaccaatgccttcttcagatccttatgggaaatttaggggacttttggattacacagtgttgccttttgctgattctaagatagagccttccaattgtaagtatgttaaaaacacacaactatttcctactgaatgttagtcaagctaaagagtgaatctgcaatttcatgaataatcaaaacaaaagcatgctgccaggatgaactgttgcaagagcaggtgctatttttttccagaaacttttttatcctcgatcacgttatgggtattaagagagttattcttaaaggatatcatgttcagtgcaatgtcttaatagaaaaaccttaaacataagtatgcaggcaaacacaggtacatagctgtataaagttaaatatgaagactggaattcattaataggatttaatttaaatctttttttttttttgagatggctttactctgtcatgcaggctggagtgcagtggcatgctcactgcagactggaactcctgggctcaaaggatcctgccacctcagcctcctgagtagttggaactacaagcgtgagccaccacacccagcacccacctttttttgagaaataatacagattgagcatccctaatttgaaaatttgaaatccaaaatgctccaaaatctgaaactttttgagcgttgacatgacactacaagtgggaaatttcacatccaatctcatgtaaggggttgcagtcaaaactttgttctgtgcacgaaattatttaaaatactaaatgaaattatcttcaggctatgtgtatgaggtgtgtatgaaacataagtgaatttcctgtttaaacctgggtcgtatccctaagatattttattatgtatatgcaaatattccaaaatctgaagaaatctgaaatctgaaacacttccaggtaatttggatgagggatactcaacc

SEQ ID NO: 38909 - DNA, 1530 bp, Homo sapiens
tagagctcatcctagctcagctgcctcccctgacagcagacgaaactgaggcccagcacttggtggtgggctcagagtgccaaactagttaatgaggcagagtagacaggcaacagccttctcatgtaggtaggcctcatcctttagaagatgttgctgcctgcccttgtgacttgtaaagatctgtttgaagcatgagtaaggagatgggggctcaggagtgttacagcatttcacatctcaggtgtagctgggacttatcgggtgaccttttagaaactgtttattttcatttttgtaccccacattgggataagtatggtccactgacattgagaataaccaggcctgttgtagacagccagccatcctgaaactactaggtttatacttcttacctgttagaacagagtttcccaagttgtattcccttggaaacactagcagtcgtgcatcatttgggcagttaggttacacaaaatttaaatggtctatttattttcttttccagacagaactcagggcagtcccacctcaagggaaatctcattacatccttctgatggtggggtagctgggagtcagcatgaaatccaaaattctaaatcatcgggaaaaagcagaagggttggaacccaaattaaactgaagtcctaaataaagttcacttttcggtcaggcattcaggaagcagcacgtgaaaatttgcttggatacagtttcctcatagttcttcagcagcttgaaataacatcttgagctggctgtaaacaaaacatctcaagttatcgtttttctttccatttgattgagccagttattgtatagggaggtgacacaaaacaaaacttcgtgtttctgaagccgagattttgggattgtactttatgcaaagttacttataagttctgattactttgagagaaaaatattacagtatccttaggaagttttatgtatttgttttaaagctaagcaccaccctctttttagttaaaaaaaaaaaaaagtttggaaaatagtgacatgtcagtacaaagggaatactgctctacaataagaaggaacacgccacagatacatagcatggatgaatgtcaaaaacattgtgagagaaaaatgcctgaacaggagagtaactattgtttgattccatttctgtggaattctagaaaaggcaaaactaacttatggcaacaggaagcagatcagcgattgccaggggtgatggggattggaggaggttgactgcaaaagggcagaagggaacttttcagggaaatatgaaatgttttatatcttaattgtggtggtgcttacactggtgtaaatatatttgcccaaattcgtgtaagcatatgcttaaaatgggtgcagttttttgtatgtaagttacacctcataaagttgatttgaaccgaaaaaaggggttagaaaaggctgtggttggaattttttgtgtaacttaaggccaaatagtccatttacgccagtttttacagtattgtaagctatgccctttgtgttcac

SEQ ID NO: 38910 - DNA, 1028 bp, Homo sapiens
gcctaggctggagtgcaatggcacaatctcggctcactgcagcctccgcctcctggtttcaagtgattctcctgcctcaccctcccgagtagctgggattacaggcgcccaccaccttgcccggctaatttttgtatttttagtagagacggagtttcaccatgttggccaggctggtcttaaactcccgatctcaggtgatccacctgccttggcctcccaaagggctgggattagaggggtgagccaccgcacccagccccccttctattgctgtcttatagcaacagctacctcctttcccctgcctaacttgacccctggcaaccattaatctgctcttcatttttataattttgtcatttcaagaatgttacataagtgatcatgttatatcatacagtatatggatttttgggattgactttttccattaagcctgatttcctggatccaagttgttacacatctcagtagtgtgttcctgtttgttactcagtagtgttccactgtatggctaggttacattttatttattcactcatcactcaatggacatttgggttgttttcagtttggggctattttgaataaagccttgtgctatgaatattaatttacaggtttttatgtgaacgtaaattttcatttttctgggataaatgcccaatgacttcattttaatgatggcaaaatatttcattgtatgaaataaatatttcattaatttagctgatttcttctaaatgggttgttaagggtttttccccctagtttttctgctgttataaatatcactgatgaaaatattttaggtaaatcttaatgtatatctacttttatttctagaagtggaattgatgtctgagagcatacagaattttaaagctttgctttttctagtcactcttttttttctttcctaaaatcttcctaaactcctaccatcaatgtatgaaagtgcccattctcatacccttgccaacacagagcattattactttaaaaaatctttgtaaatttctgcc

SEQ ID NO: 38911 - DNA, 1066 bp, Homo sapiens
atggtattgaggatgatcacatcctgcaaacaactgcagcctcagactactttgactaaaaggattctaatgtgagtggttggaaggaaaggaggcagcatcaggcacaatttattgaagaggtcagaagtagctagaggagaaaccaactttttactcttaaataatcaagatttttatgtagatattttaggaaagatatggtcattaaaatttggaattatggtgaatgaaataagtaataaagaaaaactggaaaacgacagtacgcactgttaatacatttcttggtgactaaatgaggtgaaagtcattgggttcctttgccctcttcagtggcaggttaagtttttatggcttattatacctttggatgattgtgtagaagaacttcctgatatattttttttcttttcgaatttaaaggtaatttaacagcgacgtgcctttgcctgaaatgagtagaaatgttatatgacttattagtatgtaatattacttctgacactgacatttgtgaacaaggaataatcagtttgctttcttgttcattattatgttttaacaagaaataagtgttacagtgttagagtctctactagaactgaatttgaacaacaaccagtgaatgcagccaaagaaaacagccagtttggatgtttcaggccccctcaactttttgaaggttgggttttttttttccttgttgctttttgcttttcagtttgtttggtttggacccttttttaagtatttgaaggattgtctaagcttaagtttatccttatggagatgccttcacgtggggcatctgaatgtcatgagtttggtgattctaagccttcccgttttgtgacttggctcacttatggagtgtaaaggccctataagaagagagaaaaaggtatttgaagtcaaatgtttctgttttgcaaatttactttatactgttccaccacaggatgtggcctcttggctttattaatttttatttttaagcttaagatgttgcttaggccaaaataaactttttagttgagataaatgaagttcatagtcacactct

SEQ ID NO: 38912 - DNA, 1061 bp, Homo sapiens
gcttttaaggctaaggtatttgtgtttctgggttagccacttgtgccaacaaagcgacctctctttaactggaaagcagtttggtgttctcactcatttcttcaggacatatcattacaggtctttgagttgtagttaggactttacacgtatgaatatgctgctaacacgcctggaggacttaactgttgacaacagggctccttttgcctagactagagttttttcattaaattcaggagatgtgcctgttgaattttttttaaatgtacacatacatgcacacatatgtacatttttgaaaagaaaacagttgggggaaacctgtcaccactcctcttatctgagttccttgcagatttggccatatatgcatgcattgtttgcttggctgcagtaagagattttttttgcactttgctttgtttccccttcccctccccatatacaggctttacaatggctatttaaaatcgttgctttaataggacaagggttgaatggatttataatttatttaattatttcctcactggagagcccttgatttttttcctctttattttaatattcttcaatattataggtattgtttttgtaattttaaaataaaaggactgagtctaagagtcctgtaaattgcttagattctgttaataactggactccttatcaggaactcagagtaaactggccacaggaaaatttgcctcacaagaaactcaatagaattaaaaggagaggattcagtgttcttaagtacaagtgaaagtcatgggactggaccgcttagcttcatgggctgagcctcttcacctttgtgctctaagaggaaaaaacagtggagctttctgagttttgtgtgtgcccctgtgttttggtttttaagagagagaacgcattcatactctgttgtctttgcaagtagatagaagtgataggacagggactgggtgaagtctgaggcatttaaatacagtgtaaaacagtgcagagagcagccctccccattttcctatcgcccacaccttttgttccttttcctccctccacatcttgta

SEQ ID NO: 38913 - DNA, 1027 bp, Homo sapiens
tagctggaattggagatacaagccaccacgctcagtgttttttgttttgttttgttttgttttttaaagagatgggatattgctttgtttcccaggctggtcttgaattcatgggctcaaatgatcctcttgtctcagcctcccaagcagccggaattataggtgcaagccactgcacctggctgcttgacatttttatagactcatactaaaaagtttattcattgaatgagtactgtgtgcatagggttaaatttatctgacgtttgttataatttaaacaggagtgttgataaaactgtgtaaaatgaattagcatatacttgccattatgtttttatcttaataattgttatgtagtttctatgaaaagttcagttacttaacatttccatgcttttttgtgtttgctttatttaaccttaaaagagtgattgaagtaatagttttgttaggtcattagattggtgatctccccttttgtatagtcaaatttaatttcattgtttaagattgaaaactagtgcaaattctagtttgatcacaggaccacagttaaaggtgcattcacatatctcatataagatacctattttcactgtattaatcatttgcattaatcaataaattttaacttttaaaagatttgatggttaaaaagatgatggaaggaattatttctctaaaactaaggaaatccttgctctgggaagctgtgttgagaagagttctaagctctgctgcctgtgtcagtgttctctggaaagacctctcttggaaggatgctgtgatgtggagtcaggaggtcaggacccagccctaccctccctaccacctgccagctgtgtggccttgagtgagccaacaactttgccaggagtcatttgccttatctttaaaataaaagatcactaccatgtcctgggttgtttaagtgagattatgtagtattagtagggtgcctcccaccacaggtcctcagtacattgaggtttctttccctgcctcctgcctccttgcaaggaaa

SEQ ID NO: 38914 - DNA, 1051 bp, Homo sapiens
ccatacccattctgcatatttcagagtgaaatgtcctttcgggacaatcttattaaatcactaatctgaaattttatgttccctagttggccatgccagtattttggttagggttttaggtgatttttatatccactgtaaacttggatataacttaccattaaccagatacttaaaaccagggtattttcctaaggtttaacattggaagtggtatgtgagctgagccttgaagggtgacaccaagttttttgacacgaaaaggttggatgagctagctaaagggcttgttttttatcctgtagggcaggagtggttgtagatgccctctcatgtgctgacatactgattgatggtggcttctaaggtctctcctgagtctagtaggaggcaggcttcctaactgtcatggacaccaggcaggcaggtaggggaatgaagcaagatttggcagcgcagctgctgtgagtttgctctccagtggcttggaaatgggaagttaaggattctgatcttatgtgagaccattttcagactgtcctagtctgccctcacatatccctggaatggacacatacaggctggtcagggctttcttggggcactgaggtgggagaagctggaggcctgggcagggtagtggaactgagagtgagaagccccctacacttggatctcttgcgtatcacacgagactcatttattgatgactgcctagctggctcataatactgatggctgaatgggggtatgaaaactggtcctcaagagtatccagtcttattggaggaataatgcaaaaacaaacaaacaaaaaaggataaaataaaagaaacaaaagcccaggtggtaaattttccagtcttcttggagaagtaacacagaaaaaaaggtaaaataaaagaaacaaaagcccaggtagtcattttgcagtagagctcagtgactaagggcagagtaccttgcagaggtgttcagtattttggcttccctgggccacactggaagaattgtcttggggcacacataaaatacactaacactaacagta

SEQ ID NO: 38915 - DNA, 1049 bp, Homo sapiens
acctccttaggagcttactggctgaaatcgagcaagttctgtaacctctctctgcctccatttttcacaggtaaatcctagtcgaggattaagttgaagctatgtatattaagtgcttagcatagttcctagcaaaaagtaaatttaaaatgatctgttactattagtggtggtggcggtgtggtgatcaccagcaacagtcagagggtggtggaccaaggaggaagcagacagcattcttaagagagatggaaattgccctctacattatagaggacccatctgagaccatctcccagttcagttctgtaggaaaggcaggtaagattgagaataagggttgtgtaattttcgggtgccttcttcctctggggctcttaagatctgagcacagtggattcaagtaaggtaaggaaagactaccagtagggagaggtctggtagttaggggtgtcagtttagcgggaggttttttgtttgctatttttttctttttgtcttagacactatgttgaacttttttggagttgtgaagtcaaaggatgataatattgtaagcaaatattctcttttcagaaaggattaggagcaggtaaaaactttagttagctgatatttttgctttatagtaaaacctctccggcagaattattttataatcttttttttaacacctttttttttctgacaggagatattaagtaagaaaggtatctactttgtatgtgttgttctctggctttttatgaataaagtattacttgtctttaagcatctctgataggaatttagataataagccagtgaaatatttttcctccataaattcctgtggccttgatggtgaacctgtgatcaaaatattagaaatactgactctgaaattgattcagatacatttgcttggttatataaattctgtacttttggccctgaaatagaaaaagcctacttgaagctttggggaccttcttactacttccaggtcatcctcgaaggtcttaaaatgtttttaaacatgaccagttcttttctactatattggtcta

SEQ ID NO: 38916 - DNA, 1075 bp, Homo sapiens
aactctgctgccctttcttcctattttctctctttgccaccaagggttgttgtactccttctcaaccagtcattaccgaaaggctattaattaattgattagaatgcaaaaaataatcttgggctttgggttcctttattgcctttcattccatagggagttttttctttttgtttaacatgtataaatgtctaagcctatttattgtagacattttatagtagtttttctaaaatgtattaaattatactgctttcttaaactaagtctggaacttactttatcatcatgaaccatcagtgttttccaaatcaactggttttcagaagactgaggtggttaggattgtgagtacatttactcatattcatttgagtgtgttttatgtagatgggcacctggggaaatagtggcaagcaagacagacactgtctctgcatgttggaatttagtctgtaaagtctgaatggtgatgatctggaccagcatagtgtggaaggtactggtctgtgttctggatgatttaggttaccatgccatctccagataaatggagtattgctgtttagggccctgacttatacacttggtcatttccacctctggtctacagttgcctaccccgcaatccatatgcaattctgcatatggctttattttctaggaggtggagggaggaaaagaggtgaggatttgcgtgaagacaagctagtgttggtccaggttttttctgctttctcaattatcctataatctttgaaaacacattggtttttttttctctcttgacatttttcccccctttcctctcgtgaggactttaaagcaaatcccaggcttcagatatttcacttctgtatacttcagtgtgcacagaataacatgggcatatgcttacctgaccagggtcattatcacacctaactgtaggtactgtattttgttgtataacctaatgcccattgtataattttaaaaatttctcccttgtacaaaataactgttctttatggttttgttagaatcaggattcacatgtgacatttggatattatgtctcttaatcaagggccat

SEQ ID NO: 38917 - DNA, 1061 bp, Homo sapiens
ttcttgaaatccaggttgacccaaaacaagaagtgtcaatagcctcatcataatatagcctcttagctataaatgtattaagtccctatccttaatggcctccacatgagaacttctaaaacttcagggccaggaggattactgttagccctgccagtcggcaacattagaagatgatagaacccagcacacatacaagtcattcactgaaaagcacttttaaagtgcctgatgacacatacatcagggtaggtatagaatataggcacataaaagtctttcttgttaggtgtttctattgcattatcttaacatgaacagaaacctctaattaccattattaatgcttggaattttataatttttaaaaaatctaatttatactaaagttgagagagagtgtgtgtatacacacagagataacatgcaggagggcatgtcagtaaaattaattcctaaaaatagaattgttgagttatcaggtaggattaggtttggctaatggaaaacaaatttaatagtgaattattctcatgtaaaagaagtctagggcttgtgtggccactgtaagaagtgattgatgctcagactcctcttattctctgccctctcatctcagcaagtggctttcatcctcagggtctcctcatggtccatccgaatggaggccaaaaggaggaaaaacagcacgaatgaagagactcatctctcacctgagtagctgcctttaaatagtcttgcatggaactcttccacttccatgtcattctattttcaaagctaagtcacatagccacatctaacttcgaagaaggctgaggaatgtagtctttttgtctgggcccagctaaaaattggcattgtgtgagtaatgaataagagaagaatggagtagtctgttctactaagtcaaaggttgtgtgcagtatcaacagatagtgataaacagtccttcaaaaactttgcacccactttaacactttcaccaaccaatccaaatttttttttcccaaatcttaattaaaaacaaaatgtcctctactgctgtatttgaattgtgt

SEQ ID NO: 38918 - DNA, 1040 bp, Homo sapiens
aggtgtcatttctaaaaaattagtgttagcagatgggcagatgtggctccaacaaggcttgcttcatggcttatcatttttccacattttccatccctttcataagcctagggaccacatgctgaacatttaattgaatcacacagattttgtagtctttaaagcttcttattccttggtcacttgttagtggtgcctccctccttggtcagtttggtgacttcagaaggaaatacacagtgcagtggtgagagcttcacttttgaagttagcctcaggcttgatttctagcaccaccacccactagacaaattgcttaacctttctgcacctcagtttcctcctgacaggcttgtttagaaaataaaatgagatcaaatttgtcaagcacagagcattggccctggtaggcaccacatacatgaatttccttcagattgtaggtgaagtagacttgatttgggatttctcttgttacctaggtgcttgtgtagaggagactttagaaccagaatgtgttatttgtggttttgagtgtgcctgggactctgagccaactgaattaccaagtaatgggggccccatggcatcccatgacaggtggagagccggctcttcaccctggatggacctgaaatgcctgctaaggccttgctccaccgagtagcacacaccctatcagtttgcccttctttccatctcttattctagagaccttaaagcctacttgttggtatatattttcaggtttttggaaattgggctgtttaattgaagttaataccagtgatgagacttttcaacctgagaacaacctagatgctacttcacattttgcagtggaagcttacttccatcttcactcatgtaggacattctttggtctcaatgttttatcacatctcatgttaaagtataattcaggtctattttgtggctcctgcccccttcccattaattcaatggttaaacagatacaattttttgaccccctactatgtaccaggccctctgccgggtgctaaagctatagtaaaaca

SEQ ID NO: 38919 - DNA, 1068 bp, Homo sapiens
gtcatagaaaggttaggtaaaaattctcatcggttcttcattcacagaagtagttaagaaaaggtagacgttgtgcctctatactagtggaggaggggaccatgagaaaataaaatagccctccaccaggtgattaattacccttagagagccggggaagtttgttgcaaagtgcaggggacagaggagtgtggtagtaaattccaagtgtgaacttcaatatgggcaatataattacagaaaggccagtaattaggggcctttcaatatgggcaatataattacagaaaggccaggaatttgaggaaaactactatcagtgagcttatctattcccagcatctcttggacatgaaatcatctcccttccccctagatatgaaaactgccatttaacatgtcattttattctcaaagagggtcatgcatatatgtgtctttttgaattaggatggattttttttaacctttgaaattgaggcagctttaaaaaatgaggagttggccagcacggtggctcatgcctataatcctagcactttgggaggccaacgtgggaggatctcttgagtccaggagtttgagaccagcctgggtaacgtggaaaaccccatctgtacaaaaaatacaacaattaactgggcttggtggcatgcgcctgtagtcccagttacaggtgcttcaggatcgcttcagcccaggaggttgaggctgcaccactgcattccagcatgggcagcagagtgagaccttgtctcaaaaaaataaaataaaaaatgaatgaggagtctgatttactatatcatctgggtgctcggttttggaccattctggttcatactctgtattttcttttctccctgcagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgc

SEQ ID NO: 38920 - DNA, 1024 bp, Homo sapiens
agtggtgtaaaaagcaagggaattcaaagctgtaaaaacttgagccttgtttaaccctctgccatgatgaaggacttaacaagggtctcctatggtgagctcactccagctcacgggtggttgcagaaaggggaatgttaagagtgttgtgatgctaaagcctctcaactttctcaggcctaagagacccctaatggaactcagatatctgatttcagtcatttaatagcccttgagatggtgaaaagactgtaatggaagctaagtagggtggtagtacttccatgccagccagctcagttccataccagaacttgggctagtggagatttgacttcagaaatgtagatatttggcctttagaagactagtttgtcttcctttaaggagaagaatatggaagatttgtctttagaaatgtagatgtttggcttttaaaagaataaatggtttgtcttcctttaaaaataggcttttaaagacacaagtaagttttaatttgagtgtaattgtaaggaggccactttctagttcgttggaaaatatgtgttcagaagacaatgtagtatcagtttttgtctgatttttcaagtgttggtttcccttttggttgaacagcagatctttctcgtatatgtgtaattctaaaggattgtacagaaaattaagggagatctaaatacttagatttttaaagtttatctggtgaactctgattttggtgatgataataaatgactgcattgaggataatgcatttcattgttatatcctaatgaagctttagggtcatcttcgcctcagaatattttgggggaggttgttttgagaagataacttcttcagctaaaaatgaaaagtcaccaaattttcctgaaagtagactagctcagtatgaccacagagcatttaaagaaccatccaaaggacagtgggggctgtgaggggatctagtttctggtttaggatttccatttttgcttagaatccattgttctttcagcagccaggagcacatgcaacc

SEQ ID NO: 38921 - DNA, 1048 bp, Homo sapiens
aatcccagcactttgggaggccgagacgggtggatcatgaggtcaggagatcgagacggtgaaaccccgtctctactaaaaatacaaaaaaattagccgggcgtggtggcgggcgcctgtagtcccagctactcggagaggctgaggcaggagaatggcgtgaacccaggaggcggagcttgcagtgagctgagactgcgccactgcactgcagcctgggtgacagagcaagactccgtctcaaaaaataaaaaaaataaaaactaaataaacttgaaccctaacattttgtctgtgaaatggacctggtgaagtctatgttatgatacagagctagaaagaaatagtggtgtactagtgtggcatcagcaggctgcagtattggaagccatttggaatttacgtgtaggctacttcccaaaaggagtaaatctttgatgcttgtttgactgatgtttgaatgctgtgattctagtatgtctttaaaatttatgttggggataggactaattctaaccaaatacaggtaatatagactgtatcgtgttttttattgatgtagatatttctgttttagggaatgtaacatctgataaatatgaatctgttatgaattacctggagaatatattctgctatttgtacctatgactatagtcttcggttatagtatgctagcctgaagaattctgcatcttcagggatctttattcttaccttttaaaaaaagccgaaagtctgaactgtcattcagggagagaatgttgggatctttttagtgtcgatgagcgcgagagaaaattgatatggccataaaaaggggttttctttgcagaggctggtacactggctacatacgctgttttttcctggaaagcagtgacatttagcatgaaggctgctcttcctgggcctgttggttttataaaatgcacctgttttcacctctggccagcctgctaagcatggagacagagcctgagtggctcctccttcaagcagttgtatttataaacagctttctggaaggtctcttctgtccagagag

SEQ ID NO: 38922 - DNA, 1106 bp, Homo sapiens
gtttctcggaatactagatcctcaagatagtcatagatcctcaagatagtgaaatggaaaatggattctgtggtcaaataagtttaagaaataccatgttaaacaaagagaaattgcattatttccaagagaacttctcagagccttaaaggttaatacacattatgaactttttagggtaggatatgttatgcagtgtttcctaaatgtgtttgatatcttgaatcaaatcctttttcttcaagaaaccatagcaccagtgttctaaggaacccccttaagaaatgctgtcctagagttttgctgaaaggagtcagcacccccttggagacagggcttctttgcccttctcctccctttcttgctgagttttttgtatgaccttgtcatatatctagtgtttctcagccatatccatgcatgggctagctgcccggcaaagtggtaggcccgtgttggtagaagtgctcaagaaaggcctgaaatcattaagcacagttcatctgttgagtacctgctgggcacaggggatagaagtgggtaaaaagggtccctcccttaaagaatgcgtggcctagtggagaaagtggtggcagtggcgatgacagtttgtcgtagagccaaagactgccttcctcacaaggttggagcagaggtgcatgtggtgtggcagcctgatgtgcctggttttctgggacacccctgcattcaggggttctgttccattatcacatggtctattccacaaaaacacagaccctaagacttgaggagctccatactaacaggtcagagttcaggctgaatccagatgctggtttcttttaaaagctctgcagagcactttatgtttgatttctagagctggtgagttcatcacggttggacatgagccgcccacttcagcacactgtccctggggctcagctctgagggagctgtggattaaaaaagcctcccctgcagcccactccaagttaagtgagatcctgtgggatggcagaggagctgtgggacttgcagcagaaggctgcctttttcatggctgtgtgtcctgcagtcaagtccctcatctctcagtttcagtttgcttatttataaaatga

SEQ ID NO: 38923 - DNA, 1138 bp, Homo sapiens
taagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatc

SEQ ID NO: 38924 - DNA, 1048 bp, Homo sapiens
cactggggcatggggccctggactcttaacaccttccccaggtaatggttgccaactctaggtagaggactagtagccaaattcctatactaatacacatgacacaacatgacacgactgtgcactacactacactacacaccacattactgtatatactacgctgcacataacactgtacactacaccacagctccctgtgctacacagtgtcatgctgtcccctaccacactatgcgatacgactgggcttcctcctcagttaaatgctctactttctcattgatccatttttttttaattttctaaaagtagtttattttttaattttttttttaaagtgttttaatttacatacagtgaacttcacaccttttggtatccagttgcatgaggtttaacaaatgcatagagttgtgtaactgccaccacagccaagatacagaacagttccatcccgtcttccagattcctttgtgctccccggttctggtcactcccttcctgcacacttacctctggtaaccactgatctgttctccaaccctggagttttgagggttccagaatgtaatataaatggaatcacacagtccatagcctttcgaatctgactcctttcacttagcataaggcattcgagattcatccatgttagtgcatgtaggagtatttaattcctttttattgttgatattctgttgtataaatgtaccatggttgtttatccattccccaaccaagggacatttgtgttgtttctgggttttggtgataaactcaatgatccaaatttaatgaactgattcctttctctgggagaggagaatctcgtatattggccatgtgataaaaggagtaggtggtgggtcaaagaaaatggcctacacatggtttctgccatgggccacctatttaacagtccagggtcagccatggaggacccatatttgaccttatgacaaacttgctggtcttccaaaaatcataaaacaaccaggtcttcacaatgctgcagcgcctatcttttacaaataaaacaaagggc

SEQ ID NO: 38925 - DNA, 1092 bp, Homo sapiens
accttctcagaccttgagcaagaaacagatttcactaaaagtgagtcttttaattcagaaagatgtactcaatatttaattaaagatatgagatctaacgatgtaggcaggctgcgggagcagggagtatgccctgtgtaaggactccattcaagatccagatcaagaagtgagggggaagatggagctgaggatgacacacactcctggttacatgtgagccagctagtttgtgtatgtgtgtgttttgggggaggggcttgatacattagaatttaaggaacccagcatgtgaaagggcttttgtgtgcatcacagcgacctgctccacacaaaccaagggaacatatactcccaggtcagcaaaggtaatggatttggtgattgcaagtttaagaaaacagactaaaatttaagctacagaatacctccgttcgctctctctatggatccttattcagcgttaataaataaatggctctgtttaaagataaatactattaagataggaaccaacgtgggacttgagcttagatatataaggaacatagcaaaaaaaagatgaaggaagtggatcacagaaggtattaccttccaaaaacatggaaagagttcaaacaattttccatagtctcagagaaattatagataatgtgatcattctcttaaaaaaaaaaaagaaagggttcaggcatggtggctcacgcctgtaatcccaacactttgggaggccgaggcgggcagatcatgaggtcaggagatcaagaccatcctggctaacatggtgaaaccctgtctctactaaaaatacaaaaaaaaattagctgggcatagtgacaggcacctgtagtcccagctactcgggaggttgaggcaggagaatggcgtgaacccgggaggcagagctttcagtgagccgagatcatgccactgcactccagcctaggcgatggagtgagactccctctcaaaaaaaaaaaaaaaggaaaaaagcactgttctttgggttataagaatttaaatgagagattctaagcccatataaggagatgaaaaataagcttacagtacgcaaaaaagaaatgaaagaaa

SEQ ID NO: 38926 - DNA, 1050 bp, Homo sapiens
ttataaaacaggatatattgtcctaggttaaaagtaactgataaaatcttctcaccaactcttggcaaaatagattagattttagtattgtagtgattatttgtttcatctttattatgccagatactgtatacatcaagttaccattaaaataatagtgtatttttagttaaaaaaaattttgtgggaaatattctttcttgctgtgggtagaaaataaaggtagaaatatccagtgaaatgctacaggccaaatccaaaaatataaaatactagtaaaaacaaccataccacaaatacaactttcaaaacaaatgcaggatcaagcaaactgaacaaattgcacagtgcaattctatacaattttttcctctttatttctatcactcaatacatatccttctccttggagagaagaaggttttcagaggatttagaagggattttcaagagttacagatttcatcactgttatatttagcacagacctcagatttgctcaaactgacagagcattacctgcaatatagacacaaaaacactgtgaaacaatagttaacagttttcttcattttgcttcagtttgccaaatttatattctaaagcagtttccaatattttctgtgactatcatcatgaacaacacttcttttctcttcaaatactacttaaaccatttgatggttgtagttccctaaaaaaggaattaaagtagaacagtttgctttgtcattatcattaataatctccttcacccaccattttaggagacactttattttcttttttagagataggattttgctctgttacccaggcagtaatggggtgatcatggctcacagcagcctcgaactcttgggctcaagtggttctcccacctcagcctcctgagtaggtaggactacaggcatgccaccatgactgtcttaatattttgacatttttgtacagatggggtcttgttatgttgcccaggctacatggactcaagtgaactcccgcctcagcctccaaaagtgttgggattacaggtgtgagccaccttgc

SEQ ID NO: 38927 - DNA, 1025 bp, Homo sapiens
aaaagtctccaaaacttagtcgactttttcaaaagattcagtcatttgcttaaaattagtttgcttttaaaaagttattatttgagaaaagtcgaggtttgaacggccatcagtggactgataatcggtgtagattttaattctttacattgcagaattgcattgcactaaattctaaaaatttcgtcttgctaggcactgagtatacaacaatgaaaaagacagtcttactagttagaggaactagttgttagacatacggttacaataatacatgatatcactgggatgtctagaaggagatgacttagcccaatcttggaaagtcagggaaatcttcatcccaggggaaatgaagaccaaaagaacagcatatgctaaggcccagagtgagagatagggtactttcaggaaacgtcagtaagccaaatcatgcatacttggcggtgtggggtgggacgggaagggtgctttttgtgtattgatgcacttagaagctacaaagagacaggtattgtgaattctttacatcgtttctgtaagtgagctatttttgaatagatgcatagttctgatgaattggtctaatttcaaaagccttgttacattctgacacttctagtttgaatctgaattttaaaaagggaataacttatgagtgtgattgaaaaagcaaaacaaaaaccattccgttttcatctcctttttgggatcttcattctctatccagcccataaagggtcgggtagtttcttaaggctgggtgcctttttatgccgtagttaaatatgatctcatgtatacccatggcttcaccaacacctatgactctcaaatgaatagctccattcagcttcacctctcagctttcacaatatctcttggatatttcttcttggatatctcaaaagcatctcaaactcaacatacctaaaaccaaatgcatagttatctcttatgaatctaattctttttcagtgttccttatttcagcaaaggacactactatccatctacttgtgaaa

SEQ ID NO: 38928 - DNA, 1033 bp, Homo sapiens
gtttttgctcttgttgcccaggctggagtgcagtggcgctatctcggcttattgcaagctccgcctcccaggttcaagtgattctcctgcctcagcctcctgagtagctgggactacagacacccgccaccatgcccggctaatttttgtatttttagtagagacagggtttcaccatgttgggcaggatggtctcgatctcctgacctcgtgatccacccgcctcggcctcccaaagtgctgggattacaggcgtgagccaccgtgcccaacaatgggtacttttatttagtagagtatgggagacagcgagtatggatgcagcactcttttactgtgttctttgtccagattgttctagcctgtctttaactcctcttcttgcaggtctttgctcaaataatcattttctcagaggtgtccctgatctaattaaatactcttcttgtaaatagacctattgcaccgtaaaccttgagttgctcttatgttaccaattagttttgcagttgtgccatgatttgattaaagtgtgtttatttcagtagagcttaagcacacaagaggaactactgtgcttgtttttgttgatcatcttatctctacctctgagtacagtgcctggtacctagtacaaacttaataaatgtgtgacgcaagaataaaggaatgaatgaatggaagaatgatataatgccacagaactttcaaaggtatggcatatttatctatcatttacaaaaacacaaagtaattaatggatggacgagggtacattataataaaaacattttagaaagttcgtcctaaaaaaaacaaagccgggcacagtggcttatgcctataatcctagcactttgggaggctgaggtgggccgatcacttgaggtcaggagtttgagaccagctcggccaagatggtgaaaccccgtctctactgaaaatacaaaaattagccaggcgtggtggtgggcgcctgtaattccagctacttgggaggctgaggcaggagaatcgcttgaacccaggaggc

SEQ ID NO: 38929 - DNA, 1040 bp, Homo sapiens
acgtgttcactcagcaggggcaggagaaaagaactagataatgagtaatggagagccctatatgccctgaggaggtctttattctgcagtcactgaagagtttgaagcattgaagtaacatggctggattttaattttaggtagatcactctaggggcacagtaaaaaatagttttagtgaaacataattagtagtaggaaaatcacttcaaaaggctacgtaatgggaccaataaatgatgagggcctaggctgggacacctaatcagtggtggtaaggatgggagaggataggtgagtcaagaagtgttttacgtgttgacctcctcaggacttgagaatggggagtaggaggatgatcctattaagtgagattacaaatataggaagaaaaactgttttgaggcaaagatggtgctttaagttttggatatacgtttgaggtgcctttaggacattcaagtagacatgaactctgttaaaatgcagagaaatggtagtcagtacttgacaaaaaaatattatcttaggcagaagtaaagaacaaataaatgagtgcaaactccaaagtgatattgtctcttaagaagggctgggcctggagaaggcattaggtgtaaaaattaggtttgtgcaggagcagtataaagttataagtaggttatgtggggaatcaagcatttcacttgaaaagtgatatactgtttatagattacctattggagacattaggattatagtatgatacaatgttaagaaacactggatataatgtagtttttgatagttcaaaaaagattttttgattttgtggtttctcagtatcatgcacatcagtgattttactgacaaaaatttggatgaaatatccaaaatataaagatttctggatatcaataataggcaacatgtgttgagtgcttactgtgcactaagctctattctagtacttcatgttgattcattacatataattgtcttaaacaggtagtcatattattcccattttatagataggaggaacgtttaagaaacctact

SEQ ID NO: 38930 - DNA, 1042 bp, Homo sapiens
gacacttacccaggcccctactaccatccttcttcagaatttgcttactcttattgtagacacacttctaataaactcaatgtcattgttacacatttctttgctcattccttcagtgatcttcaaactttaatttatataagaatcagttggataattatcaaaatgatatatttatgggccgtatccctagaatttctgtttccatggaccttggtggggcctaggaatctgcatgtttattaaaaataaaaattctcagggtattcttacctaagtgattgaaggaccacacttagactgcatactctatatctaactcagtactcatggcttcagctgccatctatgtatattgatgacttccaaacccttatctttgtttttattattattattattatctactgactgagctagctggggccaaatccttatctttaaacaattcttgaatgtcaaactcatctataaaattggcatgtctctattaaagacagaatacactccgaactaggatacctgggttcaaatcccagctcagccccttaatagctgcatgaccctgggcaagttacttaacttctcagatgccttatgtaaaaagaagttaatacctcatagtgttgccttcatgattcagtggctcaatcaatgcatgtaaacttctttgaccagtgcctcacatgtagcaagctcaatataaatgttagctgttttttaaaaaatgttatttcacaagcacctcaattatgtctaaaataatgttttataccacctccactgctttcaaaatctgttttctaccttggttacaactttatttcattcttccctgtcacgagttttccttgttctggtcataagttctatgaatttgacatcctaattttctctagtttttctcttcctttccataggattagtagcaggaaatacctaaatagatccacttctggccaggcatggtggttcacacctgtaatctcagtactttgggaggccaaggcgggcagatcacctgatgacaggagttcaagat

SEQ ID NO: 38931 - DNA, 1035 bp, Homo sapiens
taagttgtggatgtttcagggactgcctggggttgtatttttcatctctgaatgtttaatgaatgaaacttgattgctttgttgtttcttatttgctataggttgggaaaccaattagaaaggagtgttctgctagaaacaggtaggtagacagcaagggaagaggtagcaagagatgaaaagacagaaaacagagtctaggatagtctggaactttccagtgaaggggtaaacaatacaagtatcacacggggtccctaagtatcattgtgcataattaaaatgctatgatgctatccttgagtcatcctaaaggttaaattgtgttgaatatactctgtctaaaaggaaggaaagcagtttaaacactttaggagtctttcttttaaaactagtcgaaataaattttggtactgaactaggcaagctttagttatttatcattgtccaatagctcattcctccttaggcagcctgactaatcagtgaagtcccacaattaattctgactattaagtctgctcaacctgtggaaaaaaaaatgtaaaggcctagaaagtggatttgtagcaactaatctgagtgccattagtttttaaatgctatatatatatatatacatatatatatatatattttttttttaaccagtttctgaactctgtctgtctttactaagtttaccatcaaccattctaaagagaaaagggtgtggtggcacacacctgctgctactcgggaggctgaggtgggaggattgcatgagcctaggagtttgaagctagtctaggcaacacggtgagaacctgtcttgactgattgattgattgattgattgattgatagacgggtggatagagatgtttaaagttcaacaaaaataaggatagtatacttttatccttataaatataataaacattataagaatgttgaaaccctttcaaaatcacttattttttaacttagaattttttgaagaaatattaccagtaatattttcaaatcctaagaattatgctttacttaaataaa

SEQ ID NO: 38932 - DNA, 1050 bp, Homo sapiens
agtattttaacgtttaaaatagaaatgtaggaggatcttaaaattgaattaggaaaacattttattactccaggcatattttaagctgtgcaaattcttttctgagatgctgatatcacctacttttaaaatcttctataataatggttgctgttaataaataaactagttttgtggaataaactataagaaataataatgcaaatcaatgtgccagctacagatatcatgtaaagaggaataaatataatttatttatctcatttataaaaacaaaatggtaatctctagcaagcatctttctaatttgatataaactatatgacagttaaaactctgaacttatctgaagcatgaagatattaatatagttgaatataagtcacagtagtatagaatactattatctttcaggtctgacatcaggtaaaccattaggttataattatcctggttcttaatactgcatcatggacaaagaaacagtaaatatgtgtgatttgactaaaacggaatacctcaagaactgagaaaaaaagcctataactttaaacctaaattgccatgttaattagtagaaattatattttaatgttcttattcatatttatactcttatgctccccagactgtacattgtctttaagtcctttcatttgtaaatattttattaaattaaaattgtggttattacctttctcagtcttagaaaccactaaatacaataatagatatagtgtttttacaagatatattagagagaaaatgtgcgcctcttcaaagtgttagtcattatttttcattttttgaagaatatgcattacttgtacatttttctggctcagtaacaaaaatatactgcttatttttcttatgttactttgattgtaagtgttcagaaactttcacttaaaatatcaacaaaattttttttcaacagctcttattttagccttaaaaactcttcaggaaaaaattcatcgtttagagctggagagaacacaagctgaagataacctgaacattctttccagagaagcagcacagtat

SEQ ID NO: 38933 - DNA, 1038 bp, Homo sapiens
gtgtgtttgtttatgtacatgtttcttaagatatttatattgtgttttgaattctcagaaattgtattattcttgttccattggcattacttgccaaattcagggttgctattttatttttatcctttctaggcccagcttcagagggaaaaagaacaagatcagatgaagctgtatgcaaaacttgaaaagcttgatgtcttagaaaaagagtgtttcagacttacaacaactcagaaaactgctgaggtaagctttctttgaagtgatgacaacaggaatgaatctttagtgttaagcataattggtattttatgtgaatgtagagtaaatcttagatttataaaacttcatttacaactttttataatccagatatgaattctcacctatagagtgaaaagttaatgcgttctgtcacagtatgaatgagctgtcttttgatgtgaaattgtaattttgacttctaatatggcaggatattttcatttgtcagatactttacctaaagggtattgaaaaattgtctttcaccacttgtagtcaaattaagcctataccagttcccctcttcatcctttttccctccaaatcttttccattttatagggttttctcacagtcgtacttcccctaggaagtcctccttgaactctccaacactcaggaagttctccctttgaaatagtactgtcctcctattctgaaccacaccacagatgtaagacataatacttacatatataaggttatatgtatatatggtgcctgtcaagttatttccttgctttgttgttttgttgttttatgaatattgctctttttttcttttcatacaatacaggttgggtgtccttaatccaaaaatccaaaatctgatatactccaaaatccaaaactttttgaacactaataataatgttcagaagaaatgttcactggagcatataggattttgaatttttggattagggataccgaaccagtaatgaaaatattccaaaatctaaaatatctctggttccaaacacttaagat

SEQ ID NO: 38934 - DNA, 1030 bp, Homo sapiens
ccaatactgtactctcagaacagacagtcactctccaacccagaaggacacctctcccaggctggccctcagagggcgccttcttcctctttctgacacacacacacacacacaccgccttctccctctgtcacacacacacacacacacacacacacctccccatcccagttatcctgcccgcctttccttcaggtcacctgggctgtgggccatgctcttgaaggcactgtggaagtggctgaggtaggcaatgaggcccagtgggtcactccctgctaccacggcctgtgcagacaccaccggtgtgatgcccagctcattctctgccacctttagtgcccaagcagttgcttccagagctcccagcccctgcagctctgagggttccctgtgggatgtcagggagaaaagccaactagagacaagaacctagccccactgaggggaggaagggcagcaggaggggagggacagcaagcagcagctggggtacaagaaggcttgaaggtaggtgtgtagtctctgctacccagtgcccaacccagtgacactactcctggctttgggggcctgtgccattcacaaagctctccactatctgaatgcattagagtctcacaagactgtcggcagatgcagggaagcacactgtctctaggattcaactggatatgctaactcctacactgagatcatgagagagaggtgggtctgccagggactcacagcaggccaggctgcagccggtacaccagggcacacagagctagcccatcagcccaggaggaagacaaatcggagacgtggactcccgggtacccagctgtctgctcctggcaccagcgtagcagctcctcctgggtgcctgccgaccctgggaaagaaggctgtgctgtgcccaaggccccctctgcccatcccaggcatatagggagcccagctgctgcatgtgggggttctgtaggggaggaggagtcagggacccacctctactagggcaccagcctaaagctgactatcagcagct

SEQ ID NO: 38935 - DNA, 1047 bp, Homo sapiens
tattattaattctctcgtgtaatgcattgaaagggcagagaaagtttagcttttatgaatcaaatctaagtgtggtatagtgtataaacaaatactcttaacagatcatgttttgagaaaaaaatggtctttattaactgctattcagaaccattacagtcttttaagctattatcttataaacatacttttaatttttcacttcatgtaagttttgtaaaactcattgctgtttaatacatttatctggatatgctaaaattatgtttgatgaaattaatttattcatagagaaaaggcctgacatcataataactgccacctattggaagtatttgtaatacactaggcttattctaggccccttacgtgccttattaattcatttcgtccttaaaacaaccacgtggtacaggtgagggagcagaggtgccgtgctccctaagtaacactcttgattgtgcctgaccctgctgatgagaggcagagccaggagttggatccaggaactttgacctcatagccctgtgctcaaccgctacttcctgccacctcttgactttatttatatatttgtaacatgtcctcaatttccttgtcattttcttttctctcaagaactctcacaagtcagaaaagggatttctttgactttttacagaatcaacacaatgttctggacatgaaaggaatgatatccactgaaaatggcaatgctattaaccaagcatgttactttgaagttaaaaacagaagttaacttaaaaatgagttgaatgtcagccaatttccatatctttctgataccaaccttttttttaattgatacaaaatattttgtgtatttatggactgatacagacttttatttttcaggggtatttgggatctgtagtgagccttatatgaaatatgtatggaatggtgaacttctggatataattaaaagtactgtgcatcgtgactggcttttgtatattattcatgggttctgtgggcagtcaagtatcctttctgaagaaaaagtaagatacatattactaaact

SEQ ID NO: 38936 - DNA, 1050 bp, Homo sapiens
gttctaatactgtattgttaagggaataatgacaataaaaaaggtctgcacgtattcagttcagatgcaaccatcgtaggcctaactacattttctgtctgagattggttgactctgtggagggaacccatggatgtggggggctgacaataattaatactccagtgcatctgaaacatgtgagaaatatgactaatatgcagatgttctgaaaagtcagctatcttagagttatgcagtgctttgaggaattataaaatgtctaatgttgtggagggtgagccatttctataatatatgaaatgcggtacatgtttaatgtagagacaaaaatagcaaagcacctccacccaagtagaaggcagcactcatcacgggaagtcaattcttgataagaagacgaagtggagcaaggttcaggaaacgctttgccctctttgtcttttttgcccatactcctttttctgttcatcgctaggaaataacaacagcaaaaatgcagccatccttccatcagccgtgttctgtcctttgagtgctccgtctctgtttgcaatagacaacttgagttttgagtggatgtgtgatttggtagacagattgagtgaggcactgggttttgatcctggcttaaaatagcaacattgttcttaaaattatatcaacagtgaaaattgttacagctggtgctttaaaatatcagaattttgcagctatattatttacttttgaatattcaaaggataatcagacatgttattactgcctctaaaattattctttattatgtccttatatacttctgtaagtacctcaaaaccctattttttccttttgtccattaggcattatttgaatctcactcctttcatttcactttggtcttcagaattgaattttgatattcttctagtcttcctcacctcctgtataatttcatgtaattgtcatttctttccctctctcccatttatttaaaccagctgtttcctatctgacttgtattattagagattaatttgtttttttctagtctattctctgctactt

SEQ ID NO: 38937 - DNA, 1020 bp, Homo sapiens
agcataggagacacagtctctacaaaatttttttttttcaattagttgagcatgatgcacacctgtagtcccagctacttggaggctgaagttggaggatcacttgagtccaggagttccaggatgcagtgagctatgattgcaccattgcgttccagcctgggcgacagagtgagaccctgtctctttataaaaaaagaaaaaagaaatgttatgcaaaatcacttgtgtagtagttttcctttacttgttaggggtctgtggctctaaagaggttgactaacaacccactaacactattacactatggacagacaatgcatacagcagattcttcacacagagatgatacgaaggttgctcaaacaacatttcctctccatcccacgaaatgtcagatttgatataagcatttcaaaaagattttgtttccctagttgattttaaatgcttttgagaaaaatttcagatatataatttaattttctccgatatataaataagcaaaatttattttcatcctaaactgatttaacactgttcttaattcttatctaattatttcatttgatgtattcagctgtgctcaatagctacccctttttgtttctacagtagttatctcattaaattcatgacaattgaaaagtaatctccatgattgaaaacagcacaatctaattttgatgccaacaatagtgccttaacaccatttcagtctcactattgtgaaattaattgtttttctttgtttctaagtgaaggcttgatcagggtgataatgaaaatggcaaatttttataagttacttcccatatgccagctgttctataaaaactcaccatgctctgctgctggattcggtttgccagtattttattgaggattttcgcctcgatgttcatcagggatattggcctgaaattttctttttttgttgtgtctctgccaggttttggtatcaagatgatgctggcctcataaaatgagttagggaggagtccctctttttctgttgtt

SEQ ID NO: 38938 - DNA, 1024 bp, Homo sapiens
accacaggtggacaccaccacacccagctaatttttgtatttttggtagagactgggttttgtcatgttgcccaggctggcctccaactcctgggctcaagcagtctgcccattttggctcccaaattgccgggattacaggtgtgagccactgcacctgccctgttactattctttaaggagataacattccctagtttttaacatttattaaagatcatacgggatgcccataaagtctggaaacttagataatgtgacttattaatgtaatattaataaagactttattatttattcatgagtgttttgaaatttgtggcatgctgtatcttatactgtgtttatcaatgatacaggaatggtatagataatggcgtggcatatctatgccatgaaataatacttttcttgcacaataagggaagagggaataaacttaactctacctagagtcattggaacaaggtcctcttgagataagtacttcgatgacacaaaatctcacattgactgatctgcctaaaaccactaattgaagctttgttctgaatttgattaatatggcatacaatcatctaagattccatctaatgaactggtgtttagaatgtcaccaagatgtttttaggtattaagcattaattatttcattgactcctagagttgggagatttcttggcctgccccctgtctgatatgtgagttccctttctgtttccctagggagagagagaggtaatctggcctatgcttgacaagttcttgtttgtcaactgttgaagaggcagttgttttggaacagttcacttacacaattcttcctcatgtcatgctgagatctgcttctctgtaatcttacctattaatcctagttaaagaccttaaaaacaagatttcctcatccacttgataatcttttaaatatttgaagttgagttcatacactttcaaaatctcttcttctactggttaaatagccccagtttcttcagctgttcctcatatgctgtggtttcaaggc

SEQ ID NO: 38939 - DNA, 1041 bp, Homo sapiens
cttttgtgacttgtcttctcacttttccctgttgtttacaaacaattatttatgtagtctgtgcttgtcaaattattcctttatgtatcgggttcctgttgcttgtttgagaaatccttaactcatagtcatgaaaatattctcttgtattatctcttgaaagcttttcacatttaagtcattaatccatatgaaattaacttttgtctatagtgcgaacattcttaataatatggcttgataggtgatagggcagttcccttgcccttttttgttggctcttcttggccctgtaattctatatacagtttagaattaagttggaaagttctgctaatacccagttgggattttgtttgggagtacattgagtcataggtcaacttggagataatgttatgtccgttcatttgtttaggcctttttttagttttgtttttttttttctcccaaagtttgtaattgtctctgtatcaaaatcttgtacagttttattggaggtatttctcggtggatcttatttttatgctgttaataaacagtattgtatttttcatttatttaactttctaacttaactactatgtaagtactttctactacttacatagccatatcagctgcaaatatgacagtattttttctttcttttaatcattatttcttttatttattgttcttgccttgccatgcttactaccgcctccaggaagatctaaaataaaaataaaaaggatgtaccaggcaaattttaaccaagaaaaagctagcactgtttgtgttaacatcaataaaaatagactttaaagcagaaagcattactggagacaaaagagtcacttcatcatgatagaaggttcagttcacaaagagatataaaacaatgtaagctcaaaatatttcagcaaaaattgacagaactacaaagagaaatggacaaatatacaattacagtgagagatttttatatctctcaataattgatagaacaagtaaaaacatatcagtaatgatacagaatatgtgaacaacaaaattagt

SEQ ID NO: 38940 - DNA, 1005 bp, Homo sapiens
taagaaccctttttactttgtactttaatcagcccaaattgttttactgctccagtgtggcttttaaaatcatggccaaagttaaactttgaaggacaaaatattcccttgtgtagatgatttagtgccatccattttgtggacatgtaacattcattgaacaactattggtagtacactgccacattgtaactgttgtagataaagcaagttaagcaagaactgaaaaatatgttgatttaactaaggtcccgtgataaccttcgttggaacatttttcagtgaccactcaagtggttaggttatttaccaggatgtttaaaaaagcctgaaatagtaggtgttccttgaatcacctaaaatcaacagcctagcaaagagagtatcatggacggagtccggtcggtggggacatggggccagccccagagaccccagggaaggataatcggtcatctagaagaataaagcgtgacatgttttactcaaatgacgtgattaagtgcatagcctctggaataacaagatttgaattcaaacagcatttaatagctgtgtgagctgtttcctcatctgtaaaatggagacaataatggtacatagctcatggaagttgtgaagaataaataagttaatatgttatatgtagtacgtaaactgttatctttaacactttaaagacaggatccctctatagcccaggctggagtgcagtggcaggatcatggctcactgcagccttgacctcctgggctctattaagatgtgaataaactaaaagtaggttaaaagatgaacagatggaattaaacaaatctgtttataaagcataataaacatagggacataaaaacgattaagagaatgaaaggcttaaatgtccaaagagagcattagtattgatgctaaagacaaggataacaagataaggatatgagggagaaaaaaatcctggaaaaatagctttccaaaactaatgcaagaagaaatggagaacccaaaaca

SEQ ID NO: 38941 - DNA, 1046 bp, Homo sapiens
ctgaattcactgccgcaggaaggcaccctcagaatctaacttctggtcagtctagctttactcaagaatgatctggttttaggatgccttttacctaaagactgcttactacctggggtagaggcaccctgatgaatgtactgtaatgagagcctctaaaacagacctaaaaatatgaggtaagagcagaattgagaagctgcagtgactttggataaattacctgaactctgaaaccagctggttttacattaggaagtaatgagtaatctaatgacctggaagcttttcaaataaaaatttgcaggcatcatcctcagaaagtgtctgacctaactgggtatgggaatagcatctatgtattgagttttcaggtgattagagcataaccctgcactaatgggatccttctgtatttaagttcttggtcttttttttttttggacagtctcagtcacccaggttcgagtgcagtggtgccatctcagctcactgcaacctccgcctcccaggttcaaatgattctcctgcctcagcctccctaatagtgggtactacaggtatgcaccacgatgcctggctaatttttgtatttttagtaaaagacagggtttcgccatgttggctaggctggtcttgaactcctgacttcaagtgattgagccatcgcccctggtccctttgtccattttttaatcactttttgttgagttgtgtgtaggtgtgtcttttgctttggatattgaccccttatgaggtgacttgcaagtattttattctgtaggttgtcttttcactcgtttcttttgatgtatagaaatgtttacattttaggttttcaagttccatttgtctgtttttgattttattgtatgtcatatccaagaaatcattgccaaatgtaatgccctgaagcatttaccctatgtattcttctaggagttttattcgctgttaatgtttaggttgttgatccattttgagttaatttttgtttatgatgtaaggtaaaagtccaacttaattttgtttgcatgtggacatcc

SEQ ID NO: 38942 - DNA, 1053 bp, Homo sapiens
aacatttagtgtaacgtggatgtttctaggacataggttttgaagcctcaccggacagttcaaggtgtttgccgtcttttcctcccaattggtaaagaaggacctcttaattagaagttcaggcaaagggaaagttagcttctctatacaaatacagttgtctaattggtatataaaagctcatcaccttttttgtagttgcagagttaatttattccataaatacttttaatgcttatagtatatattgtgatgggccttgctgggggatactggactaaacagcccctccccccctttttttttctgaggcggagtctcagtctgtccaggctggagtgcattggcgcaatctcctctcactgcaacctctgccgcccaggttcaagcgattttcttgcctcagcctcccaagtagctggtattacaggcgcctgccactgtgcccggctaatttttgtatttttagtagagacggggtttcatcatcttggccaggctggtcttgaactcctgacgtggtgatccacctcggccgcctaaagtgctgggattacaggtgtgagccactgtgcctggcctctctcttttttttttttaaactaagtttatattatgaatatacgaatgtttatcaaaatgcttaccatgtgccaagccctggggatgttttgtatactagaaaaggaaaagaataatgtgttacttgcttccttgagatcctaatatttaaaagtactagccaaaattgtaaatgataattaaattggttgattgcaccctcagtagtacattagtattgttataatattgtgacttttttcaactgcagtgagagtagcatgtttgtctccaagagacgtttcattttgaagacatgtggtaccaccctcttgctgaaagcactggttcccctgttgaagcttgctagggattacagtgggtttgactcaattcaagtaagtaagcaaacatttaaatatttttcaggcataaatgttagcgttcttatcctgtaatatgcgaagtaaataaatttatatacttactgcc

SEQ ID NO: 38943 - DNA, 1071 bp, Homo sapiens
catttttagtaataattgttgctggactcttctgcgtggggactaaattttatttttcattctgtaacttttaagttcagggtaacaagtgctagtttgttacataggtaaacttgtgtcatgggggtttgtcgtacacagtatttcgtcacccaggtgttaagcctagtacccattagttatttttcctggtcctctcccttctcccaccctgggactaaattttggactcaattgaagtttatttgtcaaacccttgttaaactcggtctttttccccccccaggagagtggaattcgtgacctgataccaggttctgtcattgatgccacaatgttcaatccttgtgggtattcgatgaatggaatgaaatcggatgtgagtagttatatattgcttcaataattatttaaatgtgaatagtctttccattcttaacactgtgaactttttctctcagggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcaggtaattttatattttattattaatcaggttatttgatttttaaaatcttaaaggaaatgagacagtgaggcctaagatgtattctgagatagcacatataccagccactcagatatccagaagtaatattgtttgaggttactggtagctgagaagctttgtttcattagacctgtgtcagtccttgttttctgtctagccaaactgatgggttcctcctgtcttgctattgacaggcctctggtgggaggaaccataagatgccctggcccctccagcacataagaaggcagctaaaataactcagatgtcttagtttcattaagataaaagtctgtcacttaactgttttggttgaaaatacttctctggattgcaaacactaacggttatttaattttttcccccagagttctaaatgtcgcacagtgcttgcttcgccccagaagattga

SEQ ID NO: 38944 - DNA, 1640 bp, Homo sapiens
caagcagtcttgctgcagcttcccaagtagctgggaatgcagggttctgccatcacacttggctttgtcattttctttatttggcaacattttagttccacagtcaaatatgtaataagctgaaaaatcttatgaaaatgtatattctgatctttctcagaatatgcttccgttagaaaatatttcctcaattttcattaaaaacagatggtgttcctagaaaagcaaaatattacatatctgtgcaatatgtaattcacaagattcatttgccaaaaacaggtgagtgaatttgggggttcattagtaagcagtcaccaagtttctgtcacagacacataactggaaatgtgattttattctcctggatggacaattgtgatggattttttgggttccgggcttcaggctttgcaatctcatcttctttgcccttcctcttgtcataatggaagaggtgctgctaatttgggttccatcctttcctgctttcagagactgtcctgtgatttcctaaaacatttccattagtttgtttgaattttctgattttcttcccttagggccctccacaggcctctgtgctagtgccttgaatgatggcaagtgtacaaaaaaaattttttttctttttaagacgtttttgttctgtcacccaggctggagtgcaatggcgtgatctcggctcactgcaacctccacctcccaggttcaagtgattctcatgcctcagtcacccaagtaactgggactacagggatgtgccaccacacccggctaatttttgtatttttagtagagacaaagtttcaccatgttggccaggctggtcttgaacttctgtcctcaagcaatacgcccacctttgcctcccagcatgttggaattacaggcatgagccactgcacctggtcaagtgtccaaattcttactccaaaactgaactttgggctgggcgccatggctcacacctgtaatctcaaaagtttgggagtctgaggtgggaggattgcttgagcctaggagtttgaggccagtctgagcaacatagtgagaccctgtctctacaataaataaaaggaaattgaggctgtaatgagctgtgattgtaccactgtactctagcccgagcaaaagtgaaaccctgtctcaaaaacaaaaatcttgacttgtgcaatagccacagttttcctggattctcaatagaaccctatggtgacatttgaaacacaaagctagaggtatgtgacttcaagatggtaagaaaaccatgaaacagacttgtcaagggatgtctgataaattgttggatatctggcctaggggcccagacaatagattttagatttgtaaacatcttaatatggagggttttgtgtgtgtgtgtatgtttgagacggagtctcgctgtgtcaccaggctggagtgcagaggcgccatcttggctcactgtaacctctacctcctgggttcaagtgattctcctgcgtcaacctcctaagtagctgggataacaggcacgcaccaccacgcctggatgattttttgtaattttagtaaagatggggtttcatcatgttggccaggctagtctggaactcctgacctcagatgatccgcccacctcggcctcccacagt

SEQ ID NO: 38945 - DNA, 1050 bp, Homo sapiens
gaggccaaggcaggtggatcacctgagattgggagttcaagaccagcctgaccaacatggagaaaccccgtctctactaaaaatacaaaaaaaattagccgggcgtgatggcacatgcctgtaatcccagctactaaggcggctgaggcaggatagtcacttgaccccgggaggcagaggtttcagtgagccgagatcacgccattgcactccagcctgggcaacaagggtgaaactccggctcaaaaaaaaaaatatttaaaacttgagttgcatttaaaggacataatgaattttcaaaaggaagtttgttatagatctatttttataaagcaagtttgagttttaaaaatatgactcttccttcagatgtttttactttttttttttttttgaagcttgggtcttggtatgttgcccaggctggtctcaaactcctgagctcaagcaatcctcctgcctcagtctcccaagtagatgggactacaggtgtacaccatcacacacaattggatacttttaaaacaaggaacactacctgaattattgctaacagatgtcagttgctttcctagagttaatcagattcttatttgagtgtatagtcaaccaaaactaaatgaaaaaactggttagtgaaatcaaagattgtttatagtaaatggagaatgatgaatggactttcagtatgtgatgatattggtttcttccttaagaaaatcatcaggggccagacacagtagctcacgcctgtaatcccagcactttgggaggccaaggcaggaggatcgcttgagcctaggagttcgagaccagcttggaaaacgtagcgagaccctgtctctatttaaaaaataaaaataaaaaaacttaatatgattatgttttcttgataggaacccattgtttattttgaaatagggtctggctctgttgcctaggctggagtgcattggaatgatctctgctcactgcagtctccacctcccagactcaagccattctcccatgtcagaagcagggactgcaggtgcacgacacgatgcctgg

SEQ ID NO: 38946 - DNA, 1049 bp, Homo sapiens
tagactttggtaattatataattgctttttttttttttttttagaacagtaaatgtcctgagggaacaaaacccatgctgatatttgctggcgatgatttcgatgtaacagaagattatagaagactaaaaagtcttcttattggtaagtattttagtatttattatcttcagggtagctcaggaagacagtctcagactctcactggtggcactttgctactttaggtttgtaacttcttttttctcttattttaaaaataatatttatatacttaaaataatggagtgcttcacaaatttgcatgccatccttgcgcagggaccatgctaatcttctctgtatggttccagttttagtatatgcgctgccgaagcgagcacaacttctttttcctcctttttttggacctttctcttttttttttcccttaccagcagcaggaaagcacctaagtatctcgggagagttaaagcagctgttgtactgtgtagatgattatttctggatgtgttagtaacttaggtattacttgtatagtgttttataaaattcctgcacccatctcctgtcattcctagcatcatttaaaattaaatttagaaagttgagggattaaaatttcaagattgtttgtatcaccgacttccaactcaaaaaccttaattagtttttctgagttgaatatacaaggcctttcacaatatataaccaatgtagcttggccttcttgatctcctattgccttctttttttccattagaaagggtttattgccaatatattattcacatttctattgtgtattctgatattgctcttatttatccagtttctactattcatttaagtgtcagatcatcaagtttcttttccgggaagccctcagtgaccttcctggctccttttttttttttttttttaaagatagagtcttgctctgttgcccaggctggagcacaatggtgtgatctcggcccactgcaacctccacctcccgggttcaagcgattctcctgcctaagcctcccgagtagctgggattacag

SEQ ID NO: 38947 - DNA, 1016 bp, Homo sapiens
aaacaaacaggggctctgagaagttaaatgagagctattaagtaggtaaggccaagttgaaacccaacgcttccaaagcctgagcttttcttcccctactgtccatcttgcctgtggtaaacatattcccatgatcccttctagaatctttataggttcttatccatattttccatgaattaaattcatacatgaaagacaatgactaatatttccttctctcaatattatatatcccaaattatcaagggtatttttctttctttctttctttctttctttctttctttttttttttgagacatagtctcactctgttgccctggcatgatctcagctcactgcaacctccacctcccagggtcaagcaattctcttccttagcctccttagtacctgggaccacaggtgcatgccaccacacccggctaattttttatatttttagtaaagactgggtttcaccatgttagccaggctggtcttgaactcctgacctcaagtgatctgcctgccctggcctcccaaaagtgctgagattataggtgtgatccaccgtgcctggtcaagggtatttttccagccaaaatgtcagccagattttcagctaagatttccattacttgtactccattgacctagattttctgcctttttctctttcccctaggtctcccatataattgtttattgtcagtgaggcagatacttacaatttgttataacagagagagcttttgtttgcatttgtttaaatgttttttgtattttaataagccccaccttctcattattttgtgcttccactagatggcaggaatgatcacataatgcagtggtgaggggaagggagtgaaaaccaaaaaggaatctggacagaagcagaaaggtagaagaggaacagattcagactgtagggcaccaagggaagttgagttttcagtataaatatgaagtaaaacaactgctctttggtttatgttgtgtgttcaaatgaaatatcagtagggagcaag

SEQ ID NO: 38948 - DNA, 1053 bp, Homo sapiens
aatgtatgaagggctttcatttaggaagttccttttttttttttttcttaattgaccagaaagaaaagttaactttttttcatgcaagatacccattttgttcattcttaatttgtttacatcatttttttttttttttctttttttgagacagggtctcactctgttgcccaggctggagtgcagtggcatgatcatggctcactgctgtagccttaactttctggtctcaagcaatcctcctacctcattcccctcagtagctgggaccacaggtacacgtcaccacgcccagctaattttttttatttcttgtagacatgaggtcttgctgcattgcttgggctggtctcagagtcctaggctcaagcagccctccagcctcagcctcccaaagttggaggtgtgagccaacatgcgtggcctattcttcccttcttaaatggtagcatattatatatatggttgtttaaaaaaatttggagtagaggaatttttaattctgattttcattatacaattgagaaaactgaggcctggacaggtgagtagcttttctaaggtcatgcatttaccaagtggcatattaaagttttgaacttaggtctctccaaagtacatgcttttatttcttatttgtttattttttgaaatggagtctcactctgtcacccaggctggagtgcaatggagcaatcttggctcactgcaacctccgcatcagctgttcaagcgattcttctgccccagcctcctgagtagctgggattacaggcattcaccaccatgcctggataatttttgtattttttgtagagacagagtttcgccatgttcgctaagctggtctcaagctcctggcctcaggtgatccactcatcttggcctcccaaagtgctgggattacaggcatgagccaccgtgcccagccatgcttttatttatacagtattattatactttaggttatcaagttcataaagttatttatcatacttcttggtcaaaatcctaacagtgtatataccacttgcatgacgtctttcccaacta

SEQ ID NO: 38949 - DNA, 1041 bp, Homo sapiens
gctgcaatcttggcactttgggaggccaaggcaggcggctgggaggtggaggttgtagctagccgagatcacgccactgcactccagcctgggcaacattgagcactgagtgaacgagactccgtctgcaatcccggcacctctggaggccgaggctggcagatcactcgcggttaggagctggagaccagcctggccaacacagtgaaaccccgtccccaccaaaaaaatacgaaaaccagtcaggcgtggcggcgcgcgcctgcagtcgcaggcactcggcaggctgaggcaggagaatcaggcagggaggttgcagtgagcggagatggcagcagtacagtccagcttcggctcggcatcagggggagaccggggagggggagggggagggagagggagagggagagggagagggcaattgtggttcttgagataagtgtgtgacttctcttttttaaggcgttggtactggctgacagagcccacagtttcctaaagaatacactgactcccacaaattgcctttctctgtacattgagtttagactttgctgtacattttgagctatggtgtggctggtgttgcagcctgagagctgacagcttggtgttgacagtgtcttctgtacagtagtgttgtttgtccaaccatttgtatctagcattttgtacatcgtttttattttgttttcttcacaatgaaaatacatgactgaccagctttatgtcctatgaatgtccaaatgaaacttaaatattcacctcttagctgataatttccatcttgggctcaactgtattaaatcagagacatttagttctttttctccatataattaataccaccgcttctgtttttctgttttcctctcactaaaaataaatgaggcaaaatgcagtaaaatacccaatgatcataagatgtaattagagactttatagtaatttttagctggttaagatcgaaagccccttaagtctcctgtttgagtttccatatgtgatttgggagcttctaagtatgtattatactataca

SEQ ID NO: 38950 - DNA, 1041 bp, Homo sapiens
ttgggctgggcgcagtggctcatgcctgtaatcccagccctttgggaggccaaggcaggtggatcacctgaggtcaggagattgagaccagcctggccaagatggtgaaaccccgtttctactaaaaatacaaaaaattagctgggcatggtggcggatgcgtgtaatcccagctattcgggaggctgaggcaggagaattgcttgaacctgggaggcagaggttgtagtgagccaagatggcgccactgtactccagcatgggcaacaagagtgaaactccgtctcaaaaaaaaaaaaaagaaaagaaaaaaagaaaaaagaaagagcaactttgttttaactctgctagatactggaaaacccatggaactaatgaagagcctagggctttttatttgttttgagattgtgccatttcactccagcctgggcaacaagagagaaactttgtctcacacacaaaaaaagtgtaaatcaaaacattaaaaattaagtagtttggaagtagattatcaaaaaggtcctgaaagggaggttctttggctataatctttaacgcaactctacactccctgtatggagacagatttctttttagatggttacagtcacaaagtagggttttcagtagcatttagggatgaatgaatcttgcagcacctctccatgtatcttgctagcccctctgaaacttcaggtcagttagtgcttcctcagaaattgttccccccacaccaagttttcacatttacagttatactgatatccacattgtactgttgtatgtgacacctagattataggaaattttggctatagttcagaaattaactgctatgttttgcctttacgctaaagagattttgttttgtttagtaggaaaagcggcctgcataactagccatttctgtatcttagaaaaatttttagtaacagtcctttgttgagctagttacagtgaacaaataatctggttcatggtcctatacatctttcactataagaaaaatacctgattgttatttacactggaagagag

SEQ ID NO: 38951 - DNA, 1035 bp, Homo sapiens
gtcaggtgggtctcaaactattgacctcaggtgatccacctgcctcggcctcccaaagtgctgggattatagatgtgagccaccatgtccagccacccatttaattttttgagcacaaaatatgtactgagagccacgcaagaaacaaattcgacttattccatgctcttgagaggtcatgaggggaaacaaaatgatacataagtaactctgagagaatatgctgcacatgctaaatcctgtgcaagtaagatataggattttagaggaagggagaatgacttctgattgagctgactagagaaggcttcagtttttgagttaggtgttacgagattgggagacttttctcagcatatctaacagaagagggtatccgaggtgagagtgtaaggcctgggcaagggttgggaggcagttctaatactgaatgttctgactgtggtttactatgtatttcaggttattttgtttaatctatccagtaatcctttcatgtaacaattatgatgtgtgtgttttaggtggggctactaaggctagtaagtagtgaggctggatttaaacttaagtctccagcttcgtggcccaggttctttatacttgactccacactgggcttattaagtgaatgacaaggagtttgatttgtcgagggccgaggatatgtagtgaaaggtcatagactataaggctggcaaagaatggtggagctggggaacggaagatctaaatgccaaggtaagcttggacattatttaatagaggcaatggggagatactgaggatttctgaagagggtttctaagtagtgctttaaaaagatctctgggttgcagaggcaagaaataggaggaacaccaattacaaagccccgaccgaaagccgagtgagatttgagggtcagccatggaaatgggaatgaagggacagatgtgagacatttcaaaggatagactgcaggaattctggcaaagaatgggttggacagtgatgaagaacacagaaacagcattgatgcctacatctggagcc

SEQ ID NO: 38952 - DNA, 1029 bp, Homo sapiens
gactggattgtgtagggtttgtaggccagggtaaagagcttggatttcttctgagtgtaggattttgagcaggggagtgatgtgtcttattttgggcgggcgctaggccaggtactgtgaaggaaataatggtatagaagaaatatgtctttcttgctagaatcttatgtgacatacaactagtggtggctgatcagcaattagaactgcagtgttcttgctggtgtactcctaatctgatcattggatgatatttatcacgtatttttgcagcagtcatctctaaagtggcattatggttctagttatctatcattggatctgtttgctctaacagtccgaaggggcatgaagggtggaaacagagtagagggaaatgggtgaaaaggctatttctaaacactagacacaaaatagggattaggaagtagtgggggttaggagaaaaagcaaaatcctgttgtgcatggagagggacattgttgaaactgtggcttcttgagattacatgagtgaacctgcgtggactgggtcgtcttccctattcaccaagctgaatccaggcccaatccaagattactgctgcctttgctctgaggctttagactgttagtagcttttctcgtctctactgaggccaaaaggggcagtgatacccttgaattttcttcttaaaacagggtttcatttccttggaagtttgtttctttgaatctttctgtcagtttaactgttatcatcaattggttagcattctaataataattataattatagtaaacatttattgagtgcttacgaagagccagttccaagcttttttatctccattattctgctactttccttctcattttacagatgaggaaaatgaggcacagagtggttaattaatctgtttgaggtcccgtagcaggtcagtgatgccagggttcaaacctacacttaactctacactagagactgttttcttaattatttcttcacaatcatatgtttaatgattacttattgattatttagtggtct

SEQ ID NO: 38953 - DNA, 1147 bp, Homo sapiens
tatgcggatgatttacttttagccgcccgttcagaaaccttgtgccatcaagccacccaagtgctcttaaatttcctcgccacctgtggctacaaggtttccaaaccaaaggctcagctctgctcacagcagagggctatttatccctaaatacttagggctaaaattatccaaaggcaccagggccctcagtgaggaatgtatccagcctatactggcttatccttatcccaaaaccctaaaacaactaagaaggttccttggcataataggcataacaggcataacaggtttctgctgaatatggattcccaagtacggcaaaatagccagaccattatatacactaattaaggaaactcagaaagccaatacccatttagtaagatggacacctgaagcagaggcagctttccaggccgtaaagaacaccctaacccaagccccagtgttaagcttgccagcggggcaagacttttctttctatgtcacagaaaaaataggaatagctctaggagtccttacacaggtccgagggaccagcttgcaacccatggcatacctgagtaaggaaattgatgtagtggcaaagggttggcctcattgtttacgggtagtggcggcagtagcagtcttagtatctgaagcagttaaaataatacaaggaagagatcttactgtgtgaacctctcatgatgtgaaccgcatactcactgctaaagaagactggtggctgtcagacaactgtttgcttaaatatcaggctctattacttgaagggccagtgctgtgactgcgcacttgtgcaactcttaacccagcgacatttcttccagacaatgaagaaaagatagaacagaactgtcaacaagtaattgctcaaacctacgccgcttgaggggaccttctagtggttcccttgactgatcccaacctcaacttgtatactgatgaaagttcctttgtagaaaaaggacttcgaaaagcagagtgtgtagtggtcagtgataatggaatacttgaaagtaatcctctgactccaggaactagtgctcagctggcagaactaatagccctcactcaggcactagaattaggagaaggaaaaagggcaaatatatatacagactctaagtatgcttaccta

SEQ ID NO: 38954 - DNA, 1009 bp, Homo sapiens
cctcccgcctcagcctcccaagtggttgggactacagacatgtgccaccaaatccagctaatttttaaattgtttttaatagaggtaagggtctcactatgttgcctaggccagtctcgaattccaggggctcaagggatccttttgccttgtcctcccagagtgctcggatttaaggtgggagccactatacccacccaacataattcaattatttaatatttcacatgttttagtattcctttgatagggatgtgatgtttgggtgaataataaagtaaatcaaagacatatatttgaaaattatgtagttattctaaaaaattaattatttacctttattttagcaaaatcagtgtgttagcataatcaagatattttggtattctagtaacaagatctagtcacagtaatgatgtaaagattaaaaaataaaatataataggaaccagtataaacaagtggaatttaaatttaaaatgcaataccagctgggtgcgatgcctcacgcctgtaatcccagcactttgggaggccaaggcaggcggatcacctggggtcaggagttcaagaccagcctgaccaacatggaaaaaccccatctctcccaaaaatacaaaataagttgggtgtggtggtgcatgcctgtaatcccagctacttgggaggcggaggcaggagaatcacttgaaccagggaggcagaggttgtgatgagccgagatcacaccattgcactccagtttgggcaacaagggcaaaactctgtctcaaaaacaaaaagaaacaaaaaacacagtaccatttacattagcacccctcaaaatgaaatacttaggtataaatccagcaaaataggtataagagatatataagtaaaactataaagctctgatgaaagaaataaaagaaccaaataaatggacagatattccatgttcatggataggaagactcagtaatgtcaagatgtcagtccttttcatctttatctatagattcagtacact

SEQ ID NO: 38955 - DNA, 1035 bp, Homo sapiens
agtctctacttcttcttcaatatcattttcttcaatatcaaatcaactcattttcttcaatatcaagtcaactgtagactgacagtgtcctacttcaagacttactgtaaagctacagtaatcagaacagtatggtattggtgaaagaatagacaaacagatcgatggaacagaatagagagcccagaaatagacccagacaaatacagttaatctttgacaaaggagcaaaggcaatagaatggaggaaagatacccttttcaacaaatgctgttggaataactggatgtccacatgtaaaaaaatgaatctagacacagaccttacacccttcacaaaaatgaacacaaaatggatcatcaacctagacatgaaacacaaaactatacaaatttctgctctgtgaaagacaatgtcaagagaatgagaagacttggaaaatatttgcaaaagacacatctgataaatgattcttatctaaaatatataggaactcttaaaactgaacaataaaaaagaaacctgattttaaaatgtgccaaacactctaatagatatctcatcaaagaagatatatagatggcaaataagcatatgcaaagatgctccacatcataggtcatcagaaaaatgcaaattaaaatgatgagattctactacacacttattagaatggccaaaatccaaaacactgacaacaccaagtgctggtgaggatgtgggacaacaggaactttcatttattgctggtgggaatgcaaaatggtatagccactttggaagacagtttgcagtttcttacaaaattaaacacactcatcatatgatccaacaattgcagtccttgatatttacccaaaggagttgaaaacttatattcacacagaaacctgcacatagttgcttacagcagctttattcataattgccaaaactttgaagcaaccaagatgtccttcaataggtaaatgaataaataaactgtagcatatccagaaatggagtactcagtgctaaaaaggaatgaggtatca

SEQ ID NO: 38956 - DNA, 1051 bp, Homo sapiens
ctgggcaacctggcaaaaccttgtttctacaaaaagtacaaaaattagccaggcatggtggtgcacacctgtggttctagctacttggaagattgaggtgggaaatttgcttgagcctgggctgtcgagatcacagtgagctgagattgcaccactgcactccagcctgggcagcggagtgagaccttttctcaaaaaaaaaaaaaaaaaaaggcaaaaaattaaattattagtatggtaaagtttcgtttggacttaatatgaaactcatttctagaaatgatgatcatttgcatagggcttaacttcctttgctaagaaaatagagtagtatactaggagacttccagagctgcatagagcttcagggtcatctaccaagacagacaatttgttgtcatcatcagtgttaaactctaaattattaagtgcttatgtgccagatactgaagtttatatacactttctctaatctttaataattctagaaaggtatgtgtttgatccattttcaagataagaaaactcattcagaggggaagtaacctgaccaagaatacgttgtagttgtagagctgggaatatgactcatgtctgttttttccatagcccattttcacttaggttccattagtttattatatattttagaaggacttacagacttgatttcctcagcgaagtcagattactcatttctttggcacagaattatgattatttgtatttaatatttctttcctgttggttttcatttttgagtttttatggaatctgacttctgattctcaatttttttattgtgaaatataacataccttcagaaaaaaagattaaacatatctatggttttataaatgattataaaataaatacccagtaactattatccaggtcagcaaatattctactagtgtatgagtcaatttccatggcaaaagaactaagcttaggcactatactcaaaaaaactaaaaataaaatttttctaaatgtgtattatatcaatggaataaatacaaatataacttaccatgtcataattcccccc

SEQ ID NO: 38957 - DNA, 1071 bp, Homo sapiens
tacacttctgggaaaatgggaattctattcagaggaatatctgagaaaagttactcaagatctaaatgaggaaagagaactatggttttataggaaattaggatttcaagtgctcaagaagtttatattgtttatttctatttcaaaggcaaaattcagctttgttatactgaaatacgaataattaatgtctagactggggttggtgcctcacgcctgtaatcccaccactttggggggctgatgcaggagttcaagaccagcgtgggcaacataaggagacttcatccctacctggggaaggaaaaaaaaaaaagaaggaagaagcagtgtctaaagtatctgcccctggcaacgtttgttcaaaagtgttcattatgtttcttccttttttcttttgtggctgaaaatgtatttacaattcaccgtaaatgataaaaatggcattggcacacatatttgtatgtttgtgaacttggatttttttctagcttacagtctacttttggagatttgtgcaatttttctttagttaagaaataagtataaatataaccgatttacggactatcaggctacatcctgatctgatagtccattttcatactattaggaaagtatagccgaaccaacttaaggtaagtttcctggaatatagatctgttgtgacaggattaactttaccatccaacctctttcatagcttctgtagtcaagagaacatttattgtgtcctttcttaaaaagatgagtagaaattctttttcttttttttcttttttccagacagggtcttgttaagttgctcaggctggcttcaagcaaccctcctgcctcagctaggattacaggtgcaagccaccacacccagctttaaaaaaaaattctctttggtactaccacatgaacacacctagagaaatcataactcagctttgctaatactagacatttaccaaaggaaaagtggtagatgactgtctagttatttttggttatatatttataatttgtaaattaatttcacatatattacttcatttgactttcacaataaaccagtaaagcaga

SEQ ID NO: 38958 - DNA, 2103 bp, Homo sapiens
tcctatcaaaaagggtttatatttcagatctgtttcctaaaaaaaaaaaaaagtctgatgtctgagatgtctgaatcagtcctgtggctgatctagaccccctacagagccacacttgttctcccttggtgacagctttttcccttctcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaatctacattttgaccatactaccctttcatgtccttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaaataaaaaaaaaaa

SEQ ID NO: 38959 - DNA, 1050 bp, Homo sapiens
atttacaatgcttactccatagccctgctacaagacttaaaatttccactgaaaattgcatagttcttgtattaagattcaaattctggctgggcgcagtggctcacgcttgtaatcccagcactttgggaggctgaggcaggcggattgcctgagctcaggagttcgcaaccagcctgggaaacacggtgaagctccatctctactaaaatacaaaaaaattagccaggcgtgtcggcatgcacctgtagtcccagctactcgggaagctgaggcaggagaagaatccaggaggcagaggttgcagtgaggcgagattgcgccactgcactccagcctgggcgacagagcgagactccatctcaaaaaaaaaaaaaaaaagtaaaagtacacacagtttaaaagtaaacatgtttacttcggataattctaatccttttagctgcatttaagaatattttaatttatacgaatgttacttgaaattggcctatgtccagatgacttttgatgttaaatcaatggaaaactgaatagaaaatatgacacgagatcggggagggggaaggcaacctatagcatgggtggctctgaggagttcctgctggtgcactttcatgccctttcttatgtaccttttgtcttactcttcttacattattcttatcctcatcattttttcatttccctttacttcctcctatccttcaaaaacctcctgaagagtccattaacatccatgcttagttccactggttgcatggctgtatttcctactgatccctgtagtttcactgaatggatccccacccaatttcgtgtatcctggtgaatggctttctctcagccttcgacttagttctaatgatctacattgaatttaaattacatgactgaaatatttaagggaagaaataaatttcatacaaattagtatcttttatgctaacatttaaaactgtatttaaatttttaaggtaaatgctttggggaaaaaaaaaaccattgccaagtctttagcatattttcagagagcgtaattttttactt

SEQ ID NO: 38960 - DNA, 1073 bp, Homo sapiens
cagagcatgattataaacatacgtggcaagatttctactaatatgctggaaattagctaatatttttaagaggcaaaatctcttgatctgaaattttagaaggctatagaagtgattttaaaatatgactaccatgctaaaatgtattttttataaaataaatattttgtacacgccgaatgtcagatacacaatatcagtgattctcagtgttccatgacacctagaattctttaagtgttgatattttggctcttactgaattatattttgggggatggggcctgggaatctgtattgttagcaacactacttgccaccccgtgattcttaagcaaaataaaattgagaatccttgtactatattataatcagtgtatccataacttttaaattataatattcctaactagaaaatggtaaaagcatcaaattaacagatttgcgatttctagaagagggtttctttccccttacctcttgaatcaacattatttactttaagaaaaggcagttgcaaccacaagtcaaatccttctagaactccaagaatgttcactcttgaagaaaaacatttgcagcatgaaattaggaatgttgtgttcattgcatgtaatttagttttaagttgatgctcaaattgaaaacctgacaatagccccctaattaaccactatcaaatgtgttttatatgtatattcttcctgaagtaagaaaaagttctggaattttgagtcagagaatgtgaatattaaaccatcatttagctaagtgctcacttattttttggaatttatttcctcatctgtgaaatggatagtaattcctgttttaacttctcagggatgttataaggctcaaatgagataatgtatgtgaaaatatagtaaaatgttcatatccagaagtctgattcattgagaaacagtaaaatcacttggaattgacttatctacatacagtatgagaaatgcaaaaattgaactctatacttaatatccttaatgctttttttttttttttttttgagacagagtctcactctgtcacccaggctggagtccagtggcaca

SEQ ID NO: 38961 - DNA, 1042 bp, Homo sapiens
tttttttttttttttttttttttttgagaatgattcttgctctgtcacccaggctggagtgcagtggtgcgatcttggctcactgcaagctctgcctcccgggttcacaccattctcctgcctcagcctcctgagtagctgggactatgggctcctgccaccagtttttttatttttgtagagatggagtctcccaatgttgcccaggctggtcttaaactcctaggctcaagggatcctcccagctgggcctcccaaagtgctgggatgataggcatgaaccaccattcccagcccatttcctttttccctttgcacagtaccagatatatggttggtactgcagaaataatttccccctgccctctacattgatcatttgatgaccaaatagtgtccgtctagccacttatttatgatttgtacaaaacattccgctttctgaggtagacagtgatattctgaagccatcagtaagagtaattttcagtttgttgaaagtgaacattctttgtgtaaaggtcagcctgtcaggaaatagcatgctactctgttcttttaagattatttttaaaacctttgaatatgtgtgtttttacactttaaaaaaaaaaaagtagtgagaaactatacctagtggtctcaccagatgttttcaaatcagaactggggcaatctagttgtaatttattttcacaaatttatgagaataagagctgatatttttcttgcttgaattagcaggtaatttcattctccattcctctttagtggggaaaatctagcctttggatgaaaatgtgaaccagaggttcttgccaagtctgcaaagcagtataaagattagttttatgaatgaaggaaaacactactcatttttcttaggaggctgcttacttctgcatttgtataacatgtttttagactgaaagctcatagagaaaagagaaggatcctcattctagaatatctgctcccctgtacttagcatattcatagtctttcaagacttaatttattaaagatgttaaagactttgaca

SEQ ID NO: 38962 - DNA, 1043 bp, Homo sapiens
tattaacaagccgtccaagtgattctgatgcacactgcagtttgaggaccaactgaactagagcttgaaatagagattaggagtagaaataaagatgtgtaagtcagatacataacagtcactcttgagagaatgaataaactccctagaagagtggaagagagaagatgagcccttgaagtaaatggaacaatcaaagaaataaaaactagtggagtacaataaaagcgggagaaatttaacagtggtatgaaatgacctatagtgtcaggtgctgtacagaggccagcatggatgaggatcatgccaaagctgtaagactgaccattaggagaattttggtgtcagttaaaagagaagtggtacagataagagtaaatgcaaaggaatacaagcaaaaactaaaggatactttttgcagcagtttgggaatacaacaaagggacttagaataatatggtcaggatgaggtttttcagggtagatgcatcatttaggttttgctgtataacaaacactctaaagtggcttaagacaataattattattatagctcacatgtctgagggttggctcctcccagctgggcttgctcatacatcagcagacctactgggagctttgctctaggctggacacttacctatcatcctccttctgtgactgtccagctcacttaggcatatctttctcatgaagatggaagaagtgttgaagagggcaaacagaggctgggcgcggtggctcacacctataatcccagcactttaggaggccgaggcgggcggatcacctgaggtcaggagttcgagaccagcctggccaaaatggtaaaaccccgtctctactaaaaatacaaaacgtagccgggtgtggtggcacatgcctgtagtcccagctgctcgggaggctgaggcaggagaatcacctgaacctgtttgcgccactgcactccagcctgggcgacagagtgagactctcccaaaaaaagaaaaaaaaattgggggtggcggcaaacacaaacacatggactccaaactgac

SEQ ID NO: 38963 - DNA, 1031 bp, Homo sapiens
agactactgcctaggacctcatttgtttccttgaaaactcctaggaaaatattgggaaaaatggcagatgattggtaatgatagaattgaggtaaaaaaaattaattgtgtatgatgggggaattggaagtaatttatatgcctatttataggagtttgcctaaaagcaaattccatgaggattaggactaacactgaccaacagtatgttcactgtactctcattatctactatagtgtaagtatttaatatttgttgattgaatgaataaatgtacatatacatttcagtcctgaagtaaaatgcagccattaaaaaagatgtcttctattagcagtctcactcatatgtatgtactcaaaaacctgaaattcaatgtttatatcaactttattcataactaccaaaaactggaaacaaccctattgtctatcaactggtaaacagatcaacgaacattcatataatgtacatccatagaatagaatactactgagcaataaaaaggaccaaattacaaatatatgcagaaaacatggatgaattgcagcagcattaggctgagtgaaagaagccaggctcaaaaagcaaatgtatgattccatttatgtagcattgtagaaaaggcaaaactgggctgggcccagtggctcacgcctgtaatcctagcactttgtagggggccaaggtgggcagatcacctaaggtcaggagtttgagaccagcctggccaacatggtgaaaccccatctctactaaaaatacaaaaattagctgggcatggtggcacacccctgtaatcccagctattctggagactgaggcaggagaattgcttgagcctgggagatggaggttgcagtgagccgagatcgtgccactgcactccagcctggccgacagagtgagactctgtctccaaaaaaaaccaaaaaaggcaaaactgtagggattgaaaatagttcagtgattgctggagaaggagcaagtgcctctaaactacaatcaggcacaaagacagtttgagggt

SEQ ID NO: 38964 - DNA, 1022 bp, Homo sapiens
atttaataatgtaattttaataatgtaaagatttaaataatgtaatttaatgtagttactagaaaattttaaattttatttgtggtttgtatttttggcttgtatcatattgctattggacagcactggtctagaataactgttaataggattttacttgtattagcttcacattgggtcttaaatcaacagcgtaatgcaggaaaaggattagcaccccattaaagaccaaattgacaacttctgtgtattaatatgaacatacctaggaattctcaaaatttataggtagaagttgagacaaatagaaataatagaattttgacctggaaaggaactttgatgtcatcaagttcaaaccccttgtcttacagaattatttatcaacctggcaaagatatatttggtacttaaggcattctaggtaagtattgaataggtatgtctgtgataggtgagtaaggtgagatgcctaccctggagaagctaagaaggattgtattagactgtaacagcacttactaggcatgctgacaggagtgctctcaaacacagaggcagaggcaaatacgggctcaaatttttgttttgttttgttttgagacagagtctcactttgtcgcccaggctggagtgcagtgacacgatctctgctcactgcaacccttcgcttcctggattgaagcgattctcctgccccaccctcccaagtagctgggattataggcacccatcaccacacctggctaatttttgtatttttagtagaaatggggtttctccatgttggccgggctggtctcaaattcctgacctcaagtgatccccccaacttggctggattacaggcgtgagccaccatgcctggccagactaaatttttttttaggaagaatcagagacgctccagcactttgggaggccaaggcaggcggatcacgaggtcaggagatggagaccatcttggctaacaaggtgaaaccccgtctctactaaaaatacaaaaaattagctgggcgtgg

SEQ ID NO: 38965 - DNA, 1048 bp, Homo sapiens
cttacacccagaccatactatggaagattcctagtggaaggaaatggaaataaacagtattaagtcataactgcgtaaaattaactgtactagtgtaatagttttgtagcaacctcctgttgctgttgcagtgagcttaagtgttgggagtatccatttaaaattctatgtgatgctaatcaatcatctctgagtgaacagttcgcctccagtaaattgcatatctcagtaaaaagtgatctctaggggttctcgagtattttttttttatcttgtttagttcaatgctataaaccttggatgtatgggaccatggggcccatatgaagtgccaccagtgatgctagaaatgctcccaataagcagagaaaagtcaagacattaccagaaaaggttgaattccttgatatgcaccatagattgaggtctgcagctgcaattgcctgccatttctagatgaatgaattcagcctaaagaccactgtaaaaagacacagtggctcatgactgtaatcccatgctttggaaggctgaggtgggaggatcacttgagtccaggagttcaagaccagcctgagcaacatagcaagactcctgtctctatggaaaataaaataaaataagtctcatgttaaaaaaaaaaaaaaaaaagccaagcatggaggtgtgcttgtagtacttgtagttcaggaggctgtgctgcagtgaactgtgattgcaccactgcactccagcctgggcaacagcaagatcctgtctcttaaataaaagaaaagggaacttgggaaggcattgctgcagctatgccagtgggcatgaaaactttacactttttgcaaaatacaaaatatgtattaatggactgtttatgttatgggtaaagcttcaggtcaatggtagactattagtagttaagtttcaggagaatcaaaagttatatgcagattttcagctgcatggtgtggggaccccccccccccgccgcccgcattgttcaagggtcaactgtactttaaaagaagtataccatgagaaaagtatgtatttt

SEQ ID NO: 38966 - DNA, 1078 bp, Homo sapiens
aaacatcttttgcttgtgacccatacaaaaccaggctgtgggttggatttggcctgtgggctggagccaccaattgctgttctaaagaattctttagggctactttagccatacttttgttattaaatactcctctgtcgagtcagagactattcagggtctgagattttaccctactttgaagccagtaaatgagcttgccacagtttaacagatgctggcagaagacatgagactcctaggtcagaaacagacaaccttattattcacagtacagcaaatagcatgggctttatgttctcttggttttccttgttctccaaaccaagacaatgaggacaatgtgagtgggtccaggtaaatgctacacatacagttggtctgtgtcacatctgaggagccccaagcttaggaaacccctaatcttataaggtaaccgctagtaaatctgccacactttgtcctggaagaagccattcactttatttttctggtcaggaaacaaatctgtcctctgtgctggagggtgacactatgccttccaaaggtgttggctagacaaacatcctttgaaagatagtctaggtcaaaatttgtcacaagacacacagaaatgccgtggagaattgttgcttagcacccacatgttcaagaggcatttccactggttgtaactcaaatgcttgtcagccctgtgaaagtgttgctgaggtctcagtgccccagtagttcttcctctgagagttgttctaatagttgttctctgcctggccttacatagtcccattttatggatgtacatcttagtattcacgtagactcaagatgatttttatgcagatttctggagctctgtctcttgacagctttctcttctcttgtggtgctctctttctcaaattgtggttgccctcctaagttcctgtctctctcttaagcccagcaaaaccactgtactctgcttaggttctccttctttgtatatcagtcgatagagtgcctccaggcagaaggctggaactcagttcatttttctttcccaagggatcacagtcctcctgtactacctgttgttcag

SEQ ID NO: 38967 - DNA, 1280 bp, Homo sapiens
atacctaattactacatatttgtacatatttaaggaactatataatgaaaattatttaagtcaacatggggaggggtttcaagagaacttttatcctttaaagaaaaagagatgtgagacacactaatcaatatggtggctctctttcagtctcagtgtttgctcaaccaaccctcttgacttttccttcttggctagctcacagagtgggctgtgttggagatgacagtgaaacctcatttcttggaaaagcagaatcagaggagaggatagcagtgttctacctgaattcaaatcttcctttttaataataagtataatatgaacacaatactgtctttcaagttactttttaaaatactttcaaatccattatcctatttttgaagccccattgtgaatctcttaagtaagtttcctttaaagtcaaacatcattggcagattttgatatgttatacctttaattattctagccagtgctgctaggagctttgctccttcgcaagatgttagaggaaagacatctcaaggtgctctgaatgttctgtgagtcagctgtggcctctcccaggccttattaagaaaataaactatgctgatgagctcccctgaaaaattagatggaggttttcagcttaaaactcatattgttgacctctcctaggctttctttttaaaatgaaagttttttttttgttgttaggatttgctgtttaactttttggaaataaggtaatagtcaaagtccccataatcattaactgtgggatagaaagcaagaaggaaagagcacgaaagaaaggaacatttaccgagtatttactagatgccagacagtattctagaagctttctattcttcatcttaccttattctaactatctccatgggagtcggttctgtcgtccccatatcattggctgaaattctgagaagtaaagtaatttgcgtaaggtcacccaacttgtaataagtaaactgaggttcaagcccacctttgtctggttccatagctacactgtgtgagtgagaaacgtgaaaacacctcacagactcagcttgggcagtgttttctgcaacagattttgtctggggaacttggacaatgccaatattcattcatagagtttctttgcccattccagcaaattatcattttctgctttctcgctcagttatttgtatacttagctgatggactcaacttcacacatttcccacaccctacttagcagagtacagaaatccatttgctctctcccagctggttccaacact

SEQ ID NO: 38968 - DNA, 1565 bp, Homo sapiens
actgttgacatataaatggaaatctgattttgaagaccctttaaagaagttgctaccatattagatagcatctttattattttcgttgccagtattcccacgagcattctgctgagatgaacaatcagatgacctcgtgtgagatttggaggagagaaggaaatggagagcatgcgtctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccgccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaattttaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttgcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgtgttttgtttgttttttagtttttgagacagagtctcactctgtcacccaggctggagtgcagtggcacaatcacggctcactgcagccatgacctcttgtgctcaggcagttctcctgcctcagcctc

SEQ ID NO: 38969 - DNA, 1048 bp, Homo sapiens
tcatcttctagcacaccattctctccttgctcactctgctaggccccactgacttgcttttggtatcttaatgacatcaagctccttgcttccttagctccttgcttccttgaccttctcatcctttaggtttcagctcagatgtctacttaaagagattctctggtcaacctgtctattaatgtctgttccaacaaccagttacttcccttatagcacttataatttgtcattctgtttctgacttctacttcttatccatctctccagtagactgtgaattccatgaaaacaaggacggtgtataactatttgctgaataaattgataagtggatggacaggttctgtttccaaatttcattgactcccttctttgcttccctcccaggccaaaaaaaaaaaaatggcttttccaaggcttcacattacaaagactctactcatgattaaggctcactcctttccccaggaagtagagaacagatttctttttattcattcaacaaatatttattgaacctcgatggccaggcacttggtgaacaaagataaataggatacagttcccttgggattagctcaaaataaatggagagagaaagagaaaatctatgtgtctgtgggtgtctgtttttaaacacaaacccacactagttagtgtgtgagaaggggagacatatgagtcgacagccacctacttgagaatccctgttcagaaatagcttccctgcggacttgtccccaatgcctacagttccatcaagagagttaattctgtaggagagggaaggtggatgatgtgatagacaaatgatttgctagcatggtaactcctcagttcagaggcagtgttaatcacaaagcaaaaatgaaaatcttgcacaatcacaaatgggcgcccaggactgtatgttatttgtcaatcctgtgatcttcttggcctgagtacacacgatcttcatgttactgagcttttaccatttggaatatgtaaaccaaatcctaaatgaggttttccatttatcagtcacaacatgcaacatttt

SEQ ID NO: 38970 - DNA, 1066 bp, Homo sapiens
atcagtcaatactgtagggggaaaaaactcaacaaaatagtagagaatatgaaaatattcatatgggctgggcgcagtggctcacgcctgtaattccagcactttgggaggccaaggcgggcagatcacctgaggtcaggagttcgggaccagcctggccaacatggcaaaaccctgtctctactacaaatacaaaaattagccaggtgtgatggtgggtgcctgtaatcccagctactcaggaggctgaggtaggacaatcgcttgaacccaggaggtggtttttgccgagatcacgccactgcactgcagcctgggtgacagaggaagactctgtctcaaaaaaaaaaaaaaaaaaagaaagaaaaagaaaatattcatatgtagtaatgagatgaatttttatgctgacaattgaataagggagtatttttgtacgattgagagtgtactacaaatcagagaccccaaccacacatgaggatccagttgagaagaaaacaaaggcagcagcacgtacctctggagggctgctgcctgccctactctgtgctctgttctgggacagacccagcactgcgcctctcccaccacatgaaagctccaggataagtagagccgttctcactctcaaagcctgctgcctggatacgcataccctcctggcaggagaaaaattatgtattctattaatttaaaatatttttcctttcaactctgcctggttggcagaatgcatatagaagtaagagtaaatggggatagcaattctgtctatagaaaatatgttcttagaattgcatcttaaaaacaatgaagctggccgggtgaggtggctctcacctgtaatctcagcactttgggaggctgaggcaggtggattgcttgagcccaggagttcaaaaccagcctggccaacatggcaaaacctcatgtctacaaaaaattagctgagtgtggtggcacacgcctgtagtcccagctactcgagaggctgaggtgggaggaacatctgagtccaggaggttggggctacagtgagccatgattgcacactgcacttcag

SEQ ID NO: 38971 - DNA, 1033 bp, Homo sapiens
gtttaatttttgttcacagcctcaacacccggggcggtggatcagtccgtttattcagattccacgggacgctgcgttggcatctctgttcaacaagccctttattctaatagaaaatgaacaatggcgttgagcaaagagaaaccccagagaaatagtcatgtcagggcacaattgaaactagatggttatacgctttgacaaaaatggcaaagctaaggtcacagacccaaccagtatttgttgaacgctgtatactccccaaattaacttgtaggctcgctgggaagattagaaagaaattaaggcatagatccagttccaagaagcttacaatctaattgaagacatacacgcgaaatacttaaagaattgtgtggcgttgactataagtgcaataggattcagtggttgaggatgtagatgagtatgtagaagtctgatagaagacacgagattaacactaggcatttagatgggtatttagatgggataggcaggagaagattaaaaagttaggcattatgacaattaccaactacttaaaattgtcaaacattaaaatatgtaaacttctattgatcaaattagaccagattttaattaagaactcaagtacttctttaatgaaattaatattttccacaaaaattctgaagaactacgaaactctaagaagtcttctttgtttaataaaaagttatatggtatgtgctatgaatatgtgctaatatgaactgtaatattcaatggattagaacactttattgtcccaccaagacacgtagtagttactattaaatttctctggtagccggtaggtttaaagttgcaatggattttatatcttttggtaataggcagctttcggtcagtaaatttttgtaggctggatttattcttaacttcttactgagtatggggtcagtggtagaggtaaagttgggcattttaggtcttgatgctaaagtcccaacgtctggggcttccaaaatttgcaagtcttggtccagtttgtaggcagtgatgtgaa

SEQ ID NO: 38972 - DNA, 1081 bp, Homo sapiens
ttgcctgtactgagaaagtcaactgctgcaaagataatgtgtattaatttagttcttttttgtgatacttacactagaaattcattttttcagatttctccctaaagccctttggctactcaggaaggccctgcgtgaaacttgccaaggattccatatgacaggtatccccccgactcccctgttgcctggcacatttatcttaggtgcccctgtgggcaggtcaggtgatacacccctcaccccactggagagtacttttgaaaggtaggaaatctgagtcttgctagctgaaaactctgactcagccttaactttcaaagtagaaatgcccatacaaatacagtgactttttgtttctgacagaatttaaacctcattgctatggtattaacggggatgctacggcaaccataaactactaactataattttccctgaaaacagctgccatggagctgtggaatattttccttagactttaaagcattgacatttcaaggaaaactcagccttcttggcacagtagagcttactcaaactaagatgtcttaaataaactatttgcacacatgaaaacttctataaatgtgtataaatgtattatcgtaaatgactcataccctcaaaaatgatataattttatataagttatattacatatcatactatggtaacctataaagggccgatgccttatgtgaaatacttaaaattttatgataaaaaatttaattggccatgatcatgtctgttaagtcactcagccaaaagtataagggcaagagcaccagtcttagaatcgggatcactgtgatataattatggctttgatttaacaaccgtgtcatcttaggtacatccaattggaaagctgctctttagagtgggtggatttcaattgttgatgttactgatactagtgctccaacccaaaagccctcttcattcattctctcaggaagaaaggcagcttgctgacttgctgtagttgagccacacacatagagttcaagtgatgttcagtggttgtctattagagacataattcagaattttaaaaaaaaatctaattaatagt

SEQ ID NO: 38973 - DNA, 1057 bp, Homo sapiens
caacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaa

SEQ ID NO: 38974 - DNA, 1043 bp, Homo sapiens
ctgctgataaagacatccctgagactgggtaatttataaagacaaagagatttaatggacttaccgttccacttggctggagaggcctcacaatcatggccgaaggtgaaaggcacatcttacatggtggcagacaagagagaacttgtgcaggaaaactcccctttataaaaccgttagatcttgtgagacttattcactatcatgaaaacagtacaggaaagacctgctcccatgattcagttacctcccaccgggtccctcccatgacacctgggaattgtgggagcttcaattcaagatgaaatcagagtggggacacagccaaagcatatcaaacagcttgtttgtttatagagaattaactgcatatcaaatatgtgagtcagacttaaagtcatagagaactgaccacagcaacccctgcatgaggctcagatttggaaagatctcttgttcctggcctcctcatatcatatatagttactttatcattacttttagctctgtggcttgcactaagtctcttggtctctgttgcttcctgaaaattgacaagaaatgaataatccaagtgatctaaccccttcaactctgtctgtctcacaatgcatccttctcctcaccttaacataggtattggcaaggttaaaggaaaaacagttggaaatctacattaagacatgatagagaacaatgtctgggttcactagctttctgggcttccacagagtctttccctttgtgtcctgcatgaaacggtggacacatctgctctcccatccccagccctgttctctggaaaatctgcctttgaattttatagtgcccagggcaaaagagctagacaatcctcatcttcccacctaactccaaggtttctagtgagaatcaaatgaaataacatgtacagaagtgctttgtaaggcaatataaacacaatccatatataggtatgaatataatgtttttcttaaaattctcacttcacatctccttttcttatttttgtctctctttctaatatgtgtgcatagaactgc

SEQ ID NO: 38975 - DNA, 1065 bp, Homo sapiens
gggcggtgctcgagggcgcgggaggcgggagaggctgccgcgccgtgtgccctggcagccgcagccccgccccgccgcgtccggcccggtcctgtcccgcagcgtcccgccagccagctccttgcacccttcgcggccgaggcgctccctggtgctccccgcgcagccatggctcagcacttctccctggccgcctgcgacgtggtcggattcgacctggaccacactctgtgtcgctacaacctgcccgagagcgccccggtgagtggcgcgggctccggggcgcactgcgcgcaacctccatggcggctggggcttgagtttcctccaggtttgggcaacggcggacgctgcccggggcctgcggcggccgagtcttgccgcagagcgcggcctccagcggcgagaaggggcggaagtgtgcagcctccgctccgcgccggtgccgtggggaccggcacatttacctcagccattagctaatgttgagagggatagggaagaacgaaggaggggcaaactgcgcaagaccgggctggggaatcggtgatttctagggccgaggaggggcggggtcagggggactagggctgtccttgaagatctcacgtcgtggaactttctctgcatgtctttctggacaccagctgattgtggacacagccacttgatttggtacttgcattttttttggctgcatttttctgtttgcacgatcaaccacccatcagtgtttaaactgcaatctgggagagatgcgtagtatatagtgtagtgtattgaaaggaacactagttgaaaagtcattaagatcttagccctagttttaccttctatcaagagaagaaaatacatatttattgcgcatcgactacgtgctccgtgcactttgaatacattccagtcctaccaacagtctgcgaagtttgggtcctcactgtgccctgagggagggggacatggagtatgcatgcttccagacctgtacactcaaattaattgccctccctccactattcctttggtttcccaattcccaaggaaactaattttgaaaagttacca

SEQ ID NO: 38976 - DNA, 1045 bp, Homo sapiens
aaaagtaggtactttgctgtgtatcttacttaggatttaatttaagcttaaatattattataaagttggttctgactacattttcagaagtccttttatttgtgcttctttcatggctataattgcccatattccaagctgtgctgttacactctcctttaccacgcctgccacgagggtcattctgtgagttccctagaattgaagtccagttttgctttttcatggcctgggcataagggttggtgacttgtaaccattagtgtagtagttatagacaggtgggcaaaatgtctgccggcagaaattttgttcttgttgcttaaggaacaaaactggctgacccagagtgagggcagagatatcaccaatcttgagcccagagttttacctttccaatcacagctttgcttggattacacaagattgcttctaaggaataaatagatgcctttatagtatgttacctcagtgacttgagccacattgtcctgattaaactaataggatgatggattcttaagagtagtatttttcagcttggaaaaaatgttgccttgtgattgacaaaaaaattgcttgcctttttaaaatgtaattcaagccatcaaaacaattttaaatattataaccaaaaacatgtcaagacaataaatagtaactgcagaatatttgttcaaactgcatatttctctgtcacctgcttctttccctcccaggagaaaattacaactttggggtgattttgtcatttttctatccctagtcatcagcccttgaccctgactcagattgcatgtggttttgtgggtacctcttcacagtcaacaatgagtggttgggtctgtgggaataaagatgcatcaccaatatagggacatatccatgacaactgtaaaagccacccatcactttattgtcctacttttttattaactttgaacaatgaaaagccttgaaagaatggttgagaacagcaaattgctgctttcaaattaattcagcctaaaaatctattgatgttattttattgcgtcgtaaataa

SEQ ID NO: 38977 - DNA, 1068 bp, Homo sapiens
aaataaaccagctaccttctttatacaattggcagttatttttagcttaaaatttttaaacttgattagttttgattagatcaagatttctggattacatgcagttatttgtgcaaaagcagcatctgagaaaaaaatttgtacacacaaaagttctgattttttgcaggtatatctttcaactatattttcaagtatatcctttctactacacttattggatattcttgttctacttttttcacagatcactttgttgtaataatttgggctaattcagaagttggaaagtaacaccaaagttaaatgcattttgttaaagagattattaagattatagaaagcaacaagcaacttgttaatagaacaaaatatacaattcaatttacctttactctttatggtgtagggaatgaagaactgtgtcttggtgttgggtagtgggccttttatgcctgtgggcatttggtatcgttcagcgtaaaacactccatgaaccaagttcaaggatactagcagcaaaaagggtatttgtggcagcatattctcagatggattctgaaaaacagaaaagaataactttatacagcattgttattaacctatttttttattctcatgtttcacagatgagttctttatacagttatctacttttttaacctatcctatatatttttaatatgtgccataaataaatgagagatcattttttagttatgtgaatatatgtcttagttatttttggaagctatactcaggtaatcaagtgaaaataaaatgatttacctaaaggaaaagaaacagaaattaggattggatgtctgtattaaataatctaggatctttgacatagcctgaaatatctaatagtttcaaaatacactgaaattcggattagggcaaatttttacaatatggttttattgggactatcatccacagactgatgcaaaaagaacttttggagtgcattttagtagaaacccattttttaaatcactttaatacttctaatacttgagaaaactcaagtatttaaatctttaaagtttctttccaagcaag

SEQ ID NO: 38978 - DNA, 1035 bp, Homo sapiens
aaaaaccattcttaggtagatggttatagctattttttttaagttttgtggggttttttttaaaagaagaaaatgaagcttattaagtggaatgactcatccaaggtcatttagctggtaggcggcagaactggggtttgaacccaagtttttcttccacaccacataacacttactataaattgctgttattatttgagtcaaatttcatttgtgaaatctcagatgtgacttactgttctgatatggcagtatctatctttcatattaataaacagataaaaatccatatgctgttatcatgagtttggaaaacaaagtgttatcacagataacaataagctattcttggccttagttccaacggtttggaatctgttactcagaacaagaagccctcagattcagatacgaaacagaatatttagtcacaaatgcaaaaatctgaaaccccaattttgagccatttctgtacaagaagaatccagcctgtgtttgtcgtgatggatagtatataaactaagaagacctgaagaggtcatagtgttgacaaaattcaacccgatggtggaatacacacaaacacaggaaacaaagctgggcctttccacaccactgttaagtccttgcagtgacttcattttaagtcaccgtctcttcatgccacacatattcaccagtgtttgcttgatgaaataccacaaatcggtggggtctccttttctgcagtcttgcgtagatgtggctgccaccccaaaacccaaagggatgtctgccaccaccacttcctggccaggagaagtatttttcatgatttgactcagaccagatttcaacatatcgtctccatatagaaaggactgctgtgctccaggttttatccacactttatacttggcatagggtgcagggtaatccagagctgtgatgttcaactgaaacttgtaggttttggtgaattttctgaagcaggtcacagggaaatcagatatcagtgccagcttcagaatcttctcactcacgtagtacacctgg

SEQ ID NO: 38979 - DNA, 1070 bp, Homo sapiens
gtgtatgggaactctggactatctttgtaatttttctgtccatctaaaactactaaaattaaaattttattttaaaaagcatagctaaataaaggtaagacactattataagtaatggttattttatccagaaggatattatcgagctctggtatataattcccttagttttaaaagtctattcatgaagtcattcctcaacttctctctctgggtgatatttaatgtccttatggatcgtacttcatctcttctcccactagcttggagcagtttcaggttcccagctaaagaaactgaaggatatcacataacagttcttcaccttcttggcataaatcctgtggcagaccatgtttactttttcttctgaggaaatccacatatgctcccttcttcttcccccacccactcagaaatacagctgccttacaacttaccagtgcttttttctaaccaaggtctgaaaggttctctgtttagtttctttgttctcaagaggaatggaaaaaagcgggaaggtactatggtagcaccccacagcaccaacttgcccagtaggagtgaagtactaacttgcccaataggagtgaagtaccaacttgcccaagaggtactgcacctagatgtgtgcagaataagaaggtgagataaggggatccttcagaatgagtcaccacatgtaaaatcttggagggacaatacatgagcagataaaaaagtttaatataggtaactacaattagttacctctatgatactcttgcctttttggctgtagccattataactaactgtgtaattggaagtcattcccaccacctttatttcagtgaacagtattgtttattcattctgggcatattgcactgtataaaggtatgtatttgaacatagtttgttacagaaattgaatttagaatcactccagtatatagagtagtgttctgtaatccgttggtggagaagaattgaccaatcaaatttccctaatgagaccagtgacttatgggactgcctcggtaatgcttttcagttctgagaacttcagtgaggtgagcatttgccag

SEQ ID NO: 38980 - DNA, 1027 bp, Homo sapiens
ttagccattgcttacttattcatgatataagtggagaccagtagataacccattatgtgaacattctagaaaggtgtttaaggagttggctggagctacaagcaaagtgagtttctttagccttttaacttatccacgctctcagggatgctaaataaaagctccatttagcaatatttgcttctgatgtgtggcaccagcaagagctacattcaggtacaggaatctgtgtccagaggtaggctctgaacccattgttttaccatctgtcttccagccccagagtgaaattcttgtaggaggaagttgagtggggagaaatgggggaagtcctgggcctgattcacctcctaactcttagggttgcttgggcagcttcctccatctctctagaaatcagtttcttcatcagtacaatgaaggaatagccactaacacttactgaacattatgtgccaggcactgctccaagtactttgcatgtaaaatttgttaaatcttcagaactctgtgagggtgaaaaatcaatacacacatactctctcaattctctctgtcctgcttttccctcctattgtctcatcaccttctgagatatatatatatatatatattcttttgtatgctttatatttttgttattttgtcagtctccttgctttagaatgtaaatgtcataagggcaggaatttccatttgtttcatttactagggtatacctctaaaacagagcctggcaagcaataattacaaaatcgatgttgaatgaatgaagtacatagattaagtaatttattaatgttcaccaagatagtagtggggcagagttgggaattggtcccaggttgtttatctccagatcccatactctaaagcaccgtgttatactgactaaaattaggcaaccaatggcttccaagccatggttcatcatgcttgtttcacatgagaatcgtatgtgatgttttaaaagctacaaatgcgggctgggcacggtggctcacgcctgtaatcccagcactttggg

SEQ ID NO: 38981 - DNA, 1033 bp, Homo sapiens
tgtgagaaaaaaaatgtgaagggatcccagagaggctggaagagcccttaatgcaagtctgaccctgaggaaaagatagaaagagaaggggaagaatggtgtaagcatttcagactgctgttcagttccatgaaaacttagcaaggctgttggggaatcctcaagccaaagccaactattagaggagtcactcatctcatgggattgggcctgcctttgtatttctgttgtacagtcattggccgggagcagcctgtgggagaatgtggacctcagtggatttcagaacagagcagctggggctttcagccaattctgccccctgcagtcaaaatctaggaggcatattgttatggccaatattctcatatttagacatgatgttctagagattccgggaagttactcttggatatgtgtccaagatgtgtcctttccagaataatttctctttacacattctttaacctggttattatcagtcttgtgctgaactctctaacccatgtggataatttttagtaaggatgcttagtaatttaaaaacataaaatccatgctgctagtctctaaatcttctacgaaaagtttaatgctaaacaaaaggggtgtgtgtgttgtttgtatcatgtatatgtacatacaaatacacacatacacatagtattgagaaacataaacttattcaactggttattatagaccatgaaaggaattgtattgccgtatctaaacaaagtgtgcaattgtttgggtttatgtactctgtgcttatgagtgttgtgaatttgtcacttgggctttcacctcagaacaagtccttttttatttctacctcttgaaataatagttgttcactcaaagctcagaggtggtagaaactggtagcagatatcaggaaaacaagaataattgtcatttactattattggtcagtttggttctttattatttccttggaaattatacacaatcagaacaactacttgagggttttttaaacctcaaatagtataaaaatagcattttatcc

SEQ ID NO: 38982 - DNA, 1050 bp, Homo sapiens
gtttgttggccaaatatgggttttagattagtgcccaaagattacattaccagatttcacagaaagaatagacagctttaccagcagagctgttaggaaagggaccaataccaggattgcttatataagaggatgcgtagccagatgcctcctaggtatatattttattgcaaaggttactctcaacatcagaatgtgttcctgcttagttctacttgtgggactttctgaatcttgttttctcctttggtaaaaatgagattttctggcaagaatatgtcaatttttttttatcctccttcaagagtctaggatgtatttctagataaagaacttattagatactagataagtcagaaaatataaactatgctttggagagaacaaaacaaaggagagaacagtgcaggttggggcaggtgaaggagtcctcctttagggaaggaggtgtattagtttgcttgcgctgccataacaaaataccatagactcagtgaattaaacaacaaaaatttattttctcacatctggaggctggaagtcaagatcaaggtaccagcagcattggtttcctctcctttgcttgaggtggccactctattgctgcctcttcacatggccttttctctgtgcatgcacatccctgatgtctctttcctgtgttccaattttctgttcttataaggacaccagtgatattggattagggtctaccctaacgacctaattttaacttaattacctctttagaggccctatatccaactacacttaaacattctaaggtactagggcttagcatttcaatatatgtattttaaggaatacacaactgagctcctaacagaaggcaaagaaggagtgtactaaggcgatggagagattgagatagagctgacatgctgcacatgtcagcaggcttgcttgtgctatgtgagattgttgaatgggtcactgaaacatgacttccttagaaaagcagttctgcaactcttctgtctctgctccatcttcctggtattgcttcccaggtcacactttcaaatactc

SEQ ID NO: 38983 - DNA, 1031 bp, Homo sapiens
tgatggactatgaaaatagatggaatttctatatgcgagtgtggagtatacaaagatatgaattgcatgggattttaaaagtcactgagaaaaaggattgaggaaggaacaaagtaaagaaacagtcaagtagtgtgaggggactcatgagagtacagaatcacagagagccagagagaagagtttcaggcagaaggtttatctgcttgtggtttgttgagcttcttgaacctgcagattaatgtttttcgtcaaatttagtatgttttcagtcattctttttaaaaatatttttctgtctccttctctctcttgtttccttctggagctctcattatatgtatattggtatacttgatgtcccacaggtctcttttcttcagctgggataatttctgctcatctgtcaagttcattgattctttcttctgccattttgaatatgctattgagggcttctagtgaattcttcacttcagttttcaaatccagaatatgcatttggttcctttttctaatttctatcacctgagagtttctgtttattgattcattgctgtcattttttttattattattattctactttaagttctagggtatatgagcacaacgtgtaggtttgatacataggtatacatgtgtcatgttggtttgctgcacccatcaacttgtcatttacattaggcatttctcctaatgctatccctcccccagcccccaccccctgacaggccctggtgtgtgatgttccccgccctgtgtccaagggttctcattgttcaattcccacctttgagtgagaacatgtggtgtttggttttctgtccttgcgatagtttgctcagaatgatggtttccagcgtcatcaatgtcactacaaaggacatgaactcatccttttttatggctgcatagtattccgtggtgtatatgtgccatattttctttatccagtctatcaatgatggacatttgggttggttccaaggctttgctactgtgaatagtgctgcagtaaacatatgtgt

SEQ ID NO: 38984 - DNA, 1034 bp, Homo sapiens
aggtggaataggtccagcctgaatataaaggcctgagaactaggaccactgttggtgtaaatcccaggcaaaggacaggagaagaccaatgttccagcccaagcagttaggccgagagaaaatcttccctctctttttgttctgtttgggcccacccacattgggaggacagtctgctttactcagtttagtctcttctggaaacaccctcatagacacatccagaaatgatgtttgaccaaatacttgtgtaccctgtgattctgtcaagttgacacaaaactatcacaactggtaagaaaagaagtcacatatgtaaacatcaaagggggagaattggtgatacagaattaaagatatttaatttacagattcaaggagttacattgccagttgaaagataatatacattggcatttgtggaaagtggaaaatgtattttgattaaacatcaaaattttaaaaaattatatttaagtttataagtaatttttttcatctgttgcatttcatcaggacttatatttctgcatttaggattttttgtgactgtgtaagcatgtttttattagtatggtgaatcagttagctttatctgtatatagactttggttgatgaagaagtagattggtaattgcttttttcctcagatctgtttggttacttggaatatttagctgaaagttataaatgtgcagttgagcaggaagaagaagaaaacttttggcatcaaatattctatatttctcaaaatatttgatatttttagtctcctgaagagactgcaaggttgagaataaacaatgcattgtacatattttaaaaatagcattctctgagtgatagttttgtgagcgtttcctcctggggtcatggtgcacttcccctcagttggactgacctcgatgttctcattgagaagatgatgatggctgctagtatttattgagcactttctaaatcctaggcaccattttaatgctttaagtatatcagctaatttaagcttcacagaaaccctatgagggaggta

SEQ ID NO: 38985 - DNA, 1027 bp, Homo sapiens
agggctagagagagctcattttaaatgcttagaaaaaaatcagtgaatgcacctaatgctatgatgaattacatcttaacatatcacaggggtgaaggatggtggtttgcaagctttccgataaatttctggaattttgtaatgaaaagtattatgcaagagttggcattaaatccatatcagagctgatattttaggcctgttgctaagtacatgtagtcattttgaagtttataatattgtaggttgaaaagaattttttatttgatttatttcaaagcttagccatgtatgtagttgtttctgactttgactgacattaactgatcttattctattcttgacaccaagaaagaaaagatgtatgaaaacttatctgatatttgaattaccagattacattatcaaatgctacagtaactcactgattgatttgttcaattagtttaaaatagcaaccatatttacattatttagaaagaaacctttgtcatctagaagggtactttaaagtcctttttgttttagataagtagattttggcaaattaagaaattgatgtaaatgttccagagatagagcctgtagagaaccgtgtatttaatctcacaagaaagtaatggactgtgaaataccatttttgatggagattgtttagcacaatacagtaacatgagaattgtacaagactagtacagttttctcattataatgtaaaatatttgggtatataaataccaatgaatgaatgctgccattaggatgagactccttctatgaaaagagaaataaataacttgaaagaaatattataatttttacatagtttccacaagtccagatttattgatcactggaggtgtatagaaacttactaggggtctagtactttattcatggcaatattgatagaaataggtataactctaggccattatctagtaaactaaaagccaatttttgacttaatagagctgaacagttgacttctttctcttgaccttcaaggtaaaatcttgagaattta

SEQ ID NO: 38986 - DNA, 1074 bp, Homo sapiens
acaaaaatttcaagacgtgttatgtatctcttttgcctggagttgttggtctatggaagatataaatactaatactattagcatattaatactagtagtgggataagtgctgtgactgggaaactacagtgtgtaatgggaagatctaggaatactttgcccaacattggagtgtcagggaaggctttcctgctgagtcctgaaggacagataggaaccagccacgtgaaggggaaaaaggagccgtgcttgactgttcaagcacaagtagctgctgtacaaaggcctggagataaaagaaagcagagtgcttttgaggaactgaaaatttagtgtagggaggaaactagcaagtgttgaggctttgggtagagagccagatgctgccaggccttgtctactatataaaggagcttggacttttttttacaagtactgtgaagccactgaaaggtgtaacagggcagtgacatgatcagatttatgtatgtacgttaaccttttcattgaaaaataaaagtagaatattatatgaataaatgtgtagctgataaagtattttgacgcaaacaccctggtaagtacaacacaggtcaagaaataggactttgccagtcactccctgaagccccttcatgggccacatcccagtcccagttccctcccttcccacaaagactaccctgatgccccagtgcctacaggcgtcatgtccttgtgttcccttatagttcatccaaatgtgcatctctaggcattatcatttaatcttgctcattttttaaatgtcttttaaggcttcaaaaaaaatctacaggccgagcgtggtggctcacgcctgtaatctcagcactttggtaggcagaggcaggcggatcacaaggtcaggagatcgagaccatcatggctaacacggtgaaaccctgtctctactaaaaatacaaaaaaattagctgggtgtggtgacacacgcctgtagtcccagctactggggaggctgaggcaggagaatggcgtgaacccaggaggcagagcttacagtgagccaagatcgctccactgcactccagcctg

SEQ ID NO: 38987 - DNA, 1481 bp, Homo sapiens
gcatgaacatcctgatcaaaactcatttacttttgctcccaatggtgtgcctttcattactgaggctctgtacgggccaaagtacaccttcttcaacaatgttttgatgttttccccagctgtgtcaaagagctgcttttctccctgggtgggtcaggtcacagaagactgctcatcaaaatggtctaaatacaagcatgacctggcagctagttgtcaggggagggtggttgcagcagaggagaaaaatggggtggttttcatccgaggagaaggtgtgggagcttataacccccagctcaacctgaagaatgttcagaggaatctcatcctcctacatccacagctgcttctccttgtagaccaaatacacctgggagaggagagtcccttggagacagcagcgagcttcttccataatgtggatgttccttttgaggagactgtggtagatggtgtccatggggctttcatcaggcagagagatggtctctataaaatgtactggatggacgatactggctacagcgagaaagcaacctttgcctcagtgacatatcctcggggctatccctacaatgggacaaactatgtgaatgtcaccatgcacctccgaagtcccatcaccagggcagcttacctcttcatagggccatctatagatgttcagagcttcactgtccacggagactctcagcaactggatgtgttcatagccaccagcaaacatgcctacgccacatacctgtggacaggtgaggccacaggacagtctgcctttgcacaggtcattgctgatcgtcacaaaattctgtttgaccggaattcagccatcaagagcagcattgtccctgaggtgaaggactatgctgctattgtggaacagaacttgcagcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaaggccggtttggacaggcacggatggtgacaactacacacagcagggccccatcactgtctgcttcctataccaggttgttcctgattctgaacattgctattttctttgtcatgttggcaatgcaactgacttatttccagagggcccagagcctacatggccaaagatgtctttatgcagttcttctcatagata

SEQ ID NO: 38988 - DNA, 1787 bp, Homo sapiens
gggtcttgctgtgttgcccaggttgccctccaattcctgggcttgtgcagccctcccacctcagcttctcaagtagctgagaccagaggcacgtgctgccatgcttggcttcttattttttattgttattattatttttgatctgaggttggttgaatctgggaatgtggaactcacagatatggagggccaactgtacctataaatctcctttagtgaactcaccatgtttctttcttctttttttctgcttcatttttatctgctcctgaattaataagcatagtactgtcattcctaagatttgttttctattccttgttaatcagatatactaaatctgttaatgtatcagatgttatctttcatatgcaacagatgtgctttttaagttttcttgcaaaaattcttagatacctcataatccagtgtgtaaatatgtgcttttttaagtgctataaaatgaccatgtgtattccacttacacgcttactgttggtaaaagatctgagattgaaagtgacgtgaagtagtctgtgcagccaaaagctagcccagaaatttgacttctcataaataccttagatcttcctagtataatgattgggaaatactcaaatattcagaattttaagttataaaattgataggtttcttttgtccactcaaatgaaaacatggaattctatggcaacttaatgttttatggaaagctcaatgtgtaaactgatttctctttattacagttgttcaaacgcagaaatgtctatttgcccagaaatgatgaatctatgcttgaaagtcctatacaggatccagatattagttccactgtacccattccagaggtatactttaccaaaatatgtttcaaattatacctcaataattttagcaatagtatgtataacaaatatttatgcatgcaaaattattcatgtaaaatatgtaaatgttaattatatttttgtgtgtgtgttttaggaagaagttgttactacagatatggttcagatgattttttctaataatgctgatcaacagctaacagcaacacagaaatttagaaagctgctttctaaaggcaagaattattttcagtatgcttatttgatattacacgattttttagtagaggtttattttattgtttttttttaaattttaaaatacctttctttgctagacacaggtgttatattctctgcaaaatatattgtaaagtaacatccgtttttgaacatgatgttaccaaagtaacatatgttgactgtagaaaaatcgtaaaaatataaaagcagttaaagaggcaaatataaaaagattaatcctgctgccaagaaataaggttagagatatatattttttaattcttgtagaaatatttttcagacatgattttttatttttatttgtatttatttattttttatttttttgttatactttaagttttagggtacatgtgcacaacgtgcaggtttattacatatgtatacgtgtgccatgttggtgtgctgcacccattaactcgtcatttaacattagttatatctcctaatgctatccctcctccctcctcccaccccacaacaggccccggtgtgtcatgttccccttcctgtgtccatgtgttctcattgttcaattcccacctatgagtgagaacatgcggtgtttggttttttgtccttgcaataattttctgagaatgatggtttccagcttcatccatgtccctacaaaggacatgaactcatccttttttatggctgcatagtgttcca

SEQ ID NO: 38989 - DNA, 1029 bp, Homo sapiens
tgtcctaaggagtcttttaaccatggctgaaaccaaactaaaaaataaaacaaaggaagaataaccagtacccagctatgtagtaatagttataaaaacaatttcaggctgggcgtggtggctcacgcctgtaatcccagcaccctgggaggccaaggcgggtggatcccctgaggtcaggagttcgagaccagcctgaccaacatggagaaaccccgtctctactgaaaatacaaaattagctgagtgtggtggtgcatgcttgtaatcccagctactcaagaggctgaggcagcagaatcgcttgtacccaggaggtggaggttgtggtgacctgagatcatgccattgcactccagcctgggcaacaagagcgaaactccatttcagataataataataatttccaaaaagggtattaaaaagttggaaagtttcagagtttcattataaaacttcgtcttagaaagtttcaaagtatttaaaaaaataagaaaagtaattaaaaggaagttaagttagatactctctctggagttgggcaaaaggaaaaattttcagcttaaaaaatgattatgcaggccgggcgcagtggctcacgcctgtaatcccagcactttggggaggccgagttgggtgggtcatgaggtcaggagatcgagaccatcctggctaacacggtgaaacccgatctctactaaaaatacaaaaaattagccaggcgtggtggcaggcgcctgtagtcccagctactcgggaggctgaggcaggaggatggcttgtacccaggaggtggagcttgcagtgagccaagatcacgccactgcactccaacttgggtgacagagcgagagactgtctcaaaaaaaaaaaatgattatgcattatttgttgttcacattgtaattcacatttagtaatgcttaagtaaatgtaaaacttattaatgtatcattttatctgtttgagtgatattttaatttattttattagtattcatttgattctcagtaaatgtaaatcttttac

SEQ ID NO: 38990 - DNA, 1076 bp, Homo sapiens
gggaagtgtttgattagaattctatatcttgttatagttctatttagattttctattcttaagtcagtttggtagtttctgtgtttctaagtggtttttcatttcttccagcttatctttcttggcttttgatgataatattctcatataatttttttttgttgaagtgctgatagtaatgtctctactttcattcttaattgtagtaatattattttatatatatatatatatatatttttttttttttttttttgagttggagtcttgctctgttgcacaggctggagtgtaatggcatgatctcgactcacggcacactctgcctcccgggttcaagcgattctttcacctccgcctcccaagtagctgggattacaggtgcatgccaccatgcctggctaatttttgcatttttgtagagacatggtttcaccatgttggccaggctggtcttgaactcctgacctcaggtgatccgcttgcctcagcctcctgaagtgctgggattacaggtgtgagccaccgcgcccagccaaattgtagtaatatgaatctttttccttttgtccatctagataaaggcttgtttttgttgatttttttttttttttgggtcaaagaactgcctttttgtttagttgattttctgtagtgtttttctattctgtattttatctctggtcttaactttattttcttcctcctgctagctatgagttttgtttactctaatttttgtaatttctgaaggtggaaggttatctttttttcatatggggtgttaacaactataaatttttttctgagtattaatttcactacatcccttaagttttggtgtgtttttttttttatttatctcaaagtattttctgcatatgtgtgtgtgtgtgtgtgtgtgtgtgttttaactcactagttatttaagagtatgttactctactcatagttctgaattttctagttttctgtctgtatttttagtttcattccattgttgtcagagaagatactttttatgatttcacttttcaaaaatttatcagagctcaagtgatctgcctgccttggtc

SEQ ID NO: 38991 - DNA, 1033 bp, Homo sapiens
tgctgtttttaatggttgtagaattggattttctcagactgtatgatatatgtatttttttcaccaattcatttggcaaaactagaggttggatcctgacctcggtcaccaaatcttttttcagttttatcagttgaactctgagaacatttgtaaatatgaaggatacacctctgattttcattttattgggttgagaacagggcagttccttatagtggcaggagactaggtttatcaatagcagacgtgtagaagacagcaagttttactttgggaggaatttctcctttcttaatttcactttctagaatgggttttgtacatctaaataattcattagtagattttcatataggttatttactataaaactttttgtttccatttctaacttgttttaggtaattttgaattgttctgcattaccctgtctcttacatttattgagtagcccaaaggagtcaattagaaaagaagcctgctggactgtttctaacatcactgctggaaatagagctcagattcaggtaactacccttcagatctgagagtagaacagcaaggtctaagaagccagtttggacaaaagttaacacttttactaaaaaagattcctttttaaaaagataccgaaaaagtattttaaagaacatgggctttcctcctctaaaataataacatttacttgtagtattctagtgaagaacatcaagtgtgtgtgtgtgtgtgtgtgtctagcacagtgcctgacacataatggtttgtctttagaaagatatttttttgcattagttttaaataagttatgcaataatcttcctctcaaagcttttaatgatttattagggttctatcaagcttcttgtgtcagtgattacttatccattttgatcagtcacatggcttgtgctttatcatctctaaaatttatattttgctattctccagtctttaaaaagctaatttcctatgtaaaaagaaaaatatttgaaaagtttgctgacagaatagaaattaaaaatttatttta

SEQ ID NO: 38992 - DNA, 1033 bp, Homo sapiens
taagcatttaaatacagttttatttatttccttaaatatattacttgggtaattaattttagatttgattgcaaagagcactgtatagcagttgggaccagctcttggcttggcttggcttggcttattgttaagagtttattggatcaagactaacaaataactttgtgatgaaaattcttcaaaaatatagctactcttttcaagtataccatttaaaatatttcatcaggcagagccctgaccaggaaaaaaaaaaaaaaagaaagaaagaaaagaaaaaaataaataaaatgctccaaaaagtgttttcagtagtcttcactggcccttgtgggaggaaaaatacttttttaacttgcttttctaagatttgttatatttaaatccaagagaaactatgccgaaaaaaagtgttataaagaggaatgcatgtagcattaatgcaaatatcaagaaaatacttgaaagagtccttttcatttatttaattaaatttggtgttttattttgtctgaatctgaatttctcctatttaatctatgcaattatgcttgttttatatttataagcacttgactcactgggtgtggtctttttactgtgttttatttcaaaacgttgttttaagtgatagtgtccttaaattttagtgtcatttggtcaacttactggtaacaccagaacaagaaagcaaaaaagtaataaattctgctggcacagaactaacatatcatttggtaactgtaaaacctatttgcagttaaaggttgatttattggataagggactaaaagaagcatatattacctttgcctttatattttttcttcttttaagaaggagcattatggaaaaataaatataaagtcttagtgaatttttgttatggttctcaattcagcaatctactggctgcttgcgaaactgtgaaatcaaattgttcttaacctttattcagtttagtttatagcattactgttttatgaaatgtgacattttaggagccaatataatagagctctaaaaggat

SEQ ID NO: 38993 - DNA, 1031 bp, Homo sapiens
gtttttgaaatctagtgtgtattttacacttacatcacatctcagtttagactagccacatttcctgtgcttacccccacatatggccagtggctttattgctttattggatagctcagctttagacacttgcaaaaacataggtcctactttttgaattcttttgaatatgactctcctcattgctactttcatagcctggccttgactctgtctttcttgtccattcatgcaatttttccaaactgaccttttaaagttgagattcaatcatatctcttccatgttcaaaacctccactggctcataatttctactattaacaacaaactttcctcaacttgacattcaaggtccatcatgatttagtccaagttcattttactatgtcacctatttcttactttctagcatgtagtctatgtgctcaccaaataattatcccagtaacctttgattcactccaactgccagtcttctgtttaagtttatgctgtcttcccctggagaatgccttttcccatatatgtatgttgaaattttacccatttgaaagaatgtctcttgaacttcttcctttagatctttttttagtccattgatttattgtaggtcccttctctgcaccctgtggcagtttgctggtacctatcttaatgtgaaattaacttatctcctcctctaaacagataatacatattttgaggacagaaactttgtctcattcacttttatattctttctgttggtcgatatataatagattatcaattaatacttatttaattgattgcaattaatgttaacattattgtggcctggaaagaataaataaagtgccagattcaaaaaggcaaaatgggtcccttccttctaaccaagtcaactttatttcaaagtttgatcagtttaactgactgatttctactgaatttgattcctactgaattgtattggttgaggaaagatcagatagtgtttaaagtaaatagatagggggaaaagaggccgagcaatgaagagaaaccctc

SEQ ID NO: 38994 - DNA, 1306 bp, Homo sapiens
tattgcttttcaagcaacttattttggaaacaatgttatacccttaattgtataattttgtactataatatttcaaaatgctttagaaattattctgcttttatgtacattttataaatcaaaatgaattttggggattaaccagaagttactgtaaaggaaaatcagtgtgtatgctgcatgtgaatgctgcatgtgaataaaattcttaccatgctttgcaaagtcttttaactttaaaacttccccgaaaaaatgatttttttagtttatttgagcaaatttaggaggcccctagaataacatttttgtaataaaattttctttactacctaatgtgtttgacctttgtcttctttttacaaaaaacaaaacctatctcttgggttgctcacagttaactagttccagcctattgcttgtctagagtaagccactttcccccttggcttagttcacaatcagtcagaaattatcagtctgagcgtcaagctaaatttcagttggtaaagattataatcatacatatgtattgtctagtaaatttggcctttcaaggaaaaaaatgccatataccagtcatttgtgctggtataaattttgaaatgtgccacaagtgtgctttgtttttaggtccatactgtggaagtatgactgttcccaaagaactcttgttgaacacaagtgaagtaaccgtccgctttgagagtggatcccacatttctggccggggttttttgctgacctatgcgagcagcgaccatccaggtataacggaagaatcaacacaaatctctaaatgttatctgtctaagaattcctcttgccacttatccccatccctggacataattgtggactcagatgcagaattaagatatgagggagaagaggaacatggtatctttgtaaatggttaggtctgaactgaatcatattgcagcacaggtgtgtccaatcttttggcttccctgggccacattagaagaagaattgtcttggggccacacataaaatacactaacaatagctgatgagctaaaaaaaatttgcaaaaaatttttataattatgttttacgaaactttaggaatttgtgttgggctgcatccaaggccatcctgggctgcatgtggcccaaggggcatgggttggacaagcttattagcatgttagattgatcagttgacttatatgggataggattcatctcatttttcctaaaaaccttggataacacacttttgtgttcccctcctgacccttcgaagtcttcactattctctggagccctcccccatcctcct

SEQ ID NO: 38995 - DNA, 1050 bp, Homo sapiens
ctggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtgaggcccggtgcggtggtggggggtggccgaggcgtcttggaccgctagaccgctggtctggcgggtggtgcccatggcacgagttgccgcggcctctctgcaaatcacagcgctagcgctttcgaggaagggagatcagctttattgaacacctactaattctctggatttgactcagtagctttttaacattttaaaaatatcccttggccgggcgcggtggctcatgcctgtaatcccagcactttgggaggccgaggcggacggatcacctgaggtcgggagttcgagaccagcctgactaacatggagaaaccccgtttctactaaaaatacaagtttagtcgggcgtggtggcatatgcctgtaatcccagctactagggaggctgaggcaggagaatcgctggaacccgggaggcggaggttgtggtgagccgagatcgcgccactgcactccagcctgggcaacaagagcgaaactctgtctcaaataagtaaataaataaataaaaataaataaaaaatctcttattcgttataatactgcagtaatgtagatggtatttgtatacccttgccaaggtttaaaaacattaactgatttgcccaaggccacaagatcgtaatggggccacaaagatcggaatgaggatattggaattttagccattctgtgctttttcacaatctttgcctttggttacaccacactgtttctttaagagagcttc

SEQ ID NO: 38996 - DNA, 1044 bp, Homo sapiens
ctttgctctcaaatttgtacttaaattcgttctaattatggttggatctagataacaacatttaatccttagactaaaagatctattatattgaccttaatttgactgccagcaaactgatctttttgtttttcactacctgcaatatttcttgattataatagagtctgcaagtaattctttcatctttcaaaaattcaggttgttctctcaggacagtgatcaggaattttttgagttcagaattctagcgagatttggctgttctgtctatatgattataatttaagaaatgaccataactgggatggtacaagaaccaggggttggggtaaatggattttattgttctagccttagcagtgttgtttgcctgtgtctcacatgcaggtacacttggctccaagttatctggatatgtattgttatcttaagtgatggaacttgttcttatttcctggctttattgtgccttgctgggaaccttgctgttgattggtatttttcaaaacctgtctgtggaccatctgtgaattagtcattggggatgcttataaaaaatgcagattcaacacacttagtaatcaaacttaatgagggaactgggacctgggcgtctctgtttttatcaagctacctgtatgatacttctgcacactgaagtttaaccctaacacagatcaaaggatactctgctacttgccttacattagattatttatatttcatgttccttttcatgattgaggataatttggggtaagccttaggattatttgctgtaaattggaatgatccagaataaggcattgccttctgtgtgagaattcaacagtaagacaacaaattttttttgtgtgctgctctttctagtgctatttccttagtttatttaaatcgaagctaggttgcttttgaaatggtttttgggtacaggtttctcacagtaacattttaaaagtctgcccagtgtatcctatcttttcaacctgtttctcaatgctttgcataccttttgctatgtctgtatttaggtatttaatg

SEQ ID NO: 38997 - DNA, 1028 bp, Homo sapiens
taagatacaaataaaaacaacagaaagttttaaaatggggagatgaatgtaaagtatacagtttttattagttttcattttgtttatttgtttatgcaagcagtgtggtaatcagcttaaaataatgggttatgacagatagtatttgcaagcctcatggtaacctccaatcaaaaaacatacaagagatacacaaaaaaataaaaagcaagaaattaagtcataccaccagagaaaatcacctttcctaaaaggaggacaggaaggaagtaaagaaggaagagaagaccacaaaacaaccagaaaacaaataacaaaatggcaggagtaagtccttatcgataataacattgaatgtaagtagactaaactcttcaaaagacatacagtgggcggatggataaaaaataagacccaatgatctgttgcctaccagaaacacacttcacctataaagacacacagactgaaaataaagggatggaaaaagatattttatgccaacggaaacccaaaaagagcaggagttactatacttatatcagacaaaagatatttcaagacaaaaactctaagaagagaccaagaagtccactatctagtgataaaggggtcattttagcaagaggatatgacagttgtaaatacatatgcacccaacattggagaacccagatatataaagccaatattaatagagctaaagaaagagagagagagagaccccaatacaataatagctggagacttcaacaccccactttcaacactagacagatagagacagaaaatcaacaagaaacattgaacttaatctgcactgtagaccaaatggatctaatagatatttacaaaacattttatccaatggctgcagaatatacattctccttgtcagcacatgaaacattcgcaagaagagaccatatgttgggccacaaaacaagtctaaaacattcacaaacattgaaataatatcaagcatcttctctgaccacaatggaataaaactagaaatcaataagagg

SEQ ID NO: 38998 - DNA, 1029 bp, Homo sapiens
ctacagagctatacttatagttaccaaaacagcatggtactggcataaaaacagacacagagaatagacaatctagagacaatctagagacaaatgcatacatctccagtgaactcattttttgacaaaggtgcccagaacatacaatgggaaaaaccagtatcttcagtaaatggtacagggaaaactggatatccgcatggaaaataatgaaactagaaccctatctcttgccatatacaaaaatcaaatcaaaatgcataaaagacttaaatctaagatctcaaactaagcaactactacaggaaaacactggggaagctctctaggacattgaactgggccaaaccctacaagcacaggcaaccagagcaaaaatgaacaaatgagatcacatcaagttaaaaagctcctgcacagcaaaggaaacaatcagcaaagtgaaaagacaacacagaatgggagaaaatatttgcaaactactcatctgacaagggattaataactagaatacataaggagcttaagcaaatctacaggaaaaagatctaatctgattttttaaataggcaaaagatctgaatagatatttctcaaaagaatacatacagatagcaaataggtatatgcaaagatgctcaatatcactgatcattggagaaatacaaattagacctacaataacatattattgtaaaatggcttttttctaaacaggtaataacaaatgctaacgaggatgtggagaaagggaatccttgtacactgttggtgggaatgtaattggtacaaccagtgtggagaacagtttggaggtttctctaaaaactaaacattgagctaccacatgatccagtaatcccactgctaggtacataccaaaaagaaaagaatatgaactcctatgtttattgcagcactgttcacaatagccaagatttggaagcaactgaagtgtccatcagcagatgaatcgataaagaaaatgtacatatggaccacagagtagtattcagccataaaaagaac

SEQ ID NO: 38999 - DNA, 1525 bp, Homo sapiens
agagttttgtgtgaagctacagcatatctaaccagagaatttctgattccttatactgtgattatattatattgaggcatttgtagtgcagctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttaatatttgcattttcgtgcttttattttctccttccattcataagtatatacttgaaagtacatctgtagcctatgatttgagtctcttgaagttctaggaagaggcaaactacaaactactaggattctgatttcagatgtagtcattccagaaccttctctttatgagttcacctgctagtacaatctccacaacttgaatggcattggttgttctgtaattcctgccaaaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaatatgtaaataatgtgtaaagccagtttttatgattaaggaatcaaatttattgaattttattattgaaagttgaaacttaacatgtatgaacaaaaaccaataaaagaatatactcttttcattgactatagtattatgtgaatgctacatttgttctgaacacttaggggctgcaaaaatgtaataagaaatgcatatgactagatagcaatagtgttttttttagatggtatgctcttgattgaaatatattctcacttttaccaggttaaacatttggaatcttataatgttacttgctttttgatagataatagtgaaataaattcagctttgccattgctggagttgtcaaaattccacagtaattaaaatttgaatttttaccgaatatgaaatttccaaattaaaaacgtatatgtgtactcttttaaaaaggaatttgatagttcttgtcaaatgagaaaatttaaaggtaagagttatggtttgtcttatgct

SEQ ID NO: 39000 - DNA, 1060 bp, Homo sapiens
gtggtttgcagcagagccatttatctgcttggtcttggtttcttcattgtaaattatgtttaataatacagtacttgttttacttccctaccatgattttgagaattagataatgctgaagaaaacacttggaaaagtataaagatctacatgaattaatgtattcaactcattttttttctaaggtaagcctatggggtaaacataggcaaatgaagttgaagtcatgctacgttatgggtagaaccttgtgtttctaatgaaacgatctgtgacatgagttgtactagtcccagtgtatagaggaggaacttatacttatgttgggttgacggcatttcatcgcaggtatacaaccgtgaatggaaccctaggtttgtagcctttagacttaagctaaaacaattatttatttatttgtctttcaaagttattcaaaattttcaatataatattttgtattgagtaactggcttttccttatccttaaaggataagaagaaactctttgtttcaagaaagaacatttttagtaaggagactgaaaaatctgagcaagttttaaaatctcaatggcataatttatttagcatgctgatgggcttggcttttgtgccataattatgtcaatgagagccttaatagtggctatagagtgattaggctctaggtaaaagtgagagtatgggggagagtgaatttttgagattctgcagagtgcttggatgtggctcccctctggtttgaaccctcatgatgtgttggactagtcagtaatggatatcaggcaggcccattggggcctaatcataagcatctttgtcaattttctaagaactcaccatctgcttactttctccttttttgctttcttcttttcctcttcctccttcctgaatacttcacccacattgccctgtccactcattgtcttcatttgtcttctttcctctacccttggcatgcagcaacttagctcctagcagaaagtggttccaaatcgggaagctgggagccaatataaaaaatatccctccaacttttgacatgcagatatatg

SEQ ID NO: 39001 - DNA, 1889 bp, Homo sapiens
catttgatttagaatgaactgatttccaacttatatttagatttattttcaaatttctgaaacctttttgaatataaaccaaagatcgttaaggatatacatagaagagtttgaagcaagcctacataaaatcaatgtccaagtaggaaacttaccatgtaaaatgggacaatatgtgtacatagcctttctgagtcattaaataaggtggacagaacatcatgaaccaatggatatgactgaactctaggtattccatacagttggtggaaacatataatttagatgatcctttctgatcaagtgagaaggcttttgttaggaaattaatggtgagaatcttcctcaagctgctccgtctaaaacatgtcaaaatgaaaagaggaagatcagctagtaatgaggttgattaatataaaatattccaagtggaactgggtggtgtgattaaaaacagacttttctaagatcagtagtaaagaaaagatgtctgaagggtgcatttgtttttaactaaaaggacaaaattataaaaataaatgattataccagtatacttgtatttatgcccagtgcttggagaaactaatgttcacattaaagggatatttggattacctcagataaagatgatgtgttttcaggtaattaacgtgtattaaaatatacttgtctttgtgtgattttctttgaacttttactttctcaaaatccttcagtgtcttaggggcatcttaactgatgtctgttttcactgtacacatctatagatgtagaaggtataggcaattgagctgctgctcatatcgctcatatagctctaaagttacttaatgcaagagatgttttattatgtagttgccatttctcataaaaataatatggagcatgtgaaagtaccaccaccagattttagtttagcttgcttgttcatttgcgttcaggccaatgagcatgccctgtacattgttcagacacattaattcttgattatgcttctcaagaagtatgcttaggaagacaaacttcagtagatgtatggaaaaaacctatgaattttgggcatgtttcttaatggtaacatgaacatatacaggtctatattcatttattcttaagcagtaactgtatgctgagccttcttatggaatacacacatgtgacgaaacattattcttgggccaaaacctcaaaacctaactgggaaacttgacatgtgtatcactatttagaatgaacgttgtaattcataatctgaattgttacacataatgcctaaataaatgcttcccagtgtctagatattggaataatgtaaatgagctgttcaatatgcaatgcgtattaaccttgttctgacactttggaattatacagggaatccttgaatgtacaatagttaagaaggaatttcacaagaaatgtcaaagaaaacaataacaataaatattctttaggaagtattttcttagaaaaaatgttagtggcaactcagttagttagtggcaacatgagtataattttttgaattatattataatttaagttttaaaaatattgtttcagccaggggcggtggctcacaactgtaatcccagcatttgggaggccaaggtgggagggtcatctgaggtcaggagtgtgagaccaacctggccaacatggcgaaaccccatctctactaaaaatacaaaaattatctgggcgtggtggtatgcgcttatagtcccagctactcaggaggctgaggcacgagaaccacttgcacccaggaggcagatgttgcagtgagccaagatcacgccactgcattccagcctgggcaacagagtgaaactccatctcaaaaaaatccccccaaaaacaaaaacaaaagaatcctatctatc

SEQ ID NO: 39002 - DNA, 1689 bp, Homo sapiens
tttattcaatgagtgtttattgagtgactattatatgttgggcactgctggatcacaatggctagtatggcctctgggtgccattggtggagtttctgttattaccctttgaatataacccatcaagggagcaatttaactaaaatagaaataaagataacatatacctctcaaaatgctatagtttcaaaaatgatgttttcaagctgatctgacaaaaaatccccataaattagttgtttcacttttaggaaaactgcccaggtagaagactgaaacataataaaattactcaacgtctacatagattcaagaagcagaccttttttgatgaataccattgagtttgtttcacttagggcttaaaaaatattaaaaaaaaaagaggaacagctattaatgttcatccaacttcagaatgttagaaggaaaaggagaacagatttgaatcccattcttctgttcagggtgaacctatcaaggtccttgccatgtaactcaagaaaatagagttttctgaaaatattaatgtgctgacagtgcataggcaactttttgggacttggggacatgtttatgcattgcagatggagagatttaaaatatgcaagagtatattttatatatggatttttatatataatttgatacaacctaacgagagtgtttgagatgtttgagttaaaattagcatttagacaatgactcaagttctctgattttaccttataaggcatatactttatagtataaaacattacattgtatgtttttcttctaataacaaagattagtattcttatccttttctagagaagaaaacaaatttatgtggtgatacagctaagtgcttttgtaaaaccacagaggagggagagagcatgctaggctggagaaaggtcaggagggatcagggatggcatttgtccttggcaatgaaagatgggtaggaaaggaatatgtgcagggagagggaggtgagacaggatgagccgttcatggaagtaagagattggggaagaattaagtgtccagtttgacaatattataggatgcgtcaatacaaagggaagaagagggaattaaggctagatttgtaggatgggatcagataactgaaagtcttagatgctctaataagcagttagacttattaagttattttaggttactgagtagagaaatgacatgatcagagatgtgcccaaatatgatactctgggggaaaatctataggacaaaaggagaaggaaaagaccagagtttggggatcagttaggaggctactgcagtcatttagaggggaagaaatgtgagtctaagtggggtggaggcagccaggacggagagggaagtgctctgatttgaacagaatctggaccaggtcagctaaaagaagatttgattatttttgagaaggcactcagcagtgcctgtcaaataatgggtatttaatacttgtttgttgaaaggttattgaaagccactacaggaaagagatctgctctccagggcctagggtgctgagtgagctagaggctgctgggaggacagcagctagctattcagaccgtgggctatggatgcctgccggactacagactgtgtggccagaccgtgatgagaacagaaattgggagtaagcatttagaaataactgtagcagtttgagagagcacttttatattt

SEQ ID NO: 39003 - DNA, 1055 bp, Homo sapiens
agaaaggcaggcaataaaaacatgaaaaaggtatccaacagtggcaaataatatgcagagaatcaaagtggggtgatgtgacagagagggaacaggtggtacttcaatttggctggtcaggcctctctctctctctctgatgacactgaagctaagattagaatagccaaaaggaaatggccactggagggtctggaggaaagtcattccaggcagagatgctaagatgaaacaagtcttcataatgatgtgaaagaaagggaggctggagagcaggaaacaggagagcataagtgaggaggtcagagagggtcagttgtcagttctaagtgggctggggaacaagtggaagattttaagcagaggagttgtctggctaatgttttgaaaagaccactctggctgctgttggagaatggattgcgggagaagtacatacctactagatgaaagagatgttggaagctggctggcctgtagcaacagaagtggagacaagcggttgtgatctgcagtggtttgcactgggaggtggagtacacaggactggttgagtgatttgacagggcagatgagggagaggaataaagaaacatttccagttttttgggcttgagcaattgggtgagcgatggtgccattttctaaggtgggaaagactgggagaggaacatgtttgatggtaggaattaaagagtttactttggcaagtaaagttagagatgtgtagtgaaacggtcaaaagaaagctggagtgtggaattctggggagaagtcggagtgtggaattctggggagaagtcagagcttggaatttggatttggggatcatgagtcctggatgcatgtgtagatagagagaaagaggggtaccaagaacaatttggggggcacactaaccctcaaacacagaaggactcagcaaaggaactggagaaggaaggatctgaagtaggaaggaaaccaggagagtatggtgtccagaagccaagagagaagatgtttccagaaggaggcaataagcagtccactgtgctgagagtaattgaggaaag

SEQ ID NO: 39004 - DNA, 1030 bp, Homo sapiens
gggttcacgtgatgttcccaccttggactcccagtgtgttggaattacagccatgagccatcacacctggtgatgagatgtgacttagcaatcacttcaaggttttatgtctggtccactggagtgatggtgtcccctttagcctgtgtcgtatgttttgtttcaggaaaacagcttaacttttgggggtttcaattctctcatttgtaaactggttaaaataattctagtttttcatttccccttggatgtttgggaattttacatgcaataacatctgggagagggcttggaaagctgccaagcaccatgtaactgttatcctggtcccaaaattaaaaggagagcctgggttttcgtggctttgcgctgtcatctggcctgtgataaatgctgaccggcttcctcggctcgcagtgactttgatgcatagtccctactctggggactgtcgtttttgtcatgagccttgtcagtcagagtctgaagtgaaacccaccgatctatgaactaggacactaggctgtttacttcaatgtgttcatgtttgtttatatatatgtgtgcatataaagtataaatatatgtaacagaaagtaaaaatgcatatgtatttaataaaagtataaatatatgtatttatggaaagtatatagcaagcctcctcttgggaaggcgatttcagcactagcatatgttctgctgtctaattgtgcctctcagcccaggagctccgcggtacctgtggttcctgaaagagagtttgacaggcttcaggaaagggttagtgcctcttgaactggggagattacaaaacgagcgtgggcctaaaaggctccacagaggcaggcagcgggatggatagagcggctcagagggaagggacagagccgctttaatgtgctaatgaggggaagcccagatgccagcgggctcagtggagctctttgtgacgccgggttcccggggctggctggagtctctgtacctatctggatcctgctgcaggccggggaaacactgcgctctt

SEQ ID NO: 39005 - DNA, 1048 bp, Homo sapiens
gtgagaaaatgcctttattgttttttgctatagttgcctaatacattgctgtggtttgaatgtttgtatccctccaaaatttatgttggaacttaaatcccaaggtgatgattaagagtggggtctttgcaaggtgattaggccatgagaggtctgccctcatcaatggcattgatgcctttataaaagaggtttcagagagctgcttggtccttccatatcttctgccacatgaggacacagtgttcatcttttttgccctcccactgtgtgaggacgcagcaaaatgcaccatcttggaagcagagagcagcgctcactagacacgaaatctgctggcacctggaatgtggatttcccagcttccagaactgtgagaaatacatttctactatttataaatactcagaatatggtattttgttatagcagcaggaacagactaagaaatacatttcaatttttttgaccattatctatatttcaaggtataagaaactaaggcacatgaagtttaaggtaacagatcaagtagtagagctgagagttgaattcagacagtttggctttagtgtctattctcttaaccatcatactataacgacatagatggcaaaaaagaacaccttttaaagcttctgtcatctcttctcagataaattaactttctgtacccaaatccaagatgaaaaatgttagataaaccaaatctcaagcatagaggcttttcttctggatgaccaagacattcaaatccttcatttctagaaatgtactctgtagtgtaattagcattgtctgaactacatcttttcaaggatgatatgaagttttcaggaaatgaaaacaccatgtgggacttccagaacttggagtaacttggagttgattcccattttcctttggaggtgactggcaaatgcaatctttaggaagctcctctgacccaagagacatgcacacatatttgagtgggattccagggcccgtgagccagcagttttcccaaggcttatctcctgtcctgcaccatcccagatctccctga

SEQ ID NO: 39006 - DNA, 1023 bp, Homo sapiens
ggagtagataggcataaaggcttagtctgacatttggatctaattccctactattttaattagaaaaaattacagttcttttaaaaaaaaactttgtattttaaaaatgttcacacaaagatgtctcaaatctggatatcaaggcaggatttgcatggaatcctttattgatggcttatgtaggcatctataagaataaacaagtagttccaatttattattgttactgttttacttactgtatgattttatctgcttcaatgatttcataatcattgaaaaatgctttatattagttaccttttatgtgagcaccttctgcactctaacatgtttgcatcataacaatggatgccagacactttatggttcattatctcactaaattctcacagaggtcccataaggaagtgattgtcattctcattttgaggatgaggaaacattttcactgactttaatttacctgtgggttccaaataagtagtagagttggggtctgatctaataactcttcgactccaaatttcttcagtctgccacactcttatggaagattggcattcattccataatgctgattattagctttctgcttgtgtactcatacacataagaatcaggaaggaaggcagcgcactacgaggagttagatgcacattgcagggactgcgtggtaaacattgaagcatatgctacagccttctattattgggttcttcttcatgttagaatgaataactatttaaaagttcatctttcaaaacaaattaatgctaaatttactgtcattatcaaccactaaaaaactcctgcccaaattaaggcatagcaatcaaacacttatttaaggaaaagagttcttttctccccagggttttttatttgaataaacagataataaatcaagaaatactgtacccagcaggcctttagctcagaagagctaaaaaattctcccagtgtctcaacatctatgatgtaaaaacaaaacgtagaagaattataatgattggatttatg

SEQ ID NO: 39007 - DNA, 1045 bp, Homo sapiens
atggcagagttgagtgggatggctttgccaggtcatacttagttctttgcctgcctgggatatacgcacatcacaaggtagctttgtctgaatagatttaagtgccagcttactgaatgctatccccctcccccgccctcaggcccctggcttgctgtgttagacaacttctgctcctaaaaataattttgttttacaggcagtcccctctgtcctccctgaatccagtgtccattccttttacttccgaagttctaccagatatgcctgtatgtgcttgaattcttgttctttttttttttttttttccggagacagcctcctgctatgtcacccaggctggcatgcagtggcgtgatcatggctcaaaatcttgagctcaaatgatcttcctgcttcttcctcccaagtagctgtgactacaggcacgcatcaccacaactggctaatttttaaaatttgttggtattattttgtagagacagggtctcactgtcttacccaagctatacttgaattctgagcagagacatgattcaaatgtttccactaccccaccaaggcctttcaaccctaatgaatatcagtagatgcaaatgtgtcattttgagaaaaagcagcgcttagctctatttcccagacagatctgagtctgacttcaccccagccagggactgcatgtgagttttgcatttatttattttcctcgggttcttgcccttcctctgatacttttatgtttaaacagcaagttaaggtatgctaagattctgtggccattctggatcttgatcttctgtaaccctcaatacatctttgaaattttctgacactgaaggttactaaaaaatttcagagtcagttggaatccaagtaatacttttgtcctaatagtttcctgaaaagtaccagttaaaaaggacctaaagggaataaacccggaaatataacaaggacatcttactgtggagttgatggaagagaaaaatagggaggagatggttttttaaagaagtgaaaggttatgctttttttttcacttact

SEQ ID NO: 39008 - DNA, 1052 bp, Homo sapiens
aagcaagtggagtggggacaggtcattgcatccttgttgcctggtggggtcagagcggtggagggtcctcacacacttttcctcaggtcctatagccctgtggcccagcacagcatggaaggtagaatgggcaaatgaatgtgcatgacttcagttgtcttcatgccagtctaggagcacacagtgggtgctcttttaaggcagcctttaccttgctgattagagagaccctgctgtcaattagccatggcaatataaccaagtacatggaggcactatgcaagaaaaccatttttcatttcaaaatgagtatcttagagggagagaaatacataagggtcaatagctctttctgtgctgattgcttttgattcattatatatctgtttgtttaatacctagagggatcaaaaacaacaaaacaagcacgagtcttctattcactgttgggggatagccataggtactttttgttgaagtgctgatggaggatggagttttctttcattactgagggtcatctgggacatttaatctatactaggactgtctgtacgtgctgcatttgttcttgcttatttattcatttatttatctatttattcagcattattgaagcataactgacgtataaaaatagaactaccatgtgatccagcaatcccacatctggttgtatatccaaagaaaaataaatcagtatctcaaagagatatctgtacccccatgttcattacaagattattcacaataaccaagacatggaatcaacctgtgttccgcaacagataaatgaatggagaagatgtgcttttttttctcctttctttttttttgtgtgtgtgtgtgtgacagggtcttactctgtcacccaggctgtagtacagtggcataatcacagctccctgcagcctccacctcccaggctcaggtgaacctcccacctcagccacacgagtagctgggactacaagcacatgccgccacacccatataattttagtattttttgtagagatggagttttgccatgttgccaaggctagcctcaa

SEQ ID NO: 39009 - DNA, 1030 bp, Homo sapiens
tgttgccaaacatagtataaatttggttgttaggctcagaaattcagagccatgctgcaattgaaaaatgctatgaatagcttaaaagttcaaaatatattgaaaaaatactgagtattgaaatgctagttattatttttgtttttattttctcagaaaagctttcaagtttgttttttgagatccccctctcccaaaacacacacatacacatacacacacacacacacacacacacacacacagaatatattctaaatgcaaacacatgatacgtattagttgatttgtttcaacttactttactaccatccctatggatgcatctgttctagagagagaatgcctgcatataaacaagagaaatttaactaaactttacaggattccagttttaaggagtaatttgtaagcagtttttgagatgtgattcttatttcagtatgaagccattcttcttttagtttcagttttgttgtctaaatctgagtgcttttactgtgttcccaaatggtctggatctgtctttgacaaggtacagcaggcttagggggcagagggcatttgtttaacaggtattaactgagtgcctgctctgtgccaaacacatttttgggtttgggggaaacaacagtgaacaaagtagacaaaaatctgcattcatggagcttgcatccatttgggggaagacagatgataataagttacatatataaatatatatggtatggtaatggctgaggaagatccctcttggcagggcatttggaaaagctgtggggctccgagggccagtgctgtccccatccgtgggtcatctggcaattgcccagtcctcctctaatgctgctcagtctcagttgagttgcactactgactcttcttaagtcacttagagatgaagttggcactatttggaaagatctgttgcagcaaagggtatgtttttccttaagttatttgttttccacatatagtcacaaatttactactatttattcagtacttgctacatgcattgtatggctta

SEQ ID NO: 39010 - DNA, 1051 bp, Homo sapiens
atattatgggtatataatactcctcatagcttttctgaaaaaataaaagttaagtgctcatgatgactattttagagagagttgcaagagtttaaaatgatcactgcttaaaagttagtagcagcattcttttcccgattctctagtttttagacctgcaagtaaagacatgctttcagtattgcaggtttaatgagactctgctgtcttttccccactgatgccatgcttcctggagttgccatgtgtcttcacagcaggattgaagggaaacccttttcttctgcatagtaacaagcttttgctttcactttgtaggaccatttttaattttggaaaaagtgtaagttgctcaatattatggtcccccagagtgaacttttagagatgggtctcggaagatcttaagaccaaaacatcaaaagagagagaccagggtcctaagagaatatgagagttgttaaaatcatgagcattttccgtaagctgcagagagttttgaaagtaattgcagtttatgttgttgtcttagaactgaagaacagaaactctctttctttgtgctccattttcctgaccagaccttagtgcaagaataaaaggaaaatgaactggattgttttccctgtggcactcattttcctcccttctcttcacacctagcttccaagtcctgacctgtttccagatactttttttttggaaaaggttgaggtttgagtaggagaagagtagtctaaatgggtttgcacctactcccaaaaatatggatttaaaaattattatcttaataacaatgacatccatataaataaactgattatgaaagcaatctgcaaattgccaatcaaatataattctcacaacaattctaagataaaaaataatggctgattttgtgcttcttagttcaaataagagtcagctgaagttttgagagattgatgcatctgctcacagaggtcctaagggctggagcttgggtaagaattcagatcctatgacatttagtccagtgttcttcagttcactattactttccaattttaag

SEQ ID NO: 39011 - DNA, 1026 bp, Homo sapiens
tactatcatcctgaggcttgaaccatgactggctggactccagagacacagttctctgttactgtgttctgctgcctctcccagttcttaacattaaggactagtgattttgattttgctgattttgtttgataagcacttattgagcatcatttattgagtactctgtaccagctgccatggaagatccttggcatatataaatctgtgccttcaaggggcatcactcttcagtagagtgactcaaaagatggatgtgaatgacaatggctctggctattgacttacttcaaacattcttggcacacatagccacagattaaagtaaaatagatgatttccattataaaattaagatgatagatatagagaaaccatctgaaataacgtttacaatttaaatgagtattgaacattaacagtaaacatgattaaaacatttaatttgaaaatgtgcagtgttggaattataattccttaaattacagttaaggcacagaagaaagcaggtgttgagacatcaatgttgataaataagggcctttaaaatagtctaagtcatttctaagaaatggaaataaatttttttcatattatttaacatatagtcaaataatacattcttaaatatgtctaaactaaaataaaatcacagacatgtacaactgaatgaattactttactattcacttatgtctagatgttctattcttaggctcgaatgggaacatttctcttcataagttttcatataatttatcttgatagcatgaatgcaatctatgaaaaagatgtattgtagggtttgcacagagcccagaatccttccagaatgtactgagggagctttggagaaaggctggaaaagtctaaagatttgtggatgaaattcaaaaaaggaagggcttaatctgtgcttttacaggaagaaaaacaacaaaaaaaccaaaatcatactagaaggagtaaagagttttctgctgtttgaggtcgaaaaacttagttatgtgtcttgataatggtcta

SEQ ID NO: 39012 - DNA, 1830 bp, Homo sapiens
tgtctgtaaatccatttggctgcctttgaagcagtagcaagaagaaccctctgtagcaactgtcaatatttcttttccccgtggtgtacatcaaactcgagactggagacagattcttcttaattacaaaggagagaaagaaacaccccaaaagacaaatcaaaaactttaccaagagaggattgatttggtcttcagtctaatcatccttagaaacagagaaaatcctattttgcccatcaataatggccctgtgtttataatttttagcctaccagaactaaagaagaacctaatttggggaaaaacttttgaagattggttattgggctcagtgaagtcatctagtttctggttttcaacaaaaaattatttcaaacaaaatattactgagaaccttcacctataaaccagatacagttgtaactgctctggttgaagcagagagaagcgagagaagtgagcaggaagtgggcactggtccatgttcatgggctccactggacagtctgtaaagatactcattgagggtatttctttttcttgacactgatggtagagagtagttgttattgtttatttttattctgccttttaactgtttgcataaatgttattttatatccctcattggtatccttttctctcatcattttgggctacatttggcagagaatgtaataggtgagagctaaaatctcttccattctaaaattcaaaggcaaaatacctttactttcttgtggttatatgttgacattttcttacacagttgtcacatgacaaccttattatttgctttattttttattgaatttttttctaaatatggctttgtacacatatatatcgacatgtatttatttatatacatgtcatatacataagagacatgtttgtataactcttccatagttctttctgagagacacatatatctagtggtagacagtaatatggaaaatcttgaaactcctatttacaaatccacttaccaatccctgaaaaaatcatttttatagtccacttacctgtccagaagcatgaacaaaacctcacccagtgtaaaagttgttgtttcccatctgtgggtcagccagggaccagaacagtaggccaaagaagcagacatttgtagttacatttgtatttgtcttataagtgaatgttccagagtccccaagtggttctggacccctacaatctgggagtatggggagattcacatctacaagtaggccctatatgaaggtgtctaagtaggtgggtaacctgccattgtcataatggggcacaaagcagataatttattgttaaaactgggatcattttgagagtgatagaaagggaacatgaatgggatcctgaaacaacaagttaccacccagggcatgtggtcaatctccttgtaatttttgctatctcccagggtcccgtggatgaagagaatcttcagccttatagatttcaaagtatagtcttaggttgtataagcaattatgaagaaaacctcagcaactccagaaaaggaaagcagtcatatttttgttaaagcaaactgatgctttatagcaatcttaacaggttacagtggcttcatcttgatcatggattatgaaagcagtgcagtgagagagccagttgaacaaccatcagtgtaatgaacatggtgaatatggtgaccaagaagacaagagtttgttttttttctttttctttttttttgagacggagtttcgctcttgttgcccaggccggagtgcaatggtgcaatctcggctccctgcaacgtccacctcctggcttcaagggattctcctgcctcagcct

SEQ ID NO: 39013 - DNA, 1073 bp, Homo sapiens
ccttttttcaggcctaccatctctcctcagttcttatgaaccctgcttagattgcagaaacaggtgaggctgctgccaaagcagaagttttccttctggcatttaccccagtcttttggaatgaatggcctggaggccctctccattgtattagggaggaagagcacccgtcctccctccccaaaaggattctggaccatgaggttgattccctcacagagctgaggactctcattattcccaccccacagctggggtggtagacggtggatgtatgtgtttgctctggctgacataacatagtaccacagactgggtggcttaaatgatagaaatttattttctcacagttctggtgttggcagtgagaggtgaagccagctgggcttctgggttgggtggggacttggagaacctttctgtctagctaaaggattgtaaatgcaccaatcagcactctgtgtctagctaaaggtttgtaaatgcaccaatcagcgctatgtctaactgatcgggtaggggacctggagaacttttctgtctagctaaaggattataaatacaccagtcagcactctgtgtctagctaaaggtttgtaaacgcaccagtcagcactctgtcaaaatggaccaatcagcactctgtaaagcaggccaatcagcactctgtaaaaccgaccaatcagctctctgtaaaatggaccaattagcaggatgtaggttgggccaaataagggaataaaagcaggccaccgcccccccccccactcccgccccgccccaagcagcagcggtaccctgctggggtccctgtccatgctgtggaagctttgttctttcgcacttcgcaataaatcttgctgctgctcactctttgggtccacactgcctttatgagatgtaacactcacggcaaaggtcttcagcttcgctcctgaagtcagcgagaccacgaacccaccggcaggaactaacaactccagaggcactgcctttaagagctgtaacactcgccgcgaagatctgcagcttcactcctgaagaccaccaacccaccaggaggaggaatgaac

SEQ ID NO: 39014 - DNA, 1092 bp, Homo sapiens
aatggatgaatgaatgatatttgaaaatttcttattctgcactgaagtgaaatttaatttggattttgagtagcataaagtcaaaaatgcctttgaactctggagcacagcaggaggttgctttgattctgaaaatctggaaagattttttggagtgtctgagctcaacattaatataactttttaatgctgaatcaaaataagagatctgtgacagctattcttaagaattttggtctaggactcatttacactctttaaaattattaaagacccaaagagctttggtttctgtgggattatctcaatttatattcattacattataaattaaaatagaggaatttaaaaatatttatgacatgtccaaagaacaaaagtaagcccatgtgggttaatctaaataatgctttttaaattgtgttttccaaaataaaacagaaagtgagaagagtagcattgttttacatttttgcaaatctctttaatgtctgacttaatagaagacaagtggactcacatatctgcttctgcatcaatctgttgcaaaacttgcattgtatacttgtaggagaatgagagtgataaaggcaaataatgtgttagtatgattatgaaagtagttttgaaggtttggacttcttgaaaggatcttagggatttcccacaccacacttggagagccactgatgtaagtcaagtccattaggaatccatagcctctgagttttgcaatctccatttatcagcactaatgagctgaacagatggaaatgtttacttccttccattgatgtttagaaacaagttgactaaaatgattttccaatgtcattcactcacccttcagtgctaatgcccatcctcaaataaatgagaacattaaatagctagaaaaaaagtttgttgaagttatttgacaaaaataaagaaattttgattagagttaactgcattataaatgcttaaagacaatgtgtggcctttctcaaatttagagtccgctaactgggaatgccaattaagctttgacctgggattggctggcagcatcccaggaaaagtctggcagtgttgttgaagaatactata

SEQ ID NO: 39015 - DNA, 1034 bp, Homo sapiens
ctaaaatgagctcttaatagtgtaagactaatatatctccatctgctatatctggggtatttctaggtttgtagtttgccatttacttgtctatggttttaaaaatatatgcatttgagcaattttaagtttttatgtatttaaatctattaaatacttttgtggttttggtcattgatttttcttttaatgcataggatattgaggtaattctttatcaaaattttttaatgatagggaaagattttcagaggcagaggcttaaattttagcttcatttagtaatggatttccagaagaaacaagcagttggaataataaatattaagatgaaaaattatttttatgttaatttgggagtagatttagtttttacttgaattttaggaagattgtgcttcatattgtaccaaagtcttttctgataaactaatacaagtatttattacagtcatttttttcagagtaaattattttatttcttcagatgtgtttatctgaactgaatttgatttcctctgctattggacctatcttctccctccaaagcagtaaagtggtgcctgattttttcatgctttagaaatgtccaataacagaaataagggcctattttctctttggttccactttgaaagaatattcctatggaaaataactcttccccctcccctggcccccaccctctccagtttgcaaagaaaataaatcttaccagattaccagttgtatggagtctgtcacagagtccaggtcccctttaccacatttacttagtgtttttcttcaggctggattagtcgttcccttttttgtggacaccaacaccgtgtccctccccttccttacatcttcatcataatgagcaacaagccatgtggtcttaagtgctgtttatcttcaatacacagttactcactacaaaaactttacttttcccttcacgttattttcttcactggccctttcctttgactcctagcttgcttcagacctaagtcagctttcctctggcagaaaccctggttcccatt

SEQ ID NO: 39016 - DNA, 1073 bp, Homo sapiens
cagaagtagacttcagatacattcattttacctaacctgcatctagaaaatattaatagtgctttttatttcactaacacagcttgctctctagtaatcagcatactggtatgttcccaatcctgctgtgttctgcctttacatcaaaaagagaaaatcttgcttaaaacactcttcttaaagcacagagagttaaaattttataattatgtctttcttttcttctctgtggctcttagtccaaagtcatgtaagagggtctgttgtaggagaaaagagaaaatccagttctgcttccataggatgtgctgcgcgatcatcaatgtcattgttccttaacttgtatccatgggatccagctgatgatgttttcaatattggagccttttgtttcccagcatgatgggatgatggagcactttgtacatctcatcaggagtatctgattcatgtttctcctaactgtgccagcaagaattacttatcagaatttttttccctttactgtagtaaaaagttgctgttagcacagttgtgaaatttcttctacccgtgttgagtttgaggcctctgattctttttactcatcgaatgggtttctgttttatatgtttatggtaaccatggaaccttgtctagagcctcatgtgtaagattgcagactctgtttgtgaggtgttctcaacatcgttgattttgagacaatgtgtgaggggggaaacttcagaaatctacataagtaaacctcccactgaggtttgggtgatcagatgggctagacctccaaaacctctgctaaatctgggattccaggatgcacatcattaaagaaatgtaaggggtggcaggaggtacaagcacccttgattgtctttgaagaaagcctaattattcccatttcacaaagcccctgattacattgtagaattacaagaattaggttgaacatccagttctaatgttgtatatgttgaggtgcctgactaattcaaaatacatttcattggaggatattacaatttctagaaatgttactggatataagataaagagaaaatggaacagaaaggagt

SEQ ID NO: 39017 - DNA, 1023 bp, Homo sapiens
ttgttctctttctacagatgcgtaaactgaggcttagaaaggatatgaattaaccagagtgcatgacagagctgggagagtaactcacacatgtctgatgtggaagcgctagtccttcatcctacactaaactgcatctctcattggctaacaactcaatttgtttctacaatggtgttactgtcttctacactacttcttaattcttcctttcctcattaaatgcaatatatgtatactattgcacagaaagctaagaatactacagatcacactttgataaaacttccttaattgaatcaggagtctatcaaagtctgtagttgcctgagcttttgataccacatatgtgagaataaaaaataatgtgtttctttccccattccattaatacctattgatgaacttcctatagtaaatgctgagcaaactgatgtgagtatagattgaaactgagaggttgaatcacaggataagaatatcctgagtcaaattagccccttgaatttgttgcctgtaactttttaaattgagcagggatggtactcatttaaatgtctctgtttttaatggtgatactcagctaaaaacaaacattagacaattcacaattcacttgtaatgggcacatggagggagaaagtgcttgagaaatggtatctgaatttatagctcaacttgtatgcagagttgtttgttgtgtagaaaaatgcaacaattaaaaagtcattacattatacatttctaattggagcatctcaagatgttcattaaacagcataaaggatcatctgaggccattgaatacctgtagttgagtggcataactatctatacacacttttaagccgtatgctctgtatgttgttaaaatatcttcagagaaactgtgaatacctctatccattgactcatttctttttgactagcaagtctttcaattagtgaagacagaaaacagctcgtcaaattagttcatgtttttcttaatgtatctttaaatttatagaaaaaagtaaatat

SEQ ID NO: 39018 - DNA, 1076 bp, Homo sapiens
ttcccatcctgagatctaatattcaagcagattttttttctaggtttacaaaaatttttttctttcctcttttccatctttttaacttcttgtatattctttgatttgtaattgttttctgttttacacaaagtattatttactttcatttatgagatatttaacatcattgaatttgttcatttcttgagtttgggaaatgaaaaaggatggtgtaaaaaaatcaaccaaaaatcgttatgattctgtattctttattaatattctaaaatatcctatacattggagcagatgtgaacttcccaaccactcctttagtattccctctccctatttatttcctttgcattcttgtccttcttcgcctcttgtcttctctcagttatcatttgataaacacgaaatctattctttgtctcctcagctaagcaggtatgaagatcttggtcacagagaagccaaattaggaagtttgattactctgtacataatatgcctttctgactgagagaaattgctgacttttgtagacattagaaatacttcctattcagctccatttatttctctatgagagagatttttaatggaatggcttataattatttttaaagtgccatgaagaaatagagtgaaagttttttaaagctagaatagtgcagagagaaattcaattccttattttgaaattaattgatagactttccagcagtcatcagtatctctgaagagtactttagtttcattagcttcacccctctacaatatctatcagaaagataggaattttgcagatggcattgggccatgcttcatttctggtcaaatcacaccataatgatgccacttattcatccataaaagcttgtggaagtgcactgaacatctgcacataatgcaaccattcatgcaaagaaagccacagaccccgtttatcacaagggatctgggagctctctcttcctgctcagtcagcctcagaagtttcaactgccctgggagagaagtgccaacagcccattagcctaatgagccaatccatagaaacatgctctttctgccctcatgggtgcctg

SEQ ID NO: 39019 - DNA, 1034 bp, Homo sapiens
ttttaactggtgaatagcttcaatacttgtgggttccttcattaaacaaaaattttgcttctgccattttctaccactgaaatgtattataaagctgagcatgtattttcccattagaaaagtaagttggacaaatatatccaaatgttttgctaaataccaatgagagccttcatgaattccacccagagttaagttcaatgaggtagggatgttgtcttgtatacctgacacctaggaccagacatatggcaaatgctaaataaatatttattgaatgaatgaagccatgaatgaacttagattttccatatatacaaagggcatgtaatcccagcactttaggaggccgaggcgggcggatcatgaggtcaggagtttgagacctgcctggccaacatggtgaaaccccgtctctactaaaaatacaaaaattagctgggtgtggtcgtgggcacctgtaatcccagctgctcgagaggctgaggcaggagaattgcttgaacccgggagctggaagttgcagtgagcctagattgcaccactgcactccagcctgggttacagagcaagactctgtctcgaaaaaataaataaatgaaataaataaataaaaattaaaaaaagggcagtcatattcaaagttctgtttaagaaatggccaaatccattttaattggacatagattggatggattatatggtatcgtaaatcatcatagtattctttatttgaaagtgagaaaagaaaatgcatattttctgtttttcacaagagcaaattactattgaataaattgtcaatgaaataaaattacagcagaggggaagattcattaatgccatttcccatctttgtggaaataagtgctctccatggctgatggaacattacaaagagtatcatgcacatttaatttcttcatattttttgtatataaataattgtctatttaatatgattacttcttctgaaatacccacatttaagagaagaatattaaaactttacatttataaattttaaggtaaaa

SEQ ID NO: 39020 - DNA, 1032 bp, Homo sapiens
gttttgagagaacaaataagtataagaaaacagaaaacactgatttgctcttcaccttcaggtccctgtgcctccacattaatgcaagtggacagttttgcccagggtcacagagctaattagaggcaaggcagcaatttgaatcctacacatccaatcatcttttgactacaactctgtaaagtacattaacaccctctattcttttgtcttgtgttgccattttctagtgtgcttgtaattatgcactcagtaaaactgagtgcacaaaatgacaacctcagttccttagtataaattttattctcattttcttaaaagatttctagttcaaatttgtccaatcctgttttcagatattttctcttagatttatgttccacctatgcctacttaagaaaaaatttttctgatgtcgagtgtccaccttcctgacaaagaagtttcgttgttagcttacaaggaaatttgcatgccagggaagtaatgacttgggaatttattgactacgtattttacagttaacctctgaagatagaaactgtgtgcatatttgatgctaatattgttatttaggattcttttaaacgtaagatacacttctataggtgggagttgactaaaatattcttaactaaatgtattttgatagcacatagaggaactttagtatttagatctctaattccagaatctgtcatggtaaatattcctctgtggtccaagaaggtctttatatcccagacctaagtataaatctgggatttactgatggtttgacacaaatgttccatttaagagcctctaattagtttgaatcattacagaacagtaaagtctcttgtttttatatctgtctgctcagttagagatgaccattccttcaatattaatgcactgcaaggattaattaattgcttgttgaaagctcttgaatatattttcagagctgactaatacatccttgaggtaaggacaaatacaagagaaaataaaagtggtttatgatattccaagaatgaactcctattc

SEQ ID NO: 39021 - DNA, 2158 bp, Homo sapiens
tattggctctggggtggacaaatccatccaactatttgtggatcaaagtgaaattaattgacatcatgctttttttcccccacttacatagagaatttctagtcacactacatgctgtgtgcacaatagttaattaggcacttacaatacacctaatacagtgttgggtgttatacaaattcagaataagatagtttacagtcgtggcttattagaaaaaatacagaataatctaagtctgctattgctacatagtggtaaaaaaggacagcttttgcatcagacttgcattcgaatcagtgtttattagctaagttatctcaggcaagttagttgacctctgagtttcattttccttacttgcaaaatgggtataataatatttactttgaaggcacataatcaggataaaataagacatcgtatataaaacacccagcacatagtgaacacttagtacatataacctactactataaagatctcaaaatgtatattgtagtttgtaggctctcaagattcaggaaaggttgttctcttcatgggttggaggcatttgggagtaattcttcatgataattaaatggggctcttgatggcctgtgagaaatggtgggctctacatggttaagaaatccacaaaggatgctaggacttatgaaccacaggaacatgctaaaaacaaggattggtacagacagaaagtgtacactgggaataaattgtggtattcagattttgaaacccaagctcacatttgtcacttctctacaactctttaaaacccaattgtaatcagatatcttcttgggggttggtgtggtcatgacaggaggcagctttggatttctcaggagctgtggagaactctgggagcagaagttggaggttaactgaaagccaaaggagagaaatgccatcttctcaaggagattcagagacaccaaattttaaggaagcagaaatggagatgtaaataaatgtcatagagcaagtgttcagaggcacagacacaataaaaacagactaagaacaagccggaggacatcctcagtgcattaggcaatagccatcctctgaggctcacctatatgggctggcaggtaaattggactggcttagtgatatggtttggctgtgtccccacccaaatctcatcttgaattgtactcctataatttccacgtgttgtgggagggacccagctaaagataattgaatcacaggggcagttcccccatactgttctcatggtcgtgaataagtctcatgacatctcatggttttataaggggaaaccccttttgcttggctctcattctctcttccctgttgccacgtaagacatgcttttcgccttctgccagattgtgaggcctcccagccatgtggaactgtgagttcattaaacctctttttccttataaattacccagtctcaggtatgtctttatcagcagcatgaagatggactaatacacttaggagctggtcttggttgatcctccggagagattgttttttaacttttattttaggttcaggggtacatatgcaggtttgttatataggtaaacttgtgtcatgagggtttgtggtacagattattttgtcacccaggtaataagcctagtacccaatagttattttttctgctcctctccttccttgtaccctttatcctcaagtaggccccagtatctgttgttcccctttttgtgtccatgagttctcatcatttagctcccacagagaacatgcggtgtttgggtttctgttcctgcattactttgttaaggataatggcctccagctccatccatgttcctgcaaaagacatgatgtctttttaatctctccttacttcttttcacccattctgaaaacagctgttctctaaacagagttttctaaatacacttcttttctccatttttgaccacaaccatcaaagaccagactaaatgaaaagtctttgttttcccagcaggaaatactcatactacacttctaaatttttttatgacctcacccttaccccatgccacacttctttaccagactaaaagctccttaaggacaaggactatagtggtaaatccttgtatttggcacagtttctcagaaatagacagtgtctcttatagtgctatgaaca

SEQ ID NO: 39022 - DNA, 1042 bp, Homo sapiens
tacatctttggtaatgttacttccatgtaaaatacgtgcagtacacatactccaaccctcctataaaatttagttcagagcgcttcactgcctgtcaaccctgatggccagcctcatctaacacttctgtcattcaaataatacttattattaataaatgcctactattgtgccagacagtatcctagatattggagatatagtggtgggatgggggtggggagacatttagacaaaaatcaagtaaataagtaagtaaacatcaaaatgcaatgtttggtacaaaggaataaagcaggttttctaatcaagagggtgggttgaaggtgcattaaagagggagatagagaaaggcccctttgacagatcatattttaactcaatagtaaccgcccttcagagatcttgcaagcaaagggatcagcaatggaaaaacgccctgaggcagaaacaagcttggtgtatcagaaagacagaaggaaggtggagtgggtagagtggagtcagggattggaaaggcagcgggttagagaagttgtcatgcttgagtaattgggaccttatctactggatgaggacttcagatgttattcatggtcatttgctacagccaaacagaccatcttctttaaaaaaaaaaagcatcatctgtacttaaacttttatgctattgcacacatagctgtccccatatggacactctctgcctcatttcttcctgttgaactcttagcccattttaaaaaataaagctaaaatccaatatcatccataaagtctttcctgattgctcttacatgatatatatatttttccttttctatgtagccatccattcattcttggaaactcaattagtcactgagaatgcactatgttccaggcactgtgctagacactaggaatacaaagataaataagacactgtcctagcctttgtaaagcccattatttggtgaagaagatagccatatgtgagcagatcattatggttaagcatgatgaatgctctaatcaattaaaaatgaagcacgttgggtgg

SEQ ID NO: 39023 - DNA, 1033 bp, Homo sapiens
taaatacttaatttattaagaatttacctttaacctatttatgaggtgggaagttttatctagctaattgtttccaacattgttggtgtattaggccattctcacattgctatgaagagctacctgagactgcatagtttataaagaaaagaggtttaattgactcacggttctacaggccgtacaggaggcatggctggggaggcctcaggaaacttacaatcatggcagaaggcaaagaggaagcaagcacatcttcacatggtgacgagagagacggagagagaagagggaaatgctacatgatttcaaacaaccagatcccatgagaactctatcacaagaacagcaagggggaagttcacccctatgattcagtcacctcccaccaggcgtctctttgaacccgtgtggattacaatttgacatgagatttgggtggggacacagagccaaaccgttatcagttggttaaataattcatattctcaccatgaatttaaaatactgtctttacgatatactgaatgattccatacaattatatatctagcctttttagtaggcagcattgatttttttttcacccctgttaacactgtaattattgtaggcttagacgctttaccatatttattttatatagggccagtttttttctctttcttgaaacttccttgcctatttttgtgcaaccgtattttagttttacttgaggatgacttttcaagcctctttcgtcttctccatctatatcactgttcccaaattttatgttttttaaaatgaaaaattgaaattttaatgagttgacagattaatctttgaagaacttacatcttccagttttgagtagttgtaaagaaagcattgacttgtccttcattttaaacagacaacaatactagcaagatgaacactcaaaggcatccaggtgcaaagtgcagtgtgtgcaggggaaggagagagcccaggttagtcggggctgctggggagaggctctgcaaagagattgcacatgggcagaggctta

SEQ ID NO: 39024 - DNA, 1045 bp, Homo sapiens
aaacagaggtaattcaatgtgggtcacagggttgctctcacatcaggtatgcagggttgccatctgaccatggccacaaaagtagtttcttgggaaatagcccatttgaaagaattattgagtctagtaaataggcagctttccttttagggtatctctcagcctttttcctccttttacctcatccacagagtggatgttgaacattcattcactcttctttcatataaaaatatttaataagcaccacttgtaatgaatcttatattcaaaataaataggacgtcttaaaacagagtaaggtggcagtagaaggtgtgaggggtgagaaagcaaggctactgtgtttggttgtgcaagtttacattaaacaagggcattcagccataggggtgatggaactgacaccagactgatcaagtcttatcatgccatgcatcattgcataaagatgtgttagcccagaggaagcggagaaaaggagggtttttcctaattagcataaagacacttctacattcatcaagctctgcattgaaggactggattcacccacagaaggcactttttttggtaacttaagtaaggacaccctgtggactagcagcagctgtgggaattaaggagagatagatctactacacattgcacagttgggggtccaaatgtgttttaaatcttaaaccacatttaagaagctgttgcagaaacccagaaagaaatcatggtgcctagaacaaggtaatggccgtggagatagaattgatggatctgctgatgggttggatacaagaggtgtgggaaagagagaggaccctagaactctggcatgagcgtttgataaccatttttataatttactaatatgcggaagactcaggatgagggccagaatggtgagggagaacttgaagagttttgttttgaggagtctcactatagatactaactggggattttatattttatacatacttggagccccatagagcagccatgagaaggttcatccttacgtatgcccaaaacctaaaagaaacaaaag

SEQ ID NO: 39025 - DNA, 1062 bp, Homo sapiens
caaggtagcaagtattgccctcataccacgaatatgaattgtcactgtttggctaaagtagaaggttgggcatagtcagcatatatagctagtccaaaagcatgctttctccaaacacacacgagttttttaaaaattttttcctgcaatttcaagtcactccatgattaacttaagagaggaggatctattcaaacgtaagaatttttttattgattcatcaaagttgtaacatagaaagcataaaacaaaaaaaatctgttaacattcataaaatactattatgcagttgtagtcaaagcacagaaacaatttttattaaagagttttttgctcagcattatactttaagcatttttataactccacaatcttttggcaacgataggaagttgctgcctaccattcaatcaagttgatgcactataacttaatgagccattaagttataataacatttaggtcattttcaatttttatattatgaataataattgtgatgcaagtctggcttcccatcttttggattacttccttttagtaaattatcagataggagattactgagaatgtcaaagaatatgaatattattgcttctcagtttgcactgccatcagcaatacaggaggttataagttttgctcccactatttaaacataggtgctctcactttttctactttcatgagtataattgatgaaagtttgcatttgctaatatagtaactttaaattttgcgttctggcattcaaagataggtgaatttactccattatactaattatattatattatttgcacacattcatgtgcaaatacataagtatatattaatataagtaatatatatcaccctactgatgaatcattttgtctctatgcttagatcagtgatcttttttttcttaaacaggtttttctagaaataagtaataccacataatatttttaagtcttttgctgagaaaatcctgtaaactccccaagtgtcaggtgtatcatccattctttttactactattttgtaaggacctcaagaaatggatatacagatttagta

SEQ ID NO: 39026 - DNA, 1033 bp, Homo sapiens
cctgagttaaatctatgtataccccttatacactgagaactgagcagaagcaactggagccaggcttatctcaggagtttttggaacaggggcttgggtatgcttcacttttgtattcatcagtgttctccagagaaacagaaccaataagagaccatatatatataaaatgagaaattggctcacatgattttggaagctgaggagtcgcatgatctgccatctgcaagctggagaactaggaaagccagtgatgtaattcattttgagtccagaagcctgagaacaggaagaaaaggagctgttggtgtaagtctcttcatccaaaagcctgagaaccaggagctctgatgtctgagggcagaagatgaatgtccctgctccagaagagagaaagagtgaatttgcctttcttctgcctttttgttctgtctgggctctcagcagattggaacacttgcccacattggtgagggcaatcttctttgctcagtggactgattcaaatgctattcttttctgggaacaccatcacagatacctggaaataatattttactagccatctgggcacctcttagcttggtcaaattggcacataaaattgaccatcacagatttcaatttttttgtttatatgttgggagaaactcttcccagtacagtactcttgggattgtggaatgaatattttttaaaggctttttttaaagcataactgaccttctagtaaagttacaggaatttgtggaggccagatacgagtgcaggccagtagctcctatagacagacactctcacgctggttatgtaactgaggcatgtgactgctgctcgtagtgttctagaacctgggttttaacagttgccaatatggcattcaaaaggaaaggcttggaacgcagcaaatgtgaaatgttggaccagagacctagagtaaatccaggaaactctcagtggatgagctaggatgaaatctgtcccataagaaaggaaatagggaaatgtgcctgtctgagttttggtctgttga

SEQ ID NO: 39027 - DNA, 1372 bp, Homo sapiens
gatgcaggacaggtgagccccaaagtggggcttaacccacagagttcttggcttggcctaggaaagaattcaagggcaagccagaggtagaagaaaatggctttattgaagcagcaatgttacagctctggcagtgttacagctctctgactcttcctgtagagtggggctaccccataggcagagatcagaagcttagggcaattttgcagtcatattgatactcattttaaattacatgcagattaaggggtgacttatgcagaaatttctagggaagggctagtaactttggcaaagccattggaaagcaagggacgtatctctcaccctttccttcaactacattctgtaacagccatgtttgcaagattggaaaacatgtatttgatcctgtctgaactctttattcatttcttcatcttcagttttcttatagtaactgtcactttctactctatatgataattgtttatttgtatattttctctttcaagtttgtaaaaatctttgaaagtgggacttgtgtacttggaacttaataagccctgaatcaattcctaatgtttgaataaatgcagaaacaattcatctttgtttccttcacagtatcgtgtatgtgatagatgctaaaaatatatcaaacgtttgaaaataagtcaatgaatgaaaggatgaatttctaaaggccagctattgggcaaggcaacacaagtgacctctagtagttttatcactagtaagtgcatttattcacacaggacacaggtatggaacactaaacaccttttcagtattctgctatggtctggaaatgtaaagataactaaaaaagatcccctctccgaagaagctttaagtattatagacatagaatggatgcaggttcattcatgctacacttggatgtccaaagaaactgtactttctttatattctataatcgatctaatctttatagtgaaccttcttccaaacaccctccacctggctaagtagcagtaggtggagggaaaagactgactaaatgtaaaacttgccaatcccttctagtttaaaaactctctttggataactcagttgcttttggacaaatgctcagcctctcagacatcacaacccccacactcatatctgagatggtctgtggatttccaggaggtttgtgtgaccttgtggcctgatgtcggtcctgtgcctaatgtccctaggggcagctggctagtagttggatgtgcacctgctgtgctggacacggagctgctgtctggcgttctgctggcctctgctgctctctcctcccagcagttgtctctctcttcttgtggactgctcccacctgcgcttgattctcactgataaagtgaacctc

SEQ ID NO: 39028 - DNA, 1063 bp, Homo sapiens
tgccctaggttgcccagaatggagaagttccccagatgtggaacttttagtgctaaaaccaacagagtcccaggaaaacaagatagttggttccccctatttgagaggcagatgtattcaatgggatggatacattttcaggaactgcactgatagtctttcaacactctagaataatataactcaccatttatttcttgtcctagtagtaagtcatgatttcaaatagccttcctttttcctcccaccaccacgcatacacaaacatgtctccaaacatgatgtttctagtacttaaacaaaaatcggataaggaaagccagtttttgcaaagcaattatgactaggttgattggaatcaaggagcaatccaaaatgagaaatgcccaacccaaagagacaggtgcttcaggaaataatttattcacttttttaaactaccatttagtgaacacttactaagtgtcagatacaatgctaagcattttacatgtcatattttattttattctcacagtaacctaattttaatataaggaaactgaagttcaggaagactctgtagttttcccagtattacacaggtagtaagtgatagagatgtgatcagacccaactctaccaataaattgaaagctgttctcactgaaaacatttaccataggatgtattaagacttgttcagtcagctcaattcatgtagccttttattgagaatgtataatgctgcaggattcatgctggagaccacacagaatatacagctgagtgagccacagtccctgcccttcaaccatgatttgtaagagaacagttggctgcggggaaatgagatacacaagttaacaagtaacagacaaggagtggagtatggtgggtgccatagacagataccaatgctgtgaaattcagaggagggagagaactatcggtttgggtagacacttcataattttaaacatgtccatttacccaaaatttgtaaatcattatcacgtattgtggttttatacatacataaatgacagatgttctagcataactttcaccatgaacattgtgc

SEQ ID NO: 39029 - DNA, 1034 bp, Homo sapiens
ctaggattacaggcgtgtgccaccacgcccagcccaaaattgagtttaaaacaaaaagaatttttaatgaaaaaatattaatgtgatagtgaattacatatatttacactcttatgttacttacctcaggggagttgaaaatttcaacccataaatcctttcactctcattttctaacagttacacattttgcccatggtcaaagtgcaatcttgacggcttctgttatagcttccctccctgaatagcagagggtggaaatgtatactgattctgtttgttctatgccatgttcactaaactgctggaaaatgtcctgaaaccaatataacttgtgcatgtattagcatatattcatagacattagccaggtgtggtggcaggtgcctgtaatctcagctactctggaggctgaggcaggagaatcccttagaacttgggaggtggaggttgcagtgagccgagatcgtgccacttcatatttgtataaatctgataagtgaaaatctgatacctggacagaagatagtgggctttgtagagagggtgtgatctggaagagactgatctctttcttagagaagacttctaattgtgtcaacataggcaaactttttatatcagaacgtgtctagagcacagataaactttactaaatctcagttggaaattgcatgacttctataaaaatgtcaaaatagaataggcaagggaagctcaatttgccgatgccagattcttgttaagaaagttttaatgatgctccctctgtttgtttgtttggttggttcctaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattgtgagtaaaaataacaagaaatatagatagtagagggactgtcaagacttattcttacaatttttgttcttgggatgtaaaa

SEQ ID NO: 39030 - DNA, 1217 bp, Homo sapiens
gaaatcatttgaaggtacagaactgactggtagtaatcagtacacagaagaacacagattataacactgtgattcttgtgtgtaaactactcttaagtaaaaaggctaaaggatgatccaataaaaaataagtacaacaactttcaagacatagaaagtacaataagatataaatagaaacaacaaaaagttaaaaagtggggagacaaagctaaggtttggagttttttattagtttatgcaaacagtgttaaattgctatcagctaaatttaatgtgttatagtatttgcaagcctcataactttgaataaaaaaattagtagatatgtaaataataaaaagcaagaaattaaatcataccactagggaaaatcaccttcactgaaaggaagacaggaaggaaggtggaaagaaagagaagaccacaaaacaaccagaaaacaaataacaaaatggcaggagtaagaccttacttaccaataacaacattacatgcaaatggactaaactctccaatcaaaagacatagattagttaaacagataaaaagataagcccaaagatctattgcctacaataaacacaatccacctataaagacacacataaactaaaaacaaaggaatggaaaaaagatattccaggcaatggaaaccaaaaaagagcaggactagctatacttatataagataaaatagatttcaagacaaaaactataagaagagacaaaaagatcactatataatgataaagggtcaattcagaaaggggatataacaattataaatacatacacattcttttcctcagcacacggattattctcaagaatagaccatatgttaggtaacaaagcaagtcttaaaacattttcaaaaattgaaatagtatcaagcatcttctctgaccacaatggaataaaacaagaaatcaataacaacaagaggaattttggaaactatacagacacatagaaattaaacactatggtgctgaatgaccaggggttcaatgaagaaactaagaaaactggaaaacttcttgtaacaaatgacaatgtaacacaacataccaaaacttatggaatgctgtgaaagtagtactaagagggaagtttatagctgtaagtgcctacatcaaaaaagaagaaaagctttaaataacctagcagtgcatcttaaggaactagaaaagcaagagccctcaaacccaaaa

SEQ ID NO: 39031 - DNA, 1031 bp, Homo sapiens
agaagaacctggcacattaattatttccacttctcaaaatagatttattgttaatttcccctttcagttttactattctttcaaagagataaagatttaattctgggcactgccctacagaagccatacaggacattttagttgaccaatctttaagtaaaaacagagtcctttttcatttcataaataccttgctgtttatgtattgcttatagcaaataagaggttcggaaatctgaaatgcaaagataaaattctttgcagcagttttcagaagtagttattgataaactgaatgctataacaatgagttttaattaggatgcaaagtaaacagaacacataattgtttatattctaattttcttcatttagtacacgaggaagggaagcataagctgtttttgaaataaggtgtgtgtgtgtgtgtgtgtgtgtgtatctctaagatgtttggccaaaatttcatttctagctcctaaagttacctcagtattcctctttaaaagatctttttcttaactgtcctctctgcccaccaacctacttagattctgtggttcataattccaagaagtgctttgccagtatctcaagccgttttctacttcttttttttttttttttttgtccaaccctctaactttagcaaacatcaactttttcagtacctgcaccctagcagcccaggtcttagcagaaaaagtacggtatggcagattgattccatcaggtttcaaatctgacttcaaatgatcctcaacactgtctggcaagccccttgtttctatttggttgacttactttcccacttaacaagacacttccagactttctccattctcttctactctctccaacccagtggttgccacaagagagtggggttgtggtgggaggagcagttatgcctcctacccctcggtgacatttggcaatacctgaagacagttttgactgtcactgtttggggtgggcaggagtgccactgaaatgtagtgggtaaaagccaaggatgctgctcaacatcc

SEQ ID NO: 39032 - DNA, 1057 bp, Homo sapiens
gacaacaacaataaaatgttgagtgccagtgcaacactacagggagtttataaataaagcaaaaataaacccacaaagacagttctattttgggtagcacagaaagataagaatagaggcaagatgaatatgtaagatgcacgtataccaagcagcaggcacacataacgtaatgattgctgtttcccaactctcagaagcctgcctgactgaaaactgatcactcattgctctcctgggctttttcctttcttagcagctctgcagtgttgtccctgtgagttctgtaccaaagtgaggtgatggtctcaagcaggctaagaaagttttgttattttatttcctccatccctttctttttttcttccttctcttctctgcctttacaaagaaaaatgttaaaaaaggaggggtggtggaggggaggatgtgaggttttgatgaagaattctgaatctgtttggaagagggtcatggaaatcctctgactgggataggtgtgggtacaataaggctgtgctgagcatactgagctagtttaattgagtttgttcagtattggtggaaacattcttttttcttttaatttgtttctgccttgttaatctatttctgatttctccaaactatacacatggaggtatgctatcttccttctgtcctcggggaaggaaaagggcgtgctgtttgcaagttatgcctgtgctcctgtgtgtcacgacccttttggagagtccgttcaggttagtggtgtttgcaaagttttcttgtctctgaaacctactcagtgtctctagagtctcctgctgaaagaggaaaacactgtaacacatcatagtgggctgcttattagaaaacacaactctcatagcaaatgacttttctatgaagtataataaatcatacacttggtaataagtagaaagtgttagccattggaacgatccttttcctcttgtcaagattagggcaattagatagtccatatggattttcaaattaaatatctgctctgattatgctgctttaaaatattttatttgaagtaatagattgt

SEQ ID NO: 39033 - DNA, 1032 bp, Homo sapiens
atgatatctaaaactgtaaaactgttagaaggaaacctaggagaaaatctacacaacaatggcctgggcaatgaattttagatgtgaccccaaaaatgccggcaacaaaattaaaaaatagacaaatgagattacatcaaaattggaagcttcactacacagcaaaagaaacaattaacagagtgaagcgataacctatggatttaggaaaatataattgtaagccatatatgtctgataagagattaaatccaaaataaataaggagctcaaacatctctagaaaaagaaaaccaataatccaattaagaaatgacctgacataagaagagacctgaacagacatttctcaaagaagaaatatgaatggctaacagatacatgaaaaaatggtcaatatcactaatcattagagagatgcaaattaaagccacaataagatattgcctcatacctgttagaatggctattatcaaaaagacaataagaaaacaaatgttggtgaggatgtagagaaaaggaaacactttacactgttagtggaaatgtaaattaatacagtaattatggaaaacagcatggagcttcctcaaaaaactaaaaaaagaaattctatatgatcctgcaatcccacttctagatatttaaccaaaagatttgaaatcagtatgtcagagatatctgcactctcatgttcattgaagcagtattcacaatagctaagttatagattcaacctaagtgtctgtcaacagatgaatggataaagaaaatgtgaggtatattaacaatgaaaggttattcagcctttaaaaatagagaaattctattacttgggacaacatggatggaattggggagcattatcctaaatgaaataagctgaacacataaagacagataccacatgttctcacttatatgtggaatctaaaacatttaaattcacagaagcagagagtggtatggtaggaatattatcagaggctggggaaagagaggggatggagagatagtatgagtacaaagcct

SEQ ID NO: 39034 - DNA, 1049 bp, Homo sapiens
catgtccctaatgcttttttatttttcctcatcagcaaatttaaactacaactttatcctgatcccactgctgctctttgcctcttctccccccagcccttccacatttaccagcctcctccctacctcctcccagcctttccctttgccctcccctttcttctagcccctcctcccagttgagtcagtggcttgaaacttttaaaagctctgtgctccaagttacaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtaagtttttaaaaaatgagaacacgttacctattagtttctttttctacaagtaaaacttttctaaagttttaaaatgtgttaaatgtaattttgaattatgatactgtaaatggattgatggatttgaaagtgtttctatagttttaaagttaaaatttattgtaccaaatatatattttgactgttaaaaaagtttctattaacattgcaacaggtgaaaaggttcaaacctttccgattagaataaaggattagtttactggatgtttggtttttcattttagagtatcattttattttgttttttttttgtaatcagtaatagtctaggtgctatcatttgttgggtggggggggggcggttaggcgcctgggttgggggatttgactgactacatcggaaaaatcaaagtgcaaatttgcttagcgtgcttcctatagtattctacacttcatagaataaagtgcttttttcatatggaaatcttgattgatgttctatagctttgcaaagccaacttcttttgtgacgaagtgctttgttaaaacatcgtggttacttgacttccacgtggttccttcctagaattttccccattaaacaaaaaggtataaaattcaagagtattaa

SEQ ID NO: 39035 - DNA, 1068 bp, Homo sapiens
actccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaag

SEQ ID NO: 39036 - DNA, 1049 bp, Homo sapiens
gattttacaaagatacaattatgtctactatgtctactgcaaataattataaaatggtacttcctctcaaaatcttttttttttattttggtcttaattgcactagttttaaaacaatgttaattatgctgtctacataattgtatttcattttctcattgctggtttaatggaagttctaatatttcaccatagagtgtgatgtggcatttggtttgagatatgttcctaaacttttgaggttgacatcaaaaagcttagttgcaatttgttgcttaattgcaattttgtttcttgttcctgttgtcaagaatagaatgttggtctgaagacatcaaggagggactggactactcaagacagttgtgggatgtataaatatatcaccatgtgtcataggaacttaactaatttactttttctttttttttttccccttgcagaatggccaaagttttctggtcttggatgagcaacgatttgcaaaagaaattcttcccaaatatttcaagcacaataatatggcaagctttgtgaggcaactgaatatgtgtgagtatggacagcagtttattggagtaccattatcagctactgatgaagccattttttttcccattagggtggtaaaggaaaattattccatacaagcaccaccaaattttgacttgtttattttagtcatttgaattttgaatatttttcagatggtttccgtaaagtagtacatatcgactctggaattgtaaagcaagaaagagatggtcctgtagaatttcagcatccttacttcaaacaaggacaggatgacttgttggagaacattaaaaggaaggtgagctattgtgaacgtgagctaattagggtattgacctggagtgtgcttggccaagatttttatttcagctgttgaaagtacagaaatgcacaactgttccttgttgggatgaattaggataataaagttttacttgtttccctgtatttttttcctaagttagcttaaaaaaaaaaaaaagtttaagttcctgctagaatatgagctccct

SEQ ID NO: 39037 - DNA, 1031 bp, Homo sapiens
tcagcctccctagtagctgggattacaggcatgtgccagctaatttttgtatttttagtagagatggggtttcactgtgttggccaggctgttctcaaactcctgacctcaagtgatccgcccacatcggcctttcaaagtgctggaattacaggcacgagccaccgcacccagccctacttatctttatttagtaagcagataacaacattttttaatttgaatcagaaaaatacagtagttattcagtaaatattaaaatctcctttggtatacccttatatgtaaatctccagttccttttatattagtttggattaaagaagatgacttgtggagaataacaaaagatggaaaattaaagcatttaataggtattcagcattctccgtgctgcgaacatttaacaacataatgcagtttcaattaaaaaaggtgaacgaagaagaagctattcatatttggcaagttattagtttattattggatatgctttttcagaataacattttagtggtttacatatgctgttgtttgagatagatcttaagatagttttagaatctgacagactttagtttgatttcaacacttaccaaattatttgtatgatcttgagcagttcccctcaattctctgtacctcagtgtcctcatctataaaatagagatgatgacttatttcttggtggtttttagagaaattttaaataagtaatacacataaaatgtctagcatagtgcttagagtatagtaagtgctgggtatatatcactaccctttatttcctaaggtgattaggaaggcctgaattcacttggtaaccacagttgaaagattagcttatttttttttaagcaaaaaataatgagccagattgtcaaaagtagtaaattgccaactactatattgatgtaggcatatgtcttaagtttctgtgtatctattgtcatgagtagcagatactacacttaggaaggaatgattctggtgctgggtgcggtggctcatgcctgtaatcgcagcacttt

SEQ ID NO: 39038 - DNA, 1048 bp, Homo sapiens
tttcactagctgttaacattttctcttgaataagcaatttagtgtctaccctccttttcatagactctaatactatgaacctcttcagttaaaatgtctatatttttttccattgaaaaattgatattgattataaggcagaccatttagtagccttttttgtaaggaaatgctcactgttagaacctgtacaatagatatttttaattgataatactctatttaatcatgtaacttcacaaagcttataagcacactttctgcacagagtctaaatagtgctccaatcaattttggcttttattcatagcttctcagtgatatactactttttatagtttaccatatgatcctcaccttttatagcacctttaggaagttggcaatgtaatttcaagacatactctaagccagtagttcttatactcacatcagtatccagtctacactaaagggttttctaaacatactggatcccatgatccgaatttcagattcagcagttctgtagtaggattgagaatttaacatatccaaagttcctaagctagtgttcctggtattatgggccacactttaagaaacactactataagatatgaaagcttgtttgtgtgtcttcacaattttctctctaaatttaattaaatattaaagattagcttcccttgtcagtaggaagttttgacagataggtctcaacattaatctttatagaatcagacaataaacttttatctttttcttttttttctttggttgcaagcagagtttgtttgtttagaaatggagcatcacgatgttgcccaggctggtctccgactcctgggctgaagcaatcctcctacctaggcttcccaaagtgttgggattacaggcatgagccaccacgcctggcccatcacctttttctaactcgaaaatttcatgattattctgaaggaactgacggtttattttgcctctgttacctggtataagataaatgttgcctatcaaacaccagttttctcttttgcaccgtagtgtaatcttcaaagtacttgaa

SEQ ID NO: 39039 - DNA, 1059 bp, Homo sapiens
ttttttattaaaaagttatagtacccatattttttgtgagttctatcattagcataaagtaaaaattcaggaattcttatttattgcagaaaagggaagttgaaacgtatgaatatttgactttttttaagtaataaggattttttttttgacatataggaactgcacttgggcttagcaagtgttgacaagagattttgcggaacttgtttttaatgagtagtaaggacaatttgaagttattagagcaggtgttttatatcattgtattttatataacttaattgtcatgaataggtatacactccctttatcttttatttgtaccaaattgtttagtaagccttgttaaaggtaaatcaagtccagattccagattagtgaagccagaattttattttgattctttttctttatagtccaaaaatgagcacatctcaaataaatataagtgattagggtgaggggtggaatttatacgattattgtcatgtgtaagcctgaccagactgtctatatcttcaaagttacattgtggataacttagagcttaaaaaatttgtgaatttgtgaaataggaagttgattatacattcagtattcagataatttatattggaggttggcatactttctccataaaggggcagctagtaaatacttttggtttttcaggccatatgttctctgtcataactatgcagttctgcaattgtaatgtgaaagcagatacagacaatatgtaaaagaatgtgtggttgtgttgcaaaaaaacttcatttacagacaggcagcatgctgaatttggcatatggaccataagtttacctggatttatattacaagattttatataacatgctctgtgtttcagtaaatatattactgaatgttattctcatggaccatttaagttgaatggacccatatcatttgttcatgtagtgaatgtgctttgttgtttatttgcgactggacattgagtccttatttgtggatcatcatcttattcctgaaaccaagaccttgattatagttttcaaaaactataagcagtta

SEQ ID NO: 39040 - DNA, 1771 bp, Homo sapiens
aggtttgctattttccttatcagaaattcacagcacacattacttttttaagactttgacaaatactgccataaataaaattatttaatattgtttaatccaatgtttcttaaatgtgtatgatctcaaaccctgaaacaaaacaacatatcacatcccgtggatcatcatttaggaaaacactattaaaatgttaaagcaaactaaatatggtctgagaaggactccgtacttctatatttgagtccttgtggatgagctgcagcctgacttgataggtagacaagattgaaaacctaacttaggagtatgcgccagaaacaatagatgagttttggccaatcctagcagcagaagttcaaccactcttacactgcctcgtgttcaaactgtgttcaaataaggcaaatgctgagctgtaatcaatctagttgtttctgtacctcacttccaatttctgtacttcacttccctttttttggcctataaatctgccaccatgtggctgctctagagtctctgaatatgctgtgattctgggggctgcctgatttgtgaatcgtgccttgctcaattaaactcctttaaatttaattcagctgaagtttttctttcaacaaaaatattctttttttttttttcctggaatgtggtagctaggtggtctgtatttttactgagaataaaatgagacaaaatggaaaaactgaattaatctattacatgagatataaataagaggcctaagtatttatacattgaaattatttcccaaaggagaattagaatctcactgaaaatagaagagctagtcatctataaagtattaattttgaaggtttaggttaaaatattagaacaaactaatgtatcaaagtggcatcattctttaggtaaaagatatgtcagtggtaaaaacaacattaaattttctggaataattaggcttcaggatagcatcagtcgtgtgttactggaatacagaaatcaggatctaagggaagcacacgtggtaaacaaaaatcacgtttaataacaaaggagagtggttaacacatttccaattcaaaactagaagagtagaatctagtaaggatggctagtttaatagcagagccatcaaaggcagtgttaaagcggaaggatggtggcagaaatcattagcagtcgagtgcctgagtattgaatgttgcatctgttgaagtctttatcatgaattagcagtgactgtgctttggtagcatggttggattcactgtaacttttggattattgctgtatgtcttgccttttgtctttttgcatggaagtaattgtcaccaaaaattgtctctcttctatttttttgtcccaaatttacaacatatgtcttttcttaggagaaatttctggtgccagttgattgtttctttctagaaataacatattcatagacacatacacaaatgtggctaattcatcacaaaatatacccatgtaacctccacattacccccctgactctaaaataaaaataaaaacaaatgtagctgataaattgaatagccaaacttaaaaataaactttttttcttttaaatccatcactgtccctattaaacttgtgagccagcttctttctgcagaaattgaaaaagtcttgagtccagtttcatcatttctggttgtttcagatgataaaaagtcctccagtcattttattccccctaaaccagtcgcaattcaattattgttatctttctttcagaataataagtatggcatttaaaaat

SEQ ID NO: 39041 - DNA, 1008 bp, Homo sapiens
tctgtcggtctagattcttctgggcttctctaagcatggattctttccttctggatttgggggaggaccctctctgaaatggaggggttcttcagacctatggttgaatgagttagataatttctttatggccagtttttagacagaaagggagagggaagattagagtcatatttttaggtttcatggtgggctttgggaaaagagggattctgatttctgcgacctgccttggggaagagggattctagtttttatgacaagcctcaggggagaatgggactgccagacaggaaggcaggccaagatcaaagaaaaacttttgcttctgaggctgcttctgaagttttcactttgaggtattgcttactgagctccaacatgtctgagttaccaccatccctcagttgaaatactgcaattgcctcctaactcatctcttgaaccaacttttcctcttttccaatctattccgtttgctgtagccaaaacgaactttttaaaattcagttttgattgtcatactattacttaaaatccttcaatgacctcctgttactattaggatagaataaattcttaatatgtctaaatgttgtggcccctactaactgaccgacttcatcttgtgtctatctttcccttcttccctttgctgtggccacactgaccttccttcagttcctaaaatgtgctcgtctctcctgcatgaaatactcttttcctacctcaataccagttaactacatttcttcctttatatctcagttcatactatcaatgagccaggtcctgacacattcacataaaaccttgtaattttttttttatctaagacttaccacattttggaattatatatggatttgtgttaatagtttttataatgttttttctcatccattggagttctttaaaacaattataaaactgtttgggcaggcatataattggcactcaacagatatttttcaaatgaattaatacattcataagtgaataaaaatg

SEQ ID NO: 39042 - DNA, 1045 bp, Homo sapiens
tatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaatta

SEQ ID NO: 39043 - DNA, 1024 bp, Homo sapiens
ttcttgatatagaggaagggaattcacattcctgggagaagtaatgacaaaaagaggagagaatgtcatctgcacaattacctggtaataactcactgacgttggctttatcctttccagatctcaatcagtagtggatcctacagtactaaaacgcatggataaaaatgaggaagaaaacatgcaaccattgctttctctggactaataacttctctacatccccttcatggattagaaatggaaagtattggttttcagcaacagggacaacactgtagaggaattaccagctggaaaccgacttattcatgttaatgtagcataatatataacaaggcatcaggctttccttggcctgaaccatgggggccctgggctggatttttaaaatgtcaataatttattctgtaagtgccaagttgtttgtaaatataatgtaatcttcatgtcaagtttgtaaatttcagtagtaactcagtttggaaaaaggttggctcaaaagtccatgccagtgttatgaactataacaaaaagcagaaaagacacagtcaaagctaattaaatgtagccctctttcctatgaagccatatttcagctctcatagtgattgtttcattgtttttctctgaaactctgtcagtattcaaacatactcttaacgggcacacacaactaagtgattccaggaaattttatgattaatgtatttcctgtctagtgattttcatttcagagaaatgtgtcttagtaactatcattggccttgcattttggaggcaaggaatggcagatgagctggtaaactgaacacttgaactcttctatgttgtttaattcttggaatcttgtgaaaagatgtgtttcctcaattaagacgtagaaatgtaaaaaagagtggattctttttaaattgctgtcttcacaatgtgccctttattcaagaccctattatatttcttcctaatgtactctaagtacatttcccctccaaaactctttgactaagagaatgagaactca

SEQ ID NO: 39044 - DNA, 1029 bp, Homo sapiens
cacacacacacacacacacacacacacacagaggaatcataaccaggaacttctgtttgaaataatattaagctattaacattttttaggtgatcccaaacccaagaaggttctgcaagaattttaatatttgatatcctaattcaccagaaggcccagttattgccaaagaagcataataaaacagcagagatttatctttttaaattatcctgctgtataattttgcttgatccaatttgatttccttcggtaacactttttggtggactctaatttgcatgcctggagaaaggggagtaaattacaagacttcttgaaggtccttttaacttgatggttttatgattaaatcttgcatcttaaattgcctttctctggaagaaccaggcatttccggcttcatttttgtgtagaggaaattcatatatcacctcatgtgtttttctgtaagaaagaaccagacaaaatagcagtaatagaggcaaaacaaacaaacaaaacgttataaacttagaactagatgtagatgaggcttatcttatttgcaattctgcaaggatgtacttgggtccactgaaagtgcaggtgagtggaaaggtgtgtgtttgtctgtgtgtgtgttaagtgggtgtaggatgtgtaggatgtgagcaaagggggaatgaaaatgataccgttcataggtgttaacttcgtcaggtgttctggctatatgtgagaagaggaaagtgggttaactcagaatacattctttatttcttagtatattgttcttctggatgtggtaggttttcaacaggtctcgttaatagataatctgcagtgctcagggtgaaaagcaggagtcttccatctgtatgcctcgggaatagtatcaatgcagaatgaaatacagacagagattggagaaagactactgtattcacttgaagccaatggaagtttaggtgggcccgattgcaattatcccccattggaaattagccaggacacacattagtgcatgctactttctgtctagcctaa

SEQ ID NO: 39045 - DNA, 1118 bp, Homo sapiens
ttttttttttttgagacggagttttgctctgtcgcccaggctggagtgcagtggcatgatcttggctcactgcaagctccgcctcccgggttcatgccattctcctgcctcagcctcccaagtagctgggactacaggtgcctgctaccacgtcctgctaatttttgtatttttagtagagacggggtttcaccgtgttagccaggatggtcttgatctcctgacctcgtgatccgcccgcctcggccttgcaaagtgctgggattacaggcgtgagccaccatgcctggcctatagttgttgagcctgtattgacacattgtaatccctgaatccgttttcattagggttccctattgatgttatatattctgtggatttggacaaatgcatagtggccagtatccatcattatagtatcatgcagagtactttcactgccatgacaaacctctgtgctccatccattcatctctgcgccccagccaacccttgcaaccactgatctttttactgtctctgtaggttttccttttccagatatcatatagttggaatcatacaatatgtagccattttggattggcttctttcacttaataatacgcatttaaagttccttcatgtcttttcatggcctgatagctcatttctttttagctgaataatatttcattgtctgattatcacagtttatttatccattcacccaatgaaggacatctcagttgctctcatggtttggtaattatgaataagacagctatgaacatccatgagcaggtttttatgtgggtataagtttttgacacctttgagtaaatgccaagaagcgcaatttttgtattctatggtaagaatacatttaattttgtaagaaaccgctaaactgtcttccaaagtggctgtaccgtttcgcatttctacaaacaatgaatgagagttcttactgcttcacatcctcaccagcatttggtattgttagtgttgcagattttggacattctgacaggcatgtagaagtatctcattcttgttttaatatgcatttccaggtgatatatgatgtggagcattttcttgtatgcttatttgacatctgtatattttctttgttg

SEQ ID NO: 39046 - DNA, 1050 bp, Homo sapiens
tgtatttttagtagagacggggtttcaccatgttggccaggctggtcttgaactcctgacctcaggtgagccacctgcctcagcctcccaacgtgctgggattacaggtatgagccaccacacctggctgttccaggagtttttttgtcaattcttctatattttctacatagacaatcatgtcaccagtgaaaaagactattttattcttccttcccaatctgtgtattttaattcattttctttatcttattgaattagctagtacttctagtatgatgttgaaaagtggtatcaaagagggagcatcataaccttgtttttatcttaatagaaaagctttgactttctcgccattaagtatactagctgtaggattttttgtagatatgatttagtaagttgaggttccccactatacctagtttactgagagattttatgatgaatgggcattggattttgtcagatgctttttttttgcgtgtactgatatgatcatttgatttttatttattagcttgttgatgtaatggactacatgagttggtatttgcatgttgaaccagccttacatacatgtgataaatcccacttggttgtggtgtataattctttttatacgttgttggatttgatttgctactgctctgttgaggatttctatatctatgttcatgagagatcttagtcttttgttttcttgtattgtctgtatctggtttgggtattagcacagttctagccttttagaaggaatgagaagtattctctgcttctatcctcattttagctggataaatgaaaaaataatgtgtttacttaaatttagtaaccatttcaccgacatctccttgtatccagtttcattcaatcagttgccattactattgaattatatcacaaaaatagaggagcatttgaaattccacccacccatgtttgttaatcagactgatcagtttattcatgtttaggttctcagcctaagtttttctgtgtgcgttcttgtttttggtacgtggctatcaaagtattctgtacatagtt

SEQ ID NO: 39047 - DNA, 1023 bp, Homo sapiens
agtaaactggcctaacatctataatcagtgttacaatcgtgagatgtcagagtatagtatatgtgttttcaaggcatagtaattaaatatggagacataaggctgaaaggagtgacttgctttataacactatatattacagtccctttgaaaagtaagcagaccactgcccttatcactgcagggacaaattcagttgtgatggtaatttacacctcataactttcttttatgacatccatccatcatcaacaggaagtctgtacacagtctaaggaagtttcccagatatgacattctgggtagggctcccagtctcctgaagagagtaatgcaaccaatggtcacgggaaccacttcaccttaacagctgctgagtcggccctacataaccctcaacgtccaggatgctatggatttttaaaacatttcaatcattttcatcagcaaaaggaaaaccaacaaagctaacagtagcaatagtcaagggatcctccatcatcattaagactgtggcttaagttttcttggatcagttattgtataaccttgtcagtcaagcaactataggatgacttacaggatgacaggtgtaggatggttttcaaaagtcgcattgagagctccattttatgcactactaaactgttggatactgttagtagataatgggaagattccatagtagatgaagtggaaaggttaattagcccattgtgattttaggagtatctgtctaccaacatcagtagacatctgatttttctttgttgtttccctagctccaaggtggtaaaataatgctaacaagacaatttattcaaattacttggagacattatacacaaaaataaatttgtggcacgtattagtctgcttgggctgccaaaacaaaataccacacactgggtggcttaaacagcagatatgtatttctcacaactgtggcagctgagaaatccaagatcaaagtgccagataattcagttcctggtgagggctctcttcctggcttgtagatgg

SEQ ID NO: 39048 - DNA, 1049 bp, Homo sapiens
ggtcttttatacataatttagaatgttctgtatatacttcatccgctctataaaaccttcacagaggtttcatctagctttaaatcctattctctgaatgccagtaacaatgttatttttcatgcagtgggttgcatcatattcacatttaacttaagttgctaattttagaatctaactctgaatgaggagtgaaatgcaacttgatccattgtgttcaatgttcaagaacagaagcatgatggctattaagtagggccacttgaggtggggggaggggggagggatagcattaggagatatacctaatgctaaatgacgagttaatgggtgcagcacaccagcatggcacatgtatgcatatgtaacaaacctgcccatgtaccctaaaacttaaagtataataataataaaataaattttaaaaaaaaggaaatggactatgggatcacaaatctcttagtggcaatataacgaaatgtaatattttagcaaaataaatacacattgtttggtctttggacttgcatcattcttttaggtcattctaaaagtttgtttatatacatgtatacacgtgtatatatacgtgtatatacgtgtatacacgtatatatgtgtatatatacaagtatataagtgtatatacatatatacgcatatacgtgtatatacgtatatatacgtatatgtgtatatatatacatatatatgtatatatgtgtgtgtctatatatacacatatatgtatatatatgtgtatatatatatatatacacatatatgtatatatatgtgtatatatatatatatagttttcaagatgatgctcttcagacttgttcaaagcaaccagaaataagcaatttattcctgtttctctgagattgcttttagaaatgatatataagtactagaattttttttatagtttgatactgataattgtgggctgttcttttttagataatttgaacgtaagtgctaaaattgtgtttggttttggttactttatatgttttaacttttattaattgcttattatttct

SEQ ID NO: 39049 - DNA, 1023 bp, Homo sapiens
gtttgttacccttttttctaaccacttgtttagaaggaggcttgggagagtccatttccaacttactttctctgagacaaactgactttcggatagcatgactggacctcatatagtaactacaagtacaagaaaaaatgtctaatatgcttcgattgcaaatatgtataattattttagtatacagaaatgcaagaaaatacagaaattgagcatccccttcaagagatgctaaggaatcctaaaatgggagaaggctataaaatgcttgttcataaattagtatttgagttttccaacataaaaccaataatctggccataaatagttgaatgcttaaattgtgctctaacatcattgcccataagctaataaaccttaactgtaaattagagcacattttatggatatgacaaatttatccagaagaatacctttttcctcagcctgcttaagcaagccttcaatgtctctttaattaaacttctaaaataaaagtattatcctcatctgatcctggaattcaggaccctgcattagtttcccccgaaatcattcccagctaatctcctgtagtttccaactgcttgctttcttcagataaacttatttcccagccactccacttgcttgctatgagtttctgtgcaagttctattatgtccctttattttatctatgacttggtctaaataaaagtgatgggcacacaaaagtgcttagtaacttctagccattgtttttatcatcattcccaactatgtgattaattcactctacttctgctcaaaatgtctcacatccctcttgccaccgttcaaaccctgccgtgtttcaaagtaatattaaaacatttttcttttacattgtttgtgtgcaagaaattaaagacactgtcactgtaccttagtactgcttatgagttgggaataaatgtgtggagttccccggtgatggcagaaagggcaggtcaagtgtcccaagaacctcaccaggcaggagtatttgataataatattcaag

SEQ ID NO: 39050 - DNA, 1026 bp, Homo sapiens
gcacactgcaacctctgcctcccgggttcaagctcttctcctgcctcagcctcccaagtagctgggattacaggcacccaccaccatgtccggctaatttttgtatttttagtacagaccaagtttccccatgttggccaggctggtctggaactcctgacctcaagtgatctgcctgtctcagcctctcaaactgctgtgattacaggcatgagccactgcgcccagcatgtatggcactttaaaactgccactcttggcatatggaatacatgcacacacttttgtattctatattcattcatatatgcaaaagataaaagtggaaagaggaacaatctgtttattgtatatcacacaggcaggctctctgtgagattaacattttagctgcctaatgaagttgcaggtgactggtctctctgtaagtcccagcattggctatcagcaaaaattagaaaggaaaacatatttcttgaatctagtgctcatagttttggttagaaatagtctactctgaaagaatttacaactgaggagatgagaagagaatgaggattcagcagcaacagcaataaagtttcccaggagaatgagtattaaaaaagttgaggcaggatgtccactgtctgagctggaaatagtcttgcaattaaggagggtgaaaagaagcttggcttgagagaaacggaagagggagttgaggtgattgacgttccccaaggaccctcttcatttgtgtttgtttcaaggctttttctggtgacatagataattactggattgaaggtctctattttgctaggctgtttatgaggagattactaaacaaaagataagagaaagtcaagagctgatgaaggaaagtaatctagcctgtcttgctctctgctttagatggaacacgtgagggtgaaaaacagatcattgattccagttgatgtttataatatagaaatagcagagttatcctcctttacagaaatttcttaaatccattagtaccttacttaggtggacttgttc

SEQ ID NO: 39051 - DNA, 1049 bp, Homo sapiens
cctggccaaagcatggggccacagggtgactggagcaccagagacaaagacaggattcattttgtaaaaagattacgacacagcaacttgagaaatctatagacaccttagtggttctgtataagtaaagaatcgcatactcaatttgcatgggggaaaaatcctctaaatttctagaatttactatttgctgataattgccgtgatttgatttttaattgtccatggagctcaggtctccatagagactatcaccaacaacaataaatcaggagcactgtctccattttccaggtcatatgtttttctaaaactaataaatgttacctccctaaaaatttttgcactcctacaagtcatttctaagaagtcattaatctatgttcaagtagttgttttgccacctttattcaatttttctaggagaaaaaaatatctgaaaggaaacttattgcagctaaagcattaacaaatgcatgctttctgtgttgaggacagaaaatcaatgtagattagagatgaagagacttgagatactagtaaattaacaatacttctaatgactttagagtagttgtgaaaataagtcttttcccataagcctggaagggagggagaaaacaaaaaaaaacatcattacaagtttaatggatttagcctgtagtcctaaaataaatgtaataatgcaacattgcaaatgcaatttattctcaaaagaatgtgttcccttggggaaatgtggaccatttattctacaagaagatactttgtgccctcattttggtgttagactatgactaaagatttataggatgtggtacatataaataattacatttgacagtctagattcacttttttaaatcatctaataatttttgaaaatgaattttgaagaaaagatatattgtgatatgtttaagtattagtttctttttctaaaataaaaaaatcagattatgtagtttttttaatcaaaaagtaaaattgggcttataataaaataaaacttcctttccatactcttctccagctgttcctcatctctt

SEQ ID NO: 39052 - DNA, 1040 bp, Homo sapiens
atctcatagcccaggtccgttaaaatgtcaatgtcaaccaaagaaaatgtaagaatagcaaaatcctgaaatcttgattatataccccatcctttctccttttcctttcaccatcatagcaatctctgctagttggcgaatcttctaaatcaagatttcaaggcagagtttatagggttttgttccacaggtacagttctctaaatttatgatgaaatataatgggaaaaagtggctttacctaaattgttttagttcagattgcataaaatttcgattacacatggttattactcagccctctttatgtgtatatgctcataggatgcacatatatttagacttttgctctattgacttcataattgaaagaaaagaaaaaatataatggctctattaattatttacatattacatttaattctaccagatgctgaaaagagcaaaagaaacactgatcgatgaaacttatatatgggccaagttgctgttgcagagtggagcttgcaacttgaggcagagtacagttgtgttgtagaaaacaaatacactaacattttgaaccaaactcaaaatgtgcctagaaaattctataacataggatcaggtagtttaagtaaagttcctgtgaaaggtggcatatgttttcttggatagtttagtttttatcttttaagtatattaaagctcaagataaagctttgtctaccttacaacattgctctaatctacttatatcaattctgccctttggggacacccacacactgtgtaactccagagacccatattcccagagaacaccatgtgaatggtgcccctggaattgctcgttgcagtagccctgctgctgatctgggtgctctgaataacttgattgaatcttttccatgattttagtaatttatcagagtgactgttgcttacaaagtattcccttaggtgatttctttctttcctttttctttttgatggagcagtgtgcagttatggtgttacaaagttataacattgtggcaataaattttagagcaaacgat

SEQ ID NO: 39053 - DNA, 1028 bp, Homo sapiens
ccccgctgcccgcgggcgccgggtgggggtcccggcggctggatgggcagcggcggcgcgggccgcgggcggcgatgggcgaggagcagagcacggtgagcggcggcggcgggccccaggagtcgcagaccctggccagtggcactgcgggccaccctgagcccccgaggcctcagggggacagcgcccgggcgcccccgctgcgcgccgcctccgcggagccgagcggcggtggctgcggaagcgactggggctgcgcggacaccagcgccccagagcccgcgaggagcctggggcccccgggctggagtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagtcttctgctccgtgtactgcgtggagagcgacctgcccgaggcccccgcctcggagcagctctcgccgcccgcgtcgccacctggggctccgccagtgttgaaccctcccagcacccgctcttccttccccagcccccgactgtccctcccaacggattccctctcccccgacggcggcagcatcgagctggagttctacctggcgcccgagccgttctccatgcccagcctgttgggagctccaccctactctggcctgggcggtgtaggggatccctatgtgcccctcatggtgctgatgtgccgggtgtgcctggaagacaagcccatcaagcccctgccttgctgcaagaaggccgtgtgcgaggagtgcctcaaagtctacctgagcgcccaggtaacttcacccccttctcttccccatttatcattccaaatcactggcgaggaggtcctgctctcgatctga

SEQ ID NO: 39054 - DNA, 1034 bp, Homo sapiens
tacataaatctggaacattcatttcagaagtacatttcccagtgacctgtgtatgcgtgtgtgaatatggctaaagtacgtagtcccagggatgtctgcaatatcctgcacatcccttaaccctcctaagtattggccttctcagctgacttggcctttaccacattttcctaggaggaaatattatctgttgccttctttgtttcacagaatggtactatgttcatttcagaaatcttccaccaatatttttcttttatgatttggtttagacagaaaaatctgtcataaatatgaaatattaatatttagtactttagatgaagaaaggaagagacatgaggatgccaaaggggcttgctgaaggtgacagctgttgtggattccaccactctgcctaaaagtgctagagattggcagatgcatataacttggaatgtatacacctgtccaatgagtattaatagatacaagcaacacatttcttctacagattgtgaacaaaacagctgctagatgataaagtcctaaaatgactgtctactgtagtcaccctagagtcagtgacccagaggtgaaagcttatatatcctattattaaattatgagtcatccaaatcttcatgggtaaaagtgtaacataacataaatttttttttttctttgagagaatctccctcttgtcgcccaggctggagtgcaatggcttcatcttggctcactgcaacctttgcctcccgggttcaagcgattctcctgcttcagcctcctgagtagctgggattacaggtgcatgccatcaagccaagctaattttttgtatttttagtagagacggggtttcaccatgttggccaggctggtctcgaactcctgacctcagatggtccacccgcctcgcactcccaaagtgctgggggattacaggcatgagccaccgtgcctggccccataaattcatttcttttaaaccttaaagcaccctgcatatttttggaaaccattgtgttcagtgttgagtttgaatgcagttg

SEQ ID NO: 39055 - DNA, 1092 bp, Homo sapiens
gaggactaggtttagggagaatgagaaatttgatgtgccttttagacattcatgaagggatgttgagtaggcagttggcgtctggcattcagaagagagatctgagcagaagatataaatttgaacgtggatggcatatagatggtatttaaagctattagactggatgaagtcacctgtggagggagtgtcagtagctagagaagaaggattggagactgagtccgagcataccaatgttcacaaatatggagtctgggacatcagaaagaagaagcaaagagtctaaaagggagtgggctaattcggcaagaagagtactgagagtacttacccagaagccaaagacagtgttttaaaagggataatcacatgtgtctaatgcttctgatagttccagcaggatgaggtttgaaattgaccatcagatttcccaacaaggagtttattggtaactgtgagcagtgctgttttcattggcagccatgggatggttttcaggttagagtgggttcaaaagaacaggaacaattctgtttttgtactgcaggtagtagaatgttatatgagggaactcgaggttagagagattaaataacttgcccaaaatctcaaagcaagggaatggcaaaggtggaagtgaaattcagatgtttggctctaaaacctatggcttttgtacattctttaaattgattatttcatttataaggtaaacttatatttttctttttcttttaagttgatacatatattgtacaaaaagcacaagtcttccaatccaagaaggagaagacacttaattacatgttttgaggaagcgaaaggctgccactcaaacttaggtctagagattacagccaaactcagcctcatctacttgtaaggaaatcaagaggaatttggcttaggaaagctatgatttgatttgatttactgttaagtttttttttgtttgtttgtttgttttgagacggagtctcactctgtcaccaggctggagtgcagtggcatgatctcggctcacggaaacctccacatcccaggttcaagcgattctcctgcctcagccttccgagtagttgggactac

SEQ ID NO: 39056 - DNA, 1107 bp, Homo sapiens
taagcatccttcctatattctttgataaccctctttacttaaggttatcaaactatataggaatcttctatacaattattcttgtttcactgtatttaaattgtctgtttcctgctctgtgcttccattagactacaaagcttgatgcatgtaaagacattattaatctgttttttactaatttcctaacactttgtgtgttatatatactctataagtagagtggatgtttaagtttattccacaaataattaatacagtaggagctaatatcgtcaatatgtaaactatttgaatagataggcaaagtgatatttttaaatgaaaatttcagtatttcattttcttgtttaaaaacctgtaagacctcctcattgcttcacatagagatcccagctcataacactgtggataagatttggcctctgcatcctcttcagtcccttcttctatcactccagctctcctccttcaagccatagagtgttcttctcatggttaatttcgcttcactgactcagtcttccttatatcaccacctgagttagtcctgctgttaaggttcttagagtccttttcactctgccaccactgtatttacctctttttattaattatatggtatgtgataatttgatgtttattaccttggttctcccccattattctttgagctactttcataactagcacctggcacaaagcccagaagagaataggtgctcaataaatatttgttaaagcctgaatgaatgattgaaaataaattataatatgtttgctataaaaagtaaggtaactatttgaatcggaacttttgacatcttattccacaattcatttatttagattggtgcaaaagtaatggcagaaaccccaatgacttgcatcaatccagtgaactactgtggcctgagtctttatgctagcatcccatctatcactgaggtgtgtcttctttaattacaatacctgttctggttactgtctcctgtttaacagattcttccagaacctaggaacataaaaaaaaagaacgattttattttgatgatgacattgtgggtcaggaatttgggaaggcctcagccagtcagttcactttcg

SEQ ID NO: 39057 - DNA, 1078 bp, Homo sapiens
actccatcctggcaacagagcgagactctgtctcaaaaaaaaaaaaaaaaaaaaagatcttgaggcccacaaggaatttccttgtgggcaaattgtgagggaggtatgtagctatgtagcttttttatttttgtagctatcttatttaggaataaaagggaaagaaggtttgcctgatgtactttccaacttgacttttcccttggcttagtgatttttggggtcctgagatttattttcctttcacactcatattcatctttctgtcaagaatcaactcacttcaaagtaaattcaatgtttgcaagaagtttctctgtaaatgtgatgggatttaatttttgaatcatgacagtttagcatttttcctcaaaagtaccaactttactgaaaaatagaagatatttcatagggtaatacaagatactttttcaatatttatctcactttccagatacttggatattttctatagcaaaaatgtggtcattggtacctcacgtatgggaaaattctgtagtctaatccccacccccagcctccaaaaaaaaaaggattcctgcattgaattttgtttcagtaacacattttacataataacttataatcattgccgttttatagatcatttattaataatatatttacatatgagtctatgctagatcttgcctgaaaacaaagtattaataaacaattgctttatgtgcctaccctctaaaggcatttggtttctagatgatatgcaaacactggtttctcaagtcatctttggtatataattgatacatttataaagtaaaatatgtcaaaagttgatgactttatggtatgtgaaagtaatttactcacttcctggtgagaagaataggaatggggttgcattattcacctgtgttacctttgatgagtacattgaagagctgtgaagggaattcattcatctttccttggctagcaggtttgctgctggttcatgaaagggaaagaaaagggaagaagcacatataggtgtcacagtaaaaggatcacttcatagagtaatttgttttaaggaaaagctttctatatatttctt

SEQ ID NO: 39058 - DNA, 1032 bp, Homo sapiens
gaaaattgaaaatataatagtattagtaataataaagtatcttgaaatttgtaatatagatttactaatgtaaataatagaattatttcttttgagataatgttttgcttgcctggggttgaacattaatgtttcctgtcatcagtgttaattgtaaatattcatctgtcgtactgatctgtgttgaaatgttacatatttcatatttaaaacatcttttcacacatacaggttttgccgaatatagatattagtctactagcatgtatgcacattcataatttggacgttttttatacgattctttagattcatctcttgatatttgccttttagaatttcattacagtgcagaatacttccaattgaaaattaggtggaagctcctcagttgcacagtcaaatggattttttaaaaattccttattgaaatatgtttcacatatcgtatagttcacatatttaaagtgtataattattattttgtatattcacaggatatgagaccagtatcactacctaattttgaaactttttttattccccctaagagaaatcccatacccattattcatcattccctgccctcaccccaggcctcctatccccatcctaagaaaccatgaatctagtttctgtttctatagaattgcttttcctggacattttatataaacagaatcatgcaatatgtggtcttttgtaactgacaaatggattttgaaataaggaaatttcaaggtccaaaaaatgctgttggaatgttgaaatcataaattgagctcagaaaatgtgtctactgcaaattagtgtgaaaacggagatcttgcttcttgtttttttaaatgattatttgcttatttttagagacagagtctggctatgttgtccaggctggctttgaactgctaggctcaagtgatcctcctgcctcaacccgtggaatagctgggactataccttgcctggctcttattttaatttttgacaggatgagaaggtgatatagaagctcaacacttgaatcttgtg

SEQ ID NO: 39059 - DNA, 1046 bp, Homo sapiens
tgctgacctgcagcatcacactttgagtagcaaggctgtagaatgctctaaaatattaaggaataactccttttaacattttaagtaggacatgtattcatttttaccgcaaaggtatgttttgtaattagaataatgtttcctaataaaactaggtgaaaccttaaatactggttttgtacaaagctacatatattaaaacatgttttctattcccaaatgaaaacttgataaataatagtcaagcaggagaaaataagaaactaagaggctatagaacattgattttaagaatgtacttgacataggctggtttgtggtttatatttctaatgctgtgtagatgtaatggctgttctgctaacatctatagcaagatactggattcggttagcttgttctagtgtattatataataaaagtttagaatagtgagaagaggggaggtttttcttgttgaaattgacttgttccattttgtttcagaatgtggatttgatcttggaaagtatggtactatcttttgaatgataaaagtacattgaatttttctgttccaaattttgtaaagaataattctttagcagaacattctttgttgtaatgattttttttgtcaaattctaattgtaaagtaattggattactttaataaattactagttagtaaatgtaataaatttactttaaataaatttaataaatttatccttagttgcttatgcagatgaccactcatcttttacctaaaacgatttatgtctttgatgatgttacatttagatatcagaaaaagacattgccatgaagctgtctaaattttccaatgtaatagaatatttgttcattttatagactgagaaacaactgtcagtgctcttgcctatagtagtattattggcaaatttatagagcataatcaaataaaacattttgtaataattgagttcaaatagtaaaatatacttgatatatgaactttcttttggtctctactgctggccagttatgcctaaagttgacttactatcagaaacgcatgaggc

SEQ ID NO: 39060 - DNA, 1064 bp, Homo sapiens
gcctgggtgacagggtaagactctgtctcaaaaaaaaaaaaaaaaaaaaatgaaagtgggcagtcagggggacatgggaagtgatgagtttgtttttagactgttgagtttgaggtatttgactgaagacatcaagtagggaattaaacgtagatatcagaagcttagtatagagatctggactggtgttttaacatgtgggagcttgcactgtatatatatgtggagttgaaaccatgggagtggaagagtaactaaccctcagaaagattaaccaatgagaacaatccattataaatgcaacctcagagactcaggaagccttaaaggatagatgcagggaaaatccacaaaggaggatacaggggacagaaagaagtcaggaaaatcaggaatgtgatgtgctagaggtcaagaaagaaacagaactcaacagtgtcagatgttgcaaaggaggcagtaaagtaaggattcaaatggacatttagtaaccagaaggtgattgataattttgtagagaatgactgaaagtcatttcaaggaggaggtgagacagatagcagtgggttttttaatgtggacgtgaacacaagaacattaaataatctttcatttggcttggctgcaaatggacagatgataaggactggagaccaaggcacacaatcctaacgagttttttgttttcttttgcttttatagtgggagaaacttgagcatgcttatcagtttgagtgtctgaagttagcagagggaggtgagattcctgacaaggcaggtggaaataatcatcctagaaattttgcaaagtcctgctttctaccgaggagggagggaggaagggatatttccaaaggaaggaaggaaggaaggaagaaaagaaggaagggagggagggagggagggatatttccaaatgtactcccttatgagtggggaacagaaagttgaaggtgttctaaggaagggagggagtgaggaaagaagggagggatatttccaaatgtactcccttatgagtggggaacagaaagttgaaggtgttctagggagggaggaaggga

SEQ ID NO: 39061 - DNA, 1033 bp, Homo sapiens
aaaagtattgtatgaaataacgtgttgcatttttagcaattggaagaaatttttgaaatagtttagatgacctggctttctaatagaagtgatgtctaaagatatttggcctaaagttttctttgttttccttgtagaaggcaaattcatccacagtcacccattttgttttagagctatttcagatcactgcatcggttgctcagtatacttatttttcattccattaaagaacaactagaaaatgaggccttcccccctttctcttgcctttttagtttattcaaagctactgctcagtttcaaacaaaacaaagaccagtaggaacttagagtgctgttaagttattctacttaacagttattcataagtgcattttatatcctttggaaagctgtaaaaacaattccaagttagcctggttctacaactggatttggaatgagcaccactgcagcattatacgttggggaaattctgaataaactgatgtaacacaaaatacatacatttgttactgtaatctcttaacccaaccttaaatggactataatgtaaaggaagaaaaagaagccgaccatggggaatttactgaatgttctaacaactttccacagttgtaacaaatgtagataaactgttaagagaaagcataaatgctggttcccctttgaagtaatagctaaaaggtcagggctttaaaagggattaccttttaaatagctgaaaggaaaagaaccatggaatcagtggacattattacattgtagcagagagcctactttctggtgggatttgggttctgtgaagtttctgtctgtttaagtcatattttatgatgtgtttggagtataaatggtttcatttttctttctcttttaagcatgactttaaaactttaccttttttcttggaccctaaaattatgttttgccccatggaacatttctattattacaacagaaacctatgaggagatattactgagtgaattaatatttgttttatactgtaaggctttcttttcataaa

SEQ ID NO: 39062 - DNA, 1114 bp, Homo sapiens
ttttatcttaacaatgagttttctatttaatgtaaattcttaacctatggaaaatatgtgctaattttgaaatgtcttctttagttatcttagttatcacaaaaataaatctagtttgtagacttagtcattacaaaaccaagtctagttcgtaatagttttaatattaaatttaaagcaagtaggcaatctaaattttgttggaggtatcagaatatttgttcaatgtcatgcaaaaattcattttagactgttttataccacagattagatactaaagtctgagttaagaagaaaagtttctaagtcaaaaattaaaagtgagatgcatgctaaaaataacaaacacaggattatacgttataaaagcaaataaacagttaatgagcactgtcacacatacactaaattgtaatttattttattctaaggtcaacatattcattatttctagatgacaggaagttacttttatgtttttaaaagaaagatcaaatgtgcatagtcatttctggattctgatacgccatctctatacaaagtacctttgtccggtgctctttgtttgtggtgttatcacagtaataataacactaacatgtactgacatttattgcatgtcagtctcctctgtagttactataaatatattgtctcatccaaacttcagatgtgatactaagattctgattttcagtgtaccactcagatcatcactattaagtgatttgataaaactttaaggttttgcacaataattataacataacaggattggtagtatgtaagtttcatttgttgtctcaattctcaaaagaaagttgtaaacaagaggtaattaccaccatttcaagatgcagaaccagtttcagagagtttaagtaatgaccaaaaaagcaagcagaaaaaaagtgaattgtatttattcataatttattataaatttggaattagagggatttacttgtcatgatatttccctttagatattttattctcttcaatcctataatagaatgctttgggcaagaatgtattgattcaaagaaaatgaataatcttcccctgttcacataaggtcaacacaaaagctatttttttggtcttttatatc

SEQ ID NO: 39063 - DNA, 1036 bp, Homo sapiens
gcagtccaggaacttgcagttaaattacccgggtatttgatttctggcatttttaggtgggtaaaggggaataagtagatgggaaacaactttatattgacctgactccatatgtgccaaaacgagtttggcactgtgcataggttatcacattttacactggttggtagggaatattatctaacttgacacttgggagaggtaaagtaacttctttttaaacagctagtggagctagaattcaaacacagggctttgtgaagtcaaagctcatgttctttccaacctctctgtaaggcagaagcttacctgccaagtgtcagtcacccactggaaaggaatggacatttcacctcccagttcacctaacgattttgaatacataaagtcctgccagccaattgacaaacttttctttcttggtcccttcatttccccatgtatgaagtgcccgcctgtaatatgctgtgttccacttaattattacttcttcaaaatgatcacagtcaccaagaaactctccagttaggtaggtcggtagacagaagataggtagatagatagatagatagatagatagatagatagatagatagatagatagatagggatgggaggaagggggagagagaggtgttatcttttaagtgacatttttgtgattactatgattaatggccgttattagttcacaagcagcctcatgagttcttttgaaattcatattgttccattaaattgcagttttatattttagttatttaatccctaaaactgaaatactgcacataatttggagttaggaacttcaaaaactttttattcctaaaagctatacaacaaggttttattttaaagtaaagaaaaattttcatctctcaaccttttcatttctcctttcacagaactcttctctttttcctggatgattttatcccacctccataatcattgaccagtttttttaatgcagttataactacactacttcagacattcaaataaatacactgtattaggggaaggaaaggataat

SEQ ID NO: 39064 - DNA, 1024 bp, Homo sapiens
ttgtggttcttggaagaagatattttaagaaccagttatcctaagaattctgagcacgcctcttctgagaattgcttggactgtctttgaactctgcacctccttccaggccatcttgtgagacttggtgttaatagctgaagtcctatctgtaccaacaagcaaggccacttttcagaagataagagttcactgaatgcacctattataatctgtggccccagcagtataattcttttatctttcaaatgttataattgcaaaaaatctcaatgtccaaaagggaatgagtgaaactaaattaatgagaagaatattaagttactgaagtgtatatgcgtaggggcgtgaatgtgtgtgtatataaatatgtattaaaactaggcccagtaaccttgtacttacccagttccatgccgctacactatttttccacattttcatagacctattgaaagatgatggctcctttgtggacataatttagcaatgtattaaattaaagtcaatgtagacaacaggccatttcgatactgaacttttctatttcttgctctttctttttgtcacacaaacacagaaatttgtgcaacgtcaccccaaggagtattaagctttgtaaactgacaaaactggctgcttttaggaaattctcaagacacaaatattcagtctttttaaaattcttacattttggaaaacatgcttcactctatagatagatccttcacattgggattatttaatcccaaaaacaagtttgctgtagacaactgcttaagcctttaaaaaattcctattctgctaattttttaaccaacttgtaattatagataattctgctttaggtcaaggtcttacatcatttaatatcctaaccttgttatctcttgcctcctcctctctgtttttatttgttttcaaggtttttcataaaaacaaatactagttttgaaggattttttcttacatttaactgctcaaacataatatttttggggacaccttcttatggaggagtttg

SEQ ID NO: 39065 - DNA, 1080 bp, Homo sapiens
tcttgatttttgcctctgcagtcttcttcccatcttggccaagtgtgggataaattctgtctcgcccgtaactcctttcactgtaatgaaatgaattcaacactgaacgcactccagaatttagctctggtagtgagcataatttaccttggcttattttatttgtaaatggaaatgtatcaggagtgcctggaacacttttccctcttgataggagttggagaacactgcctagccctctgccaagaagtaagtcaagcaaatgaagataccagttggatcagagggcctaataatagtctaaaaccaagcttcagaaattgcttcgtgactgttgtaagatcaatattgtgtttgcgtattagttggacagaaagcatgtgtggacattcatccaacctgaccccaggtcattcattctccatccaaaaagggttataggtatggtttatggtctttgtttcagcaaaacgtcctacagcttggacttggggtggatttatatagtgtagcatttgtatataagattcaattatggattcatgctctgtgaacattgttagatttttaataatctaaagtaggtcacattgaatgtaactgatattaaccctattctagagaaaacatttgtcatttgcaagtgtttgacttttttattgatatgatttagatatgccacactcaatatatttagtatagattcagtacataacaggaaagaaaaagggagagacagacttgagtgttaaaggaccccagaaattgctgaaatgtccttttagattcttgtggctggcaagctatgctgtcattggttctctgcgaatctgtgatgtgttcacttcgccatgccccagcttgggaaatattcttagtaatccaatcaaatccttaaaaacagcatttttgtgaatgtattacttcttcaatatccccatatatttgtattgtttcaagccactagtatctaaatttttgatataaatatctaaattctttcattttatagaaaattagcatgctttatgtttctttataatgaaaagtctagataaagtatcataatttcattatcag

SEQ ID NO: 39066 - DNA, 1031 bp, Homo sapiens
aattgtttatattttcttttaaactctcatcccatatccttaagccttgtgactgccacagagagaaaataagatcaagcatgagcttacattagccacagaaacacctggggcagttccaaagttttaattactgcttcattaatgtaaaagcttaactatagttgtaatgtataaacaacttttggcatgtgccctgcaaatgcaaaaaagtctaaataattattgtcgtggctcctgtctcaacgcaagaccaatgatcgccaaattatttttaagacatggactacattaaaaagttattgaattatgttttctgttagcttatataaagcacatgacatttaataacttgcaaagaaatgcttattttatctgtaatatatactttggtgtttatcagattctgttcaaactgtgtagcaaatttccttgaaaatagaactttcttttttcctcacatccctgtatttgatatcagactattcttagactctccacctcactcatcaccatggtgtctacggacttataagtatgacatgctgtcacccttatttatacatgaggtatggaggtgagcgtgaataagaatcttgctcagagccaattagttgcagatccagcattggaattcctctcccatagtatcaaaagtgtagtcatattcctagatcattaggcaggaagaaaaagaaaataaaagaaaaactactcagagacatctggccggatctgtgcctttcatcagaataatcatgtcctgaatctcccactggggttgtcagaaaagatttttcccaagcttttctataccacggagagctacatttaatttataacctgaaagtatcccctaaaacagactcataatcatgcttgctgaaattttagcccagccttcttgcttgctgagaaaagagctggctgtcctttctctttgaataagcctccttgtatgaacagtctctagagatgtcccttttccagatgaaaatctgttttatgtgttatcatgttgaccttccaat

SEQ ID NO: 39067 - DNA, 1032 bp, Homo sapiens
ctacatacagtagtagttagtcagataaaggatatccaaaaaagagatagctagaaaatgggagaagcagagttctgcaacccctttcagtttgtaaattgttcacatgtatgaaaataactggtatttatcaatccactcagatttctgcactaacttttatcttatatatcatatgtatctcttttctttttctaaatgggaacatatatttgttattaggtggcagagatatagccttaagatatatttgtaaaatgcacactgaatagacatccaacctaaaaaaaatcactatttaaaaagcccatataatatatacatatttgttagcatgctaattgttcatgttttgtgtttattaaatagaagtgatatatatgacattttgaagtaaagcacatctgaaaaattctactcaaattaatggagcatgacaatctgtgcaatctgtacacctaactgaaaatcaaggtggttcaggacaacatcatctctgaggcctggaatcttagcagagagaatggggctgtaaacttgaccagagtggacaaatgtagacaaagaaagctcactagcagggatgctggcattctcccttatttgtgcttccagcctgttggttgaagtagaggcaggaaaccaaccctgcccagctggttctcaggccgtgctggctcgcccaccacagcacacaagtactcagtctctgtgcccaatctatagctgcctgttgagtgtgaagtggctaacttgtgaaaactccctgccaccttctttttttaccatattcagcacaccgcattgtattagataaagttatggtactttaaacaaatatctccgttcaccaaccaatttctgcacaccatagtctcagccttataatctgaaaacacaatattagaattggatagaaaaacaatcaagaaaacttgtggtaatatcttaaagcttccaacacattttagctatttattttattccattcatcaaaattctgatttcattagtttggtaagaatcttatgc

SEQ ID NO: 39068 - DNA, 1027 bp, Homo sapiens
cagccctagcctttttgggaacagagaatgatgttgaactgaagggggcgctagatttagaaacctgtgagaagcaagatataatgccagaagtggacaagcagtctggttcgccagaaagccgagtagaaaacacactgaacatacatgaagatttagataaagttaaactcattgaatattacctgactaagaacaaagaagggccacaggtatctgaaaatttgcagaaaacagaattaagtgatggaaaaagtattgaaccagggggaatagacattacccttagtagttctctttcccaggcgggtgatcccataactgagggcaataaagagccagataagacctgggtgaaaaagggagagcccctcccggtaaaactgaactcttctacagaagcaaatgtgattaaagaggctctagactcctctttggaatctactctggacaacagctgtcaaggtgcacaaatggataataaatctgaagttcagttgtggctgttaaagagaattcaggtacccattgaaggtaagctgtttttctttaatgcctttatattctgttgcataattgcctttctacaatttgcacatgtaatacccacattagtacatttatttgaaaacagtattttctcaatagagtgtatctttgctgatagcattaacaattggggagaaaatttacaagatatggtatctattttggaacttggactgtgacatagatctctagatacctacttcaaaagtcgtttacttttaatctttcaagttactttccttttttacctttattttctaaatctagaggagtttaaactgtttttgaagaaatctcaattctaaactgaattgcattatgttatattgtgttctcagtagcattcattaatatgtattcctgtgaattgtcccaattctctattatttgctattctattggtttttaaacttattttcagtatgtagcagctcatgggatgtagttcaacctgaaacaaccaaagctttttccttgt

SEQ ID NO: 39069 - DNA, 1141 bp, Homo sapiens
ttgagctcagcagttcaagacaagcctgggcaacatggtgaaatcacatctctacaaaaaaatacaaaaattagctggatggtggcacacacctgtagttcccagctactcaagaggctgaagtgggaagatcacttgagcccgagatgctgaggctgcagtgagctaaaatcacgcctccgcactccaaccttgacaaaagagcaagaccctgtctccaaaaataaaaataaaaagattatttataccttaatataaaaatgtataatacatttatttgttaaaaagtattctaaagtgctgtttctctaattggcttctatttaggatcagcaaactcatttatactcaatagacagttatgttttgtgtttgcacacgtatttaggataaactcattatgtataagttaaattgattctgttttagaaagcatgataagttattacataatgtcaagcataattcaaagtctcactatctcattataatatttgggatttttgtgctttcacaataaaaatgagtaacgtatacatgcgcacacaggtatctgtcagtttaaaaggtataatctatgttgcgtgtatatacctgatagtccaatttgagactaacagtagtatttcctgtagtatagttcatcacccagagttctccatggttgcctggaccaaagagtagaaccaagagctcaaggcccctttttaagaaatggtaccttttctttaagtcaacatttcccccaggatattcaatggaaagctagtcccatgaacaagcaatgggttagaaaatagatgtttcatagttaaatatgtttcatacttagttcttagctctgtgtagagcagagccttaagctcatagtttttattccttaaataggcttctttaaggatttcttagttttattttctattctctattatttttcctggaattggcataatagcacacagttaatttttactttatctctaatcacattttgattttatgagattactttcatatcaatatatatttaaagacatgttagttcaatctctctgttggctttaaattctttactatagtaaatgcaaattgggatgtatttcccttttcacattttttttttgagatggcattttgctct

SEQ ID NO: 39070 - DNA, 1524 bp, Homo sapiens
tcatagttttgttacagagaactaactacaattcattttatctgtatagccttttagcctttctttcaatgcatggattaatgtaataatactatatagatcatacatatatagtatatgtaaattgcttttccttaaaaatgtgtatttttctgccattaaatattctattcacatgcatttagtgagcatgaattattttataatgagaatcataaaaaataaaattgattccctattaaacttgttttacaatggaaagatgttcaaatcctaaggaccttcatgaagacagcaaaatgctcttaacagcaccttttcttagaaataagggatgaattaaaggaattacaaactgacctagttttctagcatgaaatctttaaccatagttaatgtggaattttctgatcaaaagtcaccttgcttctactgggatcacagctaacctggaatctttaatgcctcctggtgccaagaagaccataatcttgaacattttttagtactgtacttgctggaacaactgaggtcctactcagccataccaggtatatatcagaatacaaaccctgtgattcgtaagtaccacttaccaatgtgttatactgtaattttatgatgattctttaagttgaaagtcactagtaaagaaaaaacccaaacaagatctccaaaacatccctgaaagaattgtcttcttgtcttcctatttagtatgaattttggaaaacccctaaacaaatatgtaattattgattattttatgttttaaagtgacactgcttgctctcccttcctgattattttacctttttttcatcaactgaaaattccagaaattcattaccctccaaaaacaccctcttaggcaaccaccccccagtaacttcagtaaccagctttggcaaataccttgagttaatcattcactctacagtcagacgtaagctcatgaaaaaataatcttctttgtaagtgagctcttcacagtgctttctggtggcggagcaagcttggagacaagtagctttggagaatagctgagggtccatttccactgcagactaatccctgccaatgggtgctgcacacagtgtttgggagtaagtatgcagaaacagtaatgattgcaaacctaaatgcctgcaggggctgtggaatgggggtaaaggaagcatgaggccagggttaattatagagctccttctctaccagtaggggctgtggacctctgtagctaggtgggaatgggaacacaggcctggggtgttgctacatcttctcatctttttcaaaaaggaagccgaaatatcgattaaatatattaaatctccccagttgttaagtattgtccactgtttaattttaaagatagtgagcagagcaaagaaaacatatttacttctgaatccacgctatgggctgccagcctgaggcctctggcattgatattaatataaacttttacgtttttattcattttcaagtaatcctttttataaccacaactgctgttttgag

SEQ ID NO: 39071 - DNA, 1032 bp, Homo sapiens
aagtgttgtcaaaggaagcaatgccctctagacaaagaccagcaggaacacacctgtaattgagtaagtcaggttaacttgttgcagtgagggagaacacacacaatatagggaaccatgggttacctcagaggatgttagaaaggagtggctcatgcctgtaatcccagcactttgggaggctgaggtgggtggatcacgaggtcaggagatcgagaccatcctggctaacatggtgaaaccccgtctctactaaaaaatacaaaaattagccgggagtggtggcgcatgcctgtaatctcacctagtcaggaggctgagtcaggagaatcacttgaactcgggaggcagaggttgcagtgagccgagatcgcaccactccagtctagcctgggtgacagagtgagaccgtgtctcagaaaaaaaaagaaaggacttatgggattttggtttgtgttaggtgatttgagggaggattcaaggaagcagggccttgctctaaatgggatgctgtcaggaagtaggggtaattttaagattgggtattttattaaatcctatctagaaggaaggaagactggagagactaatgctataattgggaaggaagcacagtcattctcattacccaaattagggagacgtttggtcatttttgtggctggataatgtttgtgttgtttgtgttcagctctgattacaaagttgtcttgtttttgttgtgattcatcatggtcatagaatggccttatttagtgtggatgttctggaaaattatattaaataggaaaacatcgggcatagctgtgaatgctaagccggctcttagtaacactgaggcctggctgatagtaccaggctagttctcagatattagggactgcatgcctttttctctcaagtcagctagccagcaacctattaggaaccacttatgcccatacattttatccagtgtggctatgcacataatatatatttccttttccaaaagttatagtgaagcatagttcattctcaactctatttcaa

SEQ ID NO: 39072 - DNA, 1032 bp, Homo sapiens
catctccaaaatgcaaatggatcatacttccaaatacagtcacattctaaggagcttttttctatcaccatgaagtggaaaagtataatgatatcccacagcctaaaaactggaaagttggggtggagtgagatctggatttggaaacagttgcagaaataagttccagtgccataccagtgcctttcccaggtagccaaagtagtgcccacaaaccttgcctgcattttggatgtgatggagagtcagtcaaggccatagtgtgttgtgcctgaggggcccaattgttaagaaaccacagagaatacactgtaccgttcttgattgtacttttgcctgtgttacagttggtctttcttggaggaactagtgaaaactagttattaccccttgtccctgcactgttatctcttcccgtaagtcagctcagaatgggagtggaatctgtccaggtttttttcggtcactttcctgtcagtctcttgcatcatgaaaggaagacatcattcacatctgctcattgctcatttcagtttgacctgtgttctgttagaaattcctctaagattttaagatgcagcattgagcagattttctgtcactgaagcagattttactcaacatttattcattcattcattcatttattcatccactcagcaaatatctaattagagcctgttaggcgctaggcactgttaagcattggggagcttactgtgaagcacaacatttttatactgagacatgtccacgttgtaatgagccatatacatgggatcattttacaggaaatagaactttgctgtcatgatttgccttgggaaaaattagggaacaaatgggggtaccaaagacactgtctttcttagcagtgatctttgtgactttatcgtaatattattgtagcttaagagttgtgggaattaatttagctgtcattgttactattgttatttcctgattgctgacattttgcttaataaagatccaagctgaaaggtgggtagagtcaagataaaaaaattaaaa

SEQ ID NO: 39073 - DNA, 1034 bp, Homo sapiens
actttgttgaagatcagatggctgcaggtatgtggctttatttctgggttttctgttatgttctgttggtctgtgtgtctgtttttgtaccactatcatgctgttttggttatatagacttatagtatagtttgaagttgggtaacgtgatgcctctagcattgttctttttgcttaggattgtcttggctacttgggttttttggtttcatatgaattttaggatagttttctctagttgtgtgaaaaatgatgttggtagtgttgaatccatagattactttgggcagtatggcctttttaacaatattgattcttccagtccacgagcatagaatgttttttcatttgtttgtatcatctatgatttctttcagcagcattttatagttctcctcgtagagatctttcacctccttgactagctgtattcctacgtatttttgtgtgtgtgtggctattgtaaatgggattgtgttcttgatttagactgtcagtttgagtgttgtgtttggaaatgctactgatttttgtacattgaatttgtatcccgaaactttactaaagtagtttatcagttccaggatcctgttggtggagtcttcagggttttctaggtatggactcagattgttggtgaagagagatagtttgactccttttcctatttggatgccttttatttctttctcttgcctgattgctctggctaggacttctgaaatctggaaaggctttgtcatgaggttctgggattagtttgatcaatattttaaggtagcctacatgatagatcaattgggctagatttttaagaggtaagaaaccactttaatggaaaaccttgatgtgtagttcattaatatttaggctagtgaattaactaacaatttttaaactgtcgattctgaatacagctaagttccttagtcatttgaagttctatcagtacatttgagaacatatatgatttataactacagtaccctgtactgtacatttgagcttataacaattagatccaatttagattt

SEQ ID NO: 39074 - DNA, 1048 bp, Homo sapiens
tgaatatgaataaatgaacatgaggattaacgaactgttgaaaataggctgagatactagttttctttcttttttagagggggcatgatattaaagatagttttaagtaacaaattacttattacaaagttacaacatgtggaatcaatagttttatttgttcattaatttattcattcagcaaacatttgttgaacatttaatgtgtaccagatattgccaggatcaggaaataaagaactaaaaatggacattcagactgcaattgctagtacaggggtcaaacaaaatcagtgattagaatttagtgcgttaagttccctgatgccttcacagccagaagaggctgtgaagggataaacacttctgagagtgggtggtagtagaactgagtattcaagactgaatgttaggcaggtagacagtgactggttaggctgagaaacttacaagtattttcgttgagttctgcttccactattatttactttacaatggatatgaagttcagatttcatcttatttactgaaggtggagaaaggatgtggaagtaggggttatgggctctcaaaagtagatttagagagatttttttatcactgttttatgatatagttcactgagcacttacatagattaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagagaattgcttgaactcgggaggcggaggtcgcagtgagccgagatcgtgccactgcactccagcctgggtgaca

SEQ ID NO: 39075 - DNA, 1033 bp, Homo sapiens
tctcttgaccttgtgatccgactgcctcatgctgggattacaggcatgagccactgcgcctggccaggagtttggatttttagatataatgggtagccactgactgtttttcattttaagccaggaagtgacaagatcatttgtgttttagaaagatcattctgaagtacgagagaaaagataccacttagagaatactggaccagaactagagaggctcaggagtgtgactgtgtaaagtaaggcaatgcagtgacaatggagtggttagactgtggtctccagaataacaaccttagtacttggtgatttttacttgttttttccgtcgtaaattcttcttagtgtattacacttgtgccagtttattcttccaaaaactctgttctgttttacaccctcatttttcttaagatgaaaatctttagtcgggcattcaaagtccatcactgcatggttctttcctttgtgctttcacttcccacctagtccttagtgctgccaaaactgactcattattccctgaattcctgctttcacctttgctctctgtgctccctttagtctggtttgggtctttcccattctttattgatttttacataggaagtattcatttagagttaatcacatgtttatttcttttagctttatatgttttacatgattatttttcagatccacagttccctttctgtagtttttcctcctctgccaaaattcttatttttttcttgaatccccttcaatgtagaaagcgtagttatgttaaagtatatgataaaagggatcctgtgggtctgtttctattgtttctttttgttctgtttcatatagtgggctatttttaaaatatatgccagatgttgtatttgaaaatttatttgaaaaaataatttgagggctgggatgatgtacatcctcttcaagaagataggaacgcataggagcatgaggaatctaggttgggtttaactcattttcaggtgttaagccctgtttgtgttctgattcccaggtactcacagagtgt

SEQ ID NO: 39076 - DNA, 1045 bp, Homo sapiens
agaattaagttgcatattgttatttcttttagtcaccattttggattcttagcattccctctgaagatattgcaagaaatttgatgaaacggacagtgtgtgccaagtaagagaaacttatgttctcctgcatgaatatactggtacttctcataaccactcaatcctgttttttgctatattgggcagtgtgaaggctcagtttagcttgcagttacatacaactgccactgggtggcggtgggggaccagaggagggttacctgccgaaaccaaggatgaaagaatctctggggaaatgtcgacacatttgttttagaataattttttaaaacttccgtattatgcgggagtatagtatgagatataaacactatgttcttacgcaggatagatgccacatataattataaccaaagtgctgaaaatccaaaaatacttttttcatagatggtttttaattggatgagcagattagtgaagtgtaaggtaacaaaaagtgaggactgccgtgagacatgttttactgtttcagttggtagagaaaataattatgagtaccaaatcttggtgtgaattaatgtaatgatgctgttcattgtttatcctcagtgtttctagactttatcattggcatccactttttttttcttttctttcatttcttttttctttatactgttggaaaattttctgtcatcagatttgaaaattaaactgtatttttaactagcatcttaaatatcaaacagcttgtgttatctttaagctgctttttcttcctgaacattttggcagattgctgaaaactttctgtagaaattatatttgctaatgcaatgcaaataagaatttacatatatctagttttattaacatggttagcgatgttttatatcatcatatgtaattgttgtattacggaattggacacaacccaatatttagttaacttcatcctattgagaactacctgcagcctttaatcttttacagtgaaggtcgttaacaggccttattatgaaataaaaatgactagaaaaca

SEQ ID NO: 39077 - DNA, 1069 bp, Homo sapiens
ttgagattatttgtgtttatgttggtattcattataataactgggatcagcccttataatactcttttccttttcctcacccagtataagttattgtattggtgagcatttattatactttattttcttttgtggaagtaatttgatatcttgtactggtgacctgtctttttccctaccttgactgtaaagaatttagtaacatttattaggaaaatgagttataatttattaggtgtatataaatgggctagcaagaaaaagatattctttatctgaaatctgttttaaaaagtactaagaattattccaatttgcttttagtagaagcagtatatttcttttaaggaaattgtcttatataatttacttgaatttttatttattaaagttatgtttggaaacttatgttgtaaccttcagtctactggggtagaattctgattgaggtagttcccttagagcttatccaagatactgttaggtataccctctgtttcctgtggttctgaactcttactttatcctaaaatattctcaagtttctcctgttttaaaagtacaaaacttttttttttggcaaatctgtagaggttctctagctaccactttgttttccttttccatttgccaaaatgcttcttgaaaaactagtataacttcttgtctcctcttcttcatctttcactctcttctggccattattttccagcttctgtgcctatcattctgttgaaaacgctaacaaaggccacagatttatagcatttgacagtgttgaccttcatacagctgctcttggtttccttgacagtggtcttggcaggtggtacttttacttttttgtttcttctcagtctacttgatgccctgcaattttctttgatttatgtttatatattgtttttttccaggcgtctacctatctttgagcacttctccgtcacactgcatgtttttcagagtcatgtcgttcttcttttgattttataagaataattatagagcaaacatgtaactgcctcctaagtgaacaaaaagaatgttattcagccttatggagtcagta

SEQ ID NO: 39078 - DNA, 1035 bp, Homo sapiens
ccggggccatctgatgtttcttctatgaccagaatgaggtcatgctttcttggtaggaataccacaaacatgatctttgcagcacatcatatggcacacaaagccactcctcctggtaatgttaactttgattgtctggtcgggctcttctctgtcagatttctcctctctgaatcatcattttcttctttgatttgtattttatggggaaataagattacactaatatcttgtttttcatcaaaccactactcagattaatgactccattgttgacagccacttctgaggtggttgccaagtgattcttttttccatcatttcttttgcatttgtaagttggtattctgtaagaaagagcttttctttctgccccatttacttcattaatttatttatagtggtatggagtcatggattcctatattattcattgggttgtaatttattagtagcagtattttgttgctcaaattgtcccagatttgaccagtgggagtttgtttgagctggctcttctgtccttttgaaatatcctcagtagttttttatgtaagtccttcctttttagcatatctgactgttcactgttttgcagtttattatttaattataatcaaaatcatatgtggttgagaatttattttggagttcttttattcctttataaaaagtaatattggaggttctttaaactgaatgtatttctaaagactttaaaaagtggccactggatatttcttcaatgacttctctattttagtaattttagatgagggaagatttccaaatacatataaccaaagtgatgttttagaaagggaaaagggagacatgttttagggatttttttttttttgtcttagatgttttatcaatggatagatttcttctagttacgtgtctaacacatgtgggaagacaatggtggcatttatttccctgagtttttggcccctggagagggttattttcagatcccctgatgttcattattagacctcaattgtgtcttctctctttaagcctaaagcg

SEQ ID NO: 39079 - DNA, 1342 bp, Homo sapiens
ttctaattcaagtagtgaaggaagataaatatgcactagagagtgagattttgcttaagattttgcttaaggtaaacaactgctttggtataagctaactaaagaaataatttttacattttgtattttccaaccaaacagaatcgggaccagtattcacatctgctaagtgatcattttctgccataccaaggtcataattccttccgtgagaaatattttagtggggtaacaaaaagaattgccaaggaagaaaaatccacccaggaatgaaaattaagattttgacaatgaagaaagaataagaatttgatttaaaaagacatctggatgtgaactttcatgtatgatccagaaaataggtacggttttaaaatattttatatagaaaagctacaaagtaaattgagcaatgcttttaaagttatctttgttttatagacttttttgttgtatgtattacagtctttataatcttatttaatgtatatttgtactttcaagtactgatggagatagactcaaaacagttatttttttacaattaatctacaaagggaattaatattgttgacttttaaaacatctgctggatatattatatgcaattaatagtagttaagaatttattcatttggtagatatgtttatttggtttttggttgtcatcgatttacattgccactaataaaccatattgagaatttctaaaattgtgtcatatctagttgtcttcatgggggatgtgatgagggaaataaatttttatttagaaattccagacaaggaaggaataacaatgctaatagtgatgataagaaaggctaagacctgacaacctagaaagattccaaactccttaaggcctgtctacatttgaagctcttttgtaccttggatttgctcctgcattcctaaccgttgactgttgctcaagttaactacccacaatttttggtttagaaagtaacggatagttaaaagcagtaacagcaacacaaatgcttgatggttccttaatggtattaagcctaatcagtgccctttgaaatagaagctatatttttcttgaaggagaaactttgctgagtccacattgtgtccatcatgaaaatatcttgcttgaaaaccactatacccattaattcaggatgctaatagctttcttgcctttggtggtcaaatgtacctcagcagggtggcagtaaatggatcctctctctctaaccagagcctgtatttattattattattattttagtgttactgctgacttttatggactcagagtattaatgtgcacagcttaggacctctaaaagtatagtgctgcccaagcaaa

SEQ ID NO: 39080 - DNA, 1047 bp, Homo sapiens
tgagaaactgacccagagaattctagataaattcttggagttggccccccaaccttggaaaagtgctctaccttttatgttaaaaccgggccagaacttaagagatatttcttggtactggtgaagatgctgtcaattaagatgaactcctaaaaaaagaaaaatgtcaatgtaagtcaagctagagtcagacaaaggacacaaacccagtggcttcagtctgaagaccatgtgtccatggttactgagtcaaagggtccccaatgccaaaacattgtcggattttgctttgttttggggaccaaaatcattggaatttcatttatttgagctccaagcagctgctatactaaatactaaaagtagatgtaaagccttgcatactggcatggagcctcccactccaaccccatgttcccttgtttctccctccacctttaacctgacctcagtggctttaaggagaaagatgattagggatggggcccaggactcagccaccacatgtacccatctgaatatgctgggggactttataggagaaaggggcacaaacttgtatggctgtgttgaatacaggtgcccagttcaccatcttacacagtcctgtgggggaagggtccactcggtttcaactgatagggtttgggcaaggttcataataggaaaggaaagttaacatgaccacaggtcaacttgtgggtatgacctgttgaaccaatttaatgcaccgttgttctttttgcatctgaatatatagcagaaaaatgacatgttatatgcttgaacttttctgccctataagtgctagagcccaaccagaaagagccccatttagataggtactagtgtctttaaggctacagaaacctaatgatacctttgagctatagaatatcctgtaactgattactttgctgattggagactctggtaaaaggagatacccttcatccagaggtgcccttggagttttggatgcctggactccttgacatggctggccagatacacggcttctgaaaaacaactaagtattagctacta

SEQ ID NO: 39081 - DNA, 1243 bp, Homo sapiens
ggtttgtcatggaggtagatatgaatagaagctggaatgctgatcagaagattgatgcagtcatccaggttagagaacagtggtagtagggattcaatggagaaatatttagaaggtgagtgagcaggcaggtcctggtagttgggaaccagatgaggagtcagggatgatatctgagattccagctagggcactgagtgggtacaaactggaatagatgataatgggaaaaggatgagtttaggtttggacatcctgaacaagaggagcctatggtacaagcatgaagaactgcatagcaggcttttgagtatccaagagcaaagccaggcaatgattacttatgcaagaagcagaagatccctgtatgggacaaaaaacaaaacaaaacaaacagaaaaccactgagtcaagacacattgtacagctccaagattccttctgtgccgttttcccccagcatgatatatatatttggcaaagagaattgacatgacccaatactcttgagactggatcaggccattccaagtttattacaagaaatttatactagaattacttaatgagataaaatttctccactgtgccacttgaagctgcgagaataacactggctttgggtgatgtgcttctgcccaaactggatgggtggacgtgctctatttgccgtataagttagtgagctacattgtagagttaggatgtaaagaaattgataagctgttgttagttgtctctaagaaaaacctgctaaagaaatacgcaggctgccgctgtttgggctccagacgcagaaaaagaaaaacccaaagggttttcctttcctctcatcctttaaaattaaaaatacttccccttcctctctcttattaagtaactacataatacctttcaggcagcaacataaaaattacagagtaggccagaatatggggaaatttttaattaaatctggggtttcatttgttttttaatttattaaaaaatgcttggccaaaaaaaaatcccaatttccctctgcccccctttttatatatccttatgcatttggcagagctcatgacaatgtctttccacctgtggaccggccaaaagccttttctgaagctcctactaatttggattaaactgactggttaaaagcttcacacagaaatgctgccaggaaagtcatgaggtctgatgacatttaagtctacagtcttatcttttggaccaaaataaatgaacaaagatctag

SEQ ID NO: 39082 - DNA, 1056 bp, Homo sapiens
atgttttgtagagacagggtttctccatgttgtccaggctggtcttgaactcttgggctgaactgatccccttgcctcggcctcccaaagtgctatgattacaggcatgagccactgtgcctggcctttacgaccttttaaaaacccattactaatgaggatgagaggaaggacagcatggaatcctctagcccttgcttgtggcccgcctggttttctctaacactccctgcctgcttctccttcactatttactgcatgcctggcatatgccagccagcaaccactatgaacatcagatgaataaaagatacatgtcttatgttgaacagttgtacacagttcttggttaaactcatttttgttaaattgttaagaactcatttattctgagtcccaaactctggcacttaaaaataaaaaataaaaaacaagactataccactttcaatacactgttctctggatgacgtactgggtgagattgggaagggcagagaggttttatggggtgcaacatctgatcataaaggaattgacgttttttccctttagtatatacgatttctttgtatgactaaacccgtttctttgtttatgtttcctcccataaagttctacagccatctttttcatgcttcctcagtgttctataaagttctatagtccatttttaaagctttttatttaaattttttgaataagcaataaatttacatggtttgaaattcaaaacagttcaaaagcgtatacccaatgaaaagtttccctctttcttcttctccttctcgtgggtctctgagacacccagctccctgccttgagacaaccactgtcacagatggcttagctcaatgtcaaacaatacaagagagtcccaatgtgaagccatcattgaagcacccatgtgaaacaatggcaaaagcaaagaaccaggagtaagatgtcccttcccagtcctcccaggacagctctgaattcatctttgtcttatttcgcactgttaacataagataataacctttccttagctatctctcttggaatgagaactat

SEQ ID NO: 39083 - DNA, 1062 bp, Homo sapiens
gcattgttacataggtatacacatgccatggtggtttgctgcacccatcagcccgacactacattaggtatttctcctaatgctatcccactcctagccccccacctcccgacaggccccagtgtgtgatgttcccctccctgtgtccatgtgttctcattgttcaactcccacttatgagtgagaacatgcggtgtttggttttctgttcctgtgttagtttgctgagaatgatgatttccagcttcatccatgtccctgcaaaggacatgaactcctccttttttatggctgcatagtattccatggtgtatatgcgccatattttctttatccagtctatcattgataggcatttgggttggttccaagcctttgctattgtgaacagtgctgcaataaacatacatgtgcatgtgtctttatagtagaatgatttataatcctttagttatatacccagtaatgggatggctgggtcaaatggtatttctagttctagatccttgaggaatcgccacactgtcttccacgatggttgaactaatttacactcctaccaacagtgtaagaactgaaggagatagggacaccaaaaacccatcaaaaaatcaatgaatccaggagctggttttttgaaaacattaacaaaataaatagaccgctagccagactaataagaagaaaagagagaagaatcaaatagacacaataaaaaatgataaagaggatatctcaactgatcccacagaaatacaaactaccatctgagaatactgtaagcatctctatgcaaataagctggaaaatcttgaagaaatggataaattcctggacatatacatccccagtggtatttcaaaaggatagggcccacggagatgactgagctggctggattttgttactgtacctctatacctcagagaggcctaggagcctgccttgggttttgagattattctcttgtattcccctggagactgaatcgaagaatgaattggctccttgcacctcttctctctctctacttatctttttttttttttttttttgtagaga

SEQ ID NO: 39084 - DNA, 1050 bp, Homo sapiens
acagatccccacgggagcagagtctcagtcctcctgtacttggctattcaaagtgttggctatggaccagcacatctgaagccccagagctttttaggaatgcaggatctcaggccccacatcagacctaccaaagcagaatctttattttaacaagatgcccgggtgatttctgtggatgttacaatctgggaaatatggttcccaactcaaaacaagataccacacatgctacagctattgtctgctggcagagaagaaagatagctaaagtcattaatatagttcttaaacttttgttatttaggtgaattatttgtttatttaaagtaaaatggcctgctttctctgaaatcatttgtcttgcctctcagtaaattgctgttttaaattcacaggcttccttactttctacttgcatgacagttctcagaatgaattaaggatcagtcaattttttttttttttttttttagctattaatacctgtaaacagttcaatctgacattagaaaatactgactgttgctgttatctgcccaggtgcctatttctccttcatttggtaatggcaccttcctcgtcagaagccagcaggctggtggagctgtctcatatagtcctctctcctccgatggcccctccaaagtgaggttaactggacaccctctgatgaagctcatttgctctagcatgctagctgaaaggaccatttcctgcctcaatcccagagcttctggatcaccatcctgcccaagacctggctcttcagcttttcctttatgctagcctatatccagtctttttcagttttgagacaggatctccttctctcacccaggctggagggcagtggcaccatcacagctcactgcaacctccacttccttggctcaatggatcccacctcagcctcttgaatagctgggactacaggtacacgctgccacgcttggctaatttttgtattttctattttttttgatagagatgaggttttactatgttaggcttgtctctaactcctggcctcaagagatccgtccacct

SEQ ID NO: 39085 - DNA, 1048 bp, Homo sapiens
gaacacatgaatgaataacttatcaatctatcatatggaaaatagcaatgttaatacaggctaatccacttaatgactgtcaaaagatattacttgacaggtttttagttttattattcatagagtggcataaaaattcacacatctttcccgtaaatgtgtttctttattttttattagtgaatgtaaaggactgaagctgatgtaaatttgctaaatgaataaataatactgccttataaaaaataaattgaatcaagcctcaagaacaactaacatatagctcctatcctattttcaaaatgcttttggaaaaggatggcaatggattctggtgaaacactggctgatttaatatcctgtatcatcagtactcttcagccattaaacaatatcataaattaatatttattggacatgtttcataatagataaataataaagggtatatatcatgtgatcacattttataatccgttatttataataatgttacatataagtgaaagtattccaatgtcatatagttatctctgagtagttttgctttattttattttattgacttgtttatttcattctagtgatatgtattttatgattatcaaatacattttgcttttataacatgaaaaaaggaaaaggctatttttggttcaaaataaggactcagtgggctttgtgcatcaattaatatgagaagatatgttaaagtttagatatccagactataccatgttgtaccatgcagagtagtatagaaaaactaaatttccctaagaatgtgggaaaagtcttactagcttttatttttaattaaccaaattcaatggaacttaaattaagaaaacgtttctgtaacagttctgtttgattttgtgaagagatcttacagttggagatttttttctaaaaggataaattaaactttgtgttacaacagacatttctgctttctagaccagagcttctcaaatgttaatgtgcagacgaatcccctggggatcttgtgaaattacagatgggtctgaggtgaagcctgagattc

SEQ ID NO: 39086 - DNA, 1021 bp, Homo sapiens
aggcttggggggtgccatccacccagccagccaggacattggtgtctggattttagccacagtgaaaaacaagggtgaattgcttaatggctgcaatgctgggcaactgaccaacttcattcatgacttaaaaaaaaaaaaaaaataagggccgggcacagtggctcacgcctgtaatcccagcacttctgtaggccaagccgaggcaggcggatcatgaggtcaggagtttgagaccagcctgaccaacatggtgaaaccctgtctctaataaaaatacaaaagttagccagttatggtggtgtgcgcctgtaatcacagctattcaggaggctgaggcaggagaattgctgccgagactgtgccattgcactccagcctgggcgacagagtgagactccttctcaaaaaaaaaaaaaaaaagttgttttgccagtaaaatgcataaaatatgcctattgctcaataaattgtcacaaagttaacctcatgtaatcaccacttagatcaagaaatagaatacagtattgccaaagtgctacttcagaatcacctctgtgccttctaagtgtaagcaatatcttgacttttagataatccttcattgcttacccatatagttttaccacttaagatggcatcttcaaacagagtttagctgcttattttgctcaacagttttgaagattcatttatattgttgcttctagctgaagtttattcatgttctttgttgtgtgggattttactgtgtgactatactgtagtttaagatttgtatccattctagtgatgatggacatttacatttttctagtttttggcattcatgaataatattgctgtaaacattcttttacatgtttcctggtgaacatatatgtgcatttggttgggttgatacctcagaatttacttgttagatcatacataaagtatctctattttctactttaatgaattatgccaaattattttccaaagtggttgtgccaatttacactcccatcaggagtggtta

SEQ ID NO: 39087 - DNA, 1190 bp, Homo sapiens
aagattatttcttcttacttagtgagtgacaatatgcccggtctaccaagttcaggtgcactctagaaatgatggctgtaacagaagtctggcattggtttttgtaggaactagcctttgggccagcagttgtccaggcttgaaagccatctgctctttataatttagggtaccagggtatacaccttgaagctgaggaaatccaatcattttggttccatgatgactgaaggaatgaagccccaaacaataccaagtcacagaagatgctcagtaaataactgacctccttccattccttggctttgccttaaccacctgtaaggctgtgcttgactaagcacacagctgaaccaggccataaatgttgggccacatgctacaacagcagtagaccaatggctttggagtttgtgatcagggaaaggaaattcttttggctctgccatgttgtccatgatgccaaggagacaaagctgtgaacaccaccagaacaaatgtctattgactgtgccctgcattatctttactgtttctgggcaaattctgaaaatatccccaaagcaataatcattttggtgtctctggtttctatctcgttttcttttcttttttttctttctttttctttatattattattttttaatgaagtcaacttctcaaacaaaacaacaaaactccaacactgaattatgcctggttttgctgtcagacccttgtccgagccatgcacttggaaacagtcatcaagctgcgaagctgcgtgttatcctaactcccctttgttaacagcttcgtgttggcccctctccagttgctgccgccagcagagtgtctctgttttcagaccatgtcatccgggacttgccagccttcagagacatcatcttctctggttattggagactttgaaggaacacttttccttttgtttttcaagacagtaactgtggatatgatgtgagaggttgacagtagtgatacctttggtttctgtagatgaaggtttttttttttttttttaggtttattgaaacaaatgagaatctgtcagcagaaatgtcctttaaaatcacccttacttttgaagagtcacatagaagagttaagatatggctactttccaactggtctcccggggagggtttggagcagttagagggtcctgtgaaagcagaatgacatgaa

SEQ ID NO: 39088 - DNA, 1081 bp, Homo sapiens
actagaaaatcaaacaaggcacgtggacacacaaaggagataagaggctccaagagatcacgttcctttcttgtgtaatttctttcatctaattctgtcaacatttactggaaacctctatctggaacacagattacctcaagtaatctgcctgcctcagcctcccaaagaactgggactgcaggcatgagccaccacgcccagacaatttataatcctagtgatcatgttagaacaacatctgttgtcaaccaatcattgagtatttgttgaggatattcttcgtgctacattaagtgaatgcaggcagcatatcaagtctctacctttttcacaacctagtttggtgagataatgttagtatagattaagcaattgttactagtaaaaatcagtatattattaatactaagttgtgtggcacagactagaactctcagaaaagaggctgcaatcataaatatggtgagagtcagagatccttctgggctttaaagaaatgcttaatcatagactgtgtacctatccccctgctgaacaagacacatccttagtttcaagacagactggggtttgggaatatgggtagctctgtgctaatgcatcaccccactgaggaaacagggtttgtattctacttactgtggcttcattgcataaattttatgctcattggagagaatatttactcacaatctagcccatccattcttataaaagagacctctgaaagctaagagtcactttcctgagggaaatgcaagactctgggagagagagggcactttgagaatgggaaaattgcctgtgaaatcaaatttaggcgaaaagatagcccagcagccatatgtaaatcattccctcatgtaggaacaatgctgtgcacttggtaattcaatagaaaacattagtcatttatcatccttaattatcagtcatctctaactgcatctggtttgcattttttattagaaaggtttttttttttttgagttggactcaggcattttttttcttccgttcctgatttcattttgttattctttttaaaattccatcactaattcccatgatgtgaaga

SEQ ID NO: 39089 - DNA, 1092 bp, Homo sapiens
tggttgccaccttgcagaatcttgtcccaaatcattatcatgtttactttttatagtttctttttcacattgaaaattagtcttagggcatatcctctatgctctaaaatgatttataatcaaattgtgatctactttatgtcaggtttctcagtgttctagttttgagccaggaaactttatcaaatgtataatggggactcatagagccttgaaacttaatcaaatttataaaagggactttattttattctatttttttgccattttggaattttatgtcctatttaaattgttctctagcttttaattcaaaggtcattgttttcaacagataaagaagcaggtacaaagattcaccctaatacaataagcgtcactgaaaaattatagttaaaaataagaagtggttaaagtagtggttaacaaggaaacaataagcaacatgaaacagcagcctacagatgagaaaaaaatatttgcaaaccacatatctcataaggggttaatatccaaaatttataaagaactcatacaactcaagagtgaagaaacaaatcacctgattataaaatgggcaaaagacttgaatagatatttttccaaagaagacataaaaatggctaatgggtatattaaaacctcttcttgtttttaaccatgattgtttgctggaagcttcagcttatttggagagtttcacttttctgacattctttcggtccctgacaaactggtgtcccatcatggtttctctctatgaggcaacctgaagtgccatcattgagtttaccaacagtagtctctaacccttctttctgcctggagtactgttcatttccctgaccccaatgtacctaagcctaagcattaatatcttttgctctggaagatctatgactctttgcactaggtttgatcccttcagttaggtaatctgctatttacttccatagtattccataccttccttttctgaattttcagcaaactttcattattggttaagtgtatttattataaatacattatattgtgcatatgtaaggtatacaacatgatgttatgggatacatatagatagtaaacaga

SEQ ID NO: 39090 - DNA, 1457 bp, Homo sapiens
gccatgtctgtgtgtcaaatgccagccagtcctccaagacgctcagacatctttcccttattgaattcttttcacccctgccctgggagcctaaacttttctttgcacccctatctcagtttgtaccttatcacttgctcttttacagttttcacagatctcatggcaactctttctcatatgtctgtctgatgaagagtgaagcctctttggtgcaggactgttttttgatccttgtatccccagtgctgagcatagagtatacgttcaatagacagttggatgaacttttgagtgaagtatgacttagacaaattgcaatttccctaacagaccatgctgtgaaagttgtgaaaagccttcaccctgatctgattagatttctactacatttgaaaacctgtcaccctcctaaatttttttaagggaagtatatgtacacacatacaagtaaacaatttaatattgaacatagacaaagccttctctggaagcaattagttgatttacagtgccattggtagcagttttatgtatgtgggagtgtatgaatgtaaatcttggcctcatggagtcatttctctctcttgaaaatttgagattctatgtaatactaaaatttaatacaccaagacatccttagaacatgtttgctctaatacataagactggttcattctgacattcatttgcggcatttccatgactgaaataaccactttgagagagaatctcaatccatacacgtgcggtatgggtgttagttaatatgggaaacagtatctgaatccagcctctttcttcaaagcttttctttgaaacagatgtcctctctcttaccaagaagagagacttggggcatcttgttaaattaaatttagcctaggccgggtgcgatagctcacacctgtaatcccagcactttgggaggcaaaggcttgcggataacttgaggtcaggcgttcgagaccacctggtcaacatggcgaaacccagtctctactaaaaatacaaaaattagcagggtgcggtggcaggcgcctgtaatcccagctacgtgggtggttggcagggggtgtggctgagggaggtggaggttgcagtgagccgagatcgcgccactgcactccagcctgggtgacagagcgagactccatctcaaaaaaaaaaaaaaaaatttagcttagagctgccttcttacatattttaagttcagcttaaacgttacttcataagtagtgaagtgtaacctaactggaagtataagcaggccgtaacctacgcgtaccaatcaccgacttttcgccactcacaggtggacaactgtttaaatggtgttcaaataaggcaaatgtcgagctgtagccaatccagctgtttctgtacttcacttctgttttctgtacatcactcctttttcggtccataaatcttccaccaagttgcagtgccagagt

SEQ ID NO: 39091 - DNA, 1061 bp, Homo sapiens
agtgaaaaggaaaaccccttagaaaaccatcagatctcatgagacatatgcactaccatgagaacagtatgggggaaaccgcccccatgattcaattatctcccaacagggccctcccacaacacgtgggaattatgggagctacaattcaagatgagatttgggtttgagtttgggacacagccaaaccgtatcatctggttttctaactttgttagatagacgaactagagaacacaatgaatacaacctgagctttttgttcttcttggtgattggtctgtttctttatttctttacttttgttatgatatttggaatccatggcaattgcaacttctgcatttggcttggtgatttctagaaatgtcaggaatttttaccaatccagtgtttctgtttccaaagattatttgctggctgatcaattggatatggaattatcaccaataagtaaatgtgatatacttttaatctgtgactcagaaagtgagttctgcttatcttgatggagacaaatgacacagttctagaaactgggcaagaattcttagcttatttcaatctactctggatcccttgttcaaagttcttaagtgctggaatttgtgggaaaaggaatgtaatattttaatctgcctcatgaactgtttattatttatgaaatatttctcacattacttacataatggagatggaaagagggagtctttttggagaaagtattaaattatttccttccaagtccaaacataatttaggcagtttataagttatcctcacatttggttagacataaatctgagttatctgggtaaaataaaaacaaataacaaattggtagcttaacttagcatattaactctatcacattgcttaatatgaacttcagacacctgagagacagaagtaaacactattggctcttcctgtggcactacaagatttctttcctcatttcatactctccggtttctacgtatttgaaattttaaggtaaattgactataacaataattaattccaatgtaagtatgtgagatgagaagtttggagacaag

SEQ ID NO: 39092 - DNA, 1031 bp, Homo sapiens
agactttctgcccaaaccttaggccacaataggcacacatttccacatttcctttagtctcagaggcaagactatttcctggttggcgggcatagagaatgccaaggatttcgtctaggcctggcctgagtttgaatgtagaaagaagcaagacaatggttcctttttgtagctcttaattactgatgtgtgagctgaatgttcaggaacattcttgggacaaacactgcaggtcatattaactatggtctattttctacctaattaatcaagtatattatgtggagatttttcaaagaactctcatatgtgttaactctaccaacacatactaccttattttaccttcacaatcattttgtaaggcagatggagatctgctttttgaaataatgaaagaagccggcttgagaatcagatctagattctagtgactaccttatagcctcactttcaactttcaagtatgatgcttctaaaatgttcattgttttcattctacattaagacgaactatgaaactcagagattatttcttcaaggtcacatttttcattaggtctggcgctgaccttgtaatagcatgcatctctagaatttaaggacaacatacttgagatggctggataccaggaatgtttggaaatggatactagtaataatcaacacacaatggataagaatggtctttctaagtgataatttaagcaaccaatcttccccaaggagacaggtaacctgaggagtacagatctgaaaaataatctcctcagctatattgcctactgatgattgatgaacagttgaattatttgtaggaatctgtcagggttttaaatgtagtctaagggagagggagccaccatagtccttgtgggagatcctgccctaggatggagttgattgcataggctagaattgctggataacctgctcacagggaatatttaacacccttgctttgtttctttctttgcagtataaccttctgataccaatttggctttcaatgtagatcacgttattcagtc

SEQ ID NO: 39093 - DNA, 1031 bp, Homo sapiens
tcttattcttttaaagaaacatctccatactctttttgtttattcttatggtaagtggttttacaaagtgctgggtaggataatttccctgaaaatttccctggattttaatgacctgaagaattattccaaatttcttccagaacactaactggaagagcatgtggtctagcctggagtttccccactgtttttctggatgggtcacacctctagcctcagaaggccaccctggagaaaaaatgctttcctcctccctgccttccctacctgctaagctaagtttgaggtacttactgtgcttggcgtccactcacttcccacctctgatctcctgatgtgtttgctgctgcgttcatttccttgggggcaggcgctgcacagctctcccacaggtcttgacacctcctcccagtcctgcccactcctaactcttccactctccttagaatttgtcttctctttgtttcagatgctgtttaaattttgaagaataattctatgtgaatcctgtatgttccttttagacatatttgccttttataaaagcatacttcagatgcatttttataatggaaaagaaggaatggtggttatttctggttccataaaggtctgagcttttaaaaagtacctcaaatcactccctatagaccacagtgactgtacaacctgtttgcatcctctccccagcagcaattctctgtctttcacctccaacattgttgcaattacctcctttctttattctcttgttagaaatctgtgaaatgagattggcgggggatgaggggctatgaaaagttggagaagagtgtagttagtagaagctgactaaggaatattaacatctctgtgacattcccttactctagtgatcactcaaggatcagttttcctatttgtcacatgggcctagataaacagatgggtacaccattttgttctttcatgtttcagtagtttaggaaatttccacaaaggggattttttttaaagtaggtaagaaattatgggtttaagctactaat

SEQ ID NO: 39094 - DNA, 1091 bp, Homo sapiens
caccaagcatgacttgaagaaggcaccaaggatggggctagaaagctagttaaacttttagcctcaaatctggctgggtctgagagactgaggaagagaatcagaagatttcagctggcggagaagcagggcacagtgtgtggactgagcttgatggcatgatcagctgatgctgctaaagacctgagactcttaatcagcaactgtgcaatcagcaatagcagttgtacccaccttatctgctatggaggcattattattggcttttttggggggcatttaatgaaaatttcttgctttcaaggttattcttcaactatacatcacttgggcagtgctgagaaacacataggatgatttggcctgggctccatatccttcccaggaatatcttaagactgagaaatatggtctcttttccatacctccaagttgcttttacatggatgaagagaatcagaatgctcagtgaaatatgtattcaaaaagaaatgtaccagaataaaattacattagaaaataattgcttctaaaaatcatcacccattcttaccctctgttattctgttctctttcaactgtctgtattttaatccctttcttcttccctgatgttttctattcatttaatttaagcaatgtttctggataccatagcaatagcaatgaggtgttgtataaacgtacaatggagcagaatggaaatgcttcctatggtaacagaaaccatagaaacatgtgcgtgtgtgtgtgtgcatgtgcgtgcacacacacgtgcatacaaagctgttttggggtcaaagctttgtagagttcatgcaactaggaaaatgaagtgtttcactgtgatcacattgctatttgtatctattgtcatcatgatttaacatttattgcatgcctatagtcccctggacagaccctggaactagatgtcaactctacttagtggatttatgtttgaaattagatagcaaagccacaaaatggaaaaagatgagaatacttccaaaacagaaatattgaataatgcattttcagaaaaattaggtaaggagaaaatgagtttgacccaggcagttaggaatgaa

SEQ ID NO: 39095 - DNA, 1017 bp, Homo sapiens
gcagcatcagtgtcacccagaagcttgttagaaatggagaacttaggcccacctcacacctattgaatctgaatctgcagtttcaaaagatcctcaataatctgagcagattctgattcagttggtctagggtcttcacttctgacaaactcgcaggcaatgtcaatgctgttggtccatggatcgcactttaagggacttccccagttctttacaaaatgtgggttgcaacccaatagtgggtcatgaaatcaatatagtgagttgtaactagcacattcaaaaatattttaaaataggatagagtacacaaacaattcagagtgcatttcatgtcatgatgaaggcattgttgcatgaaacttgaatcagctttttgtacatctgcacacagacacaaacacagatgtatgtagactgagttctgatgaaaacgtatttcttaatacgggtcgcagctgataacagtttgaaagttattgttctagacaagcttatctaggccagaaagaagtcctcagaagtgattccagtctagaacagagagctcagatcaaaggggttctgttaatattagaactatccagaatcccagtgaggacatccaggaaaaagtagaacagtggggctagaaagatcctctactaggggtgacagctgtgtgctgattggatgatgagatgcccatgattagtggcttgtaccagttggcattaggtttttgcatgacccaagattttggactgtgagctccttgaaggtgggacctgtatgttactcctagaggctaaaacagtgcctttcccgcagggggagtttccgcagtgtactgtgactttttatatctttcatactactcaatataccacatgtaacaaatgaggtcttttctgtctttccactgggaatcatgtattattcatctttgcttttttctagggcctactccaatatctagagatggcagatattcagtaagtttattcacttaacaaatattttatttgttattcagca

SEQ ID NO: 39096 - DNA, 1015 bp, Homo sapiens
catgctgttcttgtgatagtgaataagtctcatgagatctgatcgttttataaaggggcgttcccctgcacatgctgtcttgcctgccatgtaagactttgctccccattcatcttctgccatgattgtgaggcctccctagccatgtggaactgggagcccattaaacctctttcctttataaattacccagtctcgggtatgtctttattagcagcatgagaacagactaatacaggctcagaaaataatacctccaaatgagagcctccacagcagccttagaagaaaaagtttttctctgaccttctcttgccctcctatctctcagtcccatttttcctcaaggctaggcatagaaaccagaatccttccccaaggaaggtcatagaaagcagaacctcttttcccaaaagccagccataaatcctgaaaatattatatgtaagaactgaccataaagaaattatctgacccacattgtttgattctaggacataagactgccatttcagagagggctgtgccccacaccagaaggaaggaatgcatgttcagagaagccaagaagaatctagactggctggccctgctgggcttccccactcattctcttagctttagatcttaccctttttgtccaggcatatttctacatgactgctcatactttgttgaatctaagcataaaaatggacaatttcccctatatctttgggttttaattatgaaggctctcatgtatacacattagataaatttatatgccatttcttttgttaatcagtctgcttcatatcagtgattttcagcaaacctctaggggccagagccctggttctcacattgagctggaatattgaaggaatttctgcagtgaaatcgtatttggctgtacatatataatctgtgaacctcttaaataattaaagcataacttactaataaagcaggaaagtttagtgggctccagaaccgaaaccagttggatttaaaatcctgctgctatacttaa

SEQ ID NO: 39097 - DNA, 1047 bp, Homo sapiens
gataattttgtctgtttttattctgattcttatatctgatttgttattgtcttggatagacaaggatggtgcagaagtgctggatagataatgatagtattttgcattattccttactttaagaaattacttctaatattttatccattaagtatggtacttattacatatttccactagtgacatttattaaaagggttttcttctatttctaatttcagaagattaaaaatgaggtattaaattttagtcaatacctttacattacttattttttgtcttttgtcttttaatatggagaattggtaggttctctagtattgaaccatccttgtattcctgggataagccctatttggtcctgatgtgtaattaaaaaaaaatccctgtatctgatttgctaatatgtaattcaaggtgtatatatcttcatttataaaagttatttgtccatgatttcctttcttgtgctttctcttgttttggtattagtgctatatttgcttggtaaaatggatcagataatttcttatctttgtctttactttgaaaagtttatataacacaagaattatgtgttttttaaggatgtgataaaattcacaagcaaaatcttgagttgggtgccatttcaagtatagtcttttctgttagcttaatgtattcagtggttactgatgtgcgtgttttaaaaattctttgagctgattttgatgatttttctagaaatttgaccattttagctaagtgttcatataggtatgctaaaatttccaccttaaaatggaagattcattattgctttctcacttgccaggggcagagaaattgttctacttgacaagttaattttagctttccaccaacaaaacaacctacagagtatttgtactatatgctgctttagtttttgtggtctctcagtgaagttagttattttgcaatcaaataattatgggaaattttgcttttaaaaaaatcaagtgacaatgtattttcataatgacaccttcgattccagaattcaggaatcatagaattaaaaaa

SEQ ID NO: 39098 - DNA, 1032 bp, Homo sapiens
ttaattcctcttttgctcaatagctatattaacagtgctgagagcagggagactcctgttatgtccccagctccatttctcagaaaatatctgaccttggtagttcccataaatgttctgagtctcaattttctaaactgtagaatgagaagaagtatctgttcaaataaaaggtccgtcttagagaaattttgtgactattaaatgagaaaataatatgcaataaactttgaaaattatagagtgctaaagatatataagccatttcctttaaaagaaaatattagttcaggcactaatgttgtatacactgtattttatctcaaaatcagaataaatagacattcaggaaaaaaaagttcttaatattttaacacatatttccttgtcatgtttcaccacatgtatccttggtcatttttctaagtccctgtgcaaataggactccaaaaaataatttttttctgagtattaacatttgttcttttacaaatataattgtgggtcactgaaaggcccttagcttcctatgaaacaactaagagtagcttgaatcttctcctagaagccatatatacataagggtatggagaatattgggagttttattttgaatgaagataaatggaaaattttaggttgaaagaaaaatgagattacttattaagatcaaataaaattaatattgttagaagttgttttttgaaagctaatacttatctaaaagaaaggtcccttgacagagtaaatttgcttgagctgcagattttctttttcttttatttttggataatttcatcagatttggaaaagaattaagaattgtctctgttattgtcatttagactttttctgaacaatagaactaatttaccaacacggaagaaacatgccaaatcactgaccatagcccttgaaaggaagggtttggtttttaaaaaaattaaattagatctataagtttgagaaatttcagcatgttttttataattctttattattgtgaaattggaaaaactcatgacattgctt

SEQ ID NO: 39099 - DNA, 1048 bp, Homo sapiens
aaaatcaaacatgatcagcacagttattactttttaaagccttttgagaaaaacatgtgtgttgaagaacaggatagtggacacaaaaataacttcagtctctaagtgggtagagaattgttttaacttgataatgtgtttgaaaagaagataagacagtggtttgggaagtcactgccctctgccctgtgtggaatccaaggattattagcattacaagaagaaattgcagatgatcattactaaatgaagagattactgggagacacatgcctcaggtcaaagaagacaatggggattaagagattacaactaatacagagatgatattaactgttttcccaaggttgaatacaaaggaaataagaacaactatttctcaggctggagtagggagtggtgctggagctgaggttgcttttaaatattctttctaaatttggccccaaattctttaggttagttgtattactcaggaagaaagattgaagccatgttgatttggatactgtgtcaaaactcagtcttgattcactgtgcttgctgtccttcctcagtcactgctgttgcaattcaagtcctgaagacagggtaggaatccaacctgaggcagttatgggagagactgtaaattcccacactggttttcagagacccggagtctaaacccatttttgaccagaagaatgtgatggaatttcttacacgctcagatacttcatctgcaaaattgagggaataatgctagattattttcacaattccagataattgctaaacatgtaggtacctctcaaagatccacagcattagaagcactgaaaatctatgcggttgttcaataatattatatcttggaaatatcattccaggatgaaagttcatgaatgttttcccttcaagaaggctataacatttatgacataatttatacagacattatttatacagttttggaataatttatttcattttaaaagggctaataactttttatttaaggataataaaatgaatttacatacaaaacacttaaacatttccctaa

SEQ ID NO: 39100 - DNA, 1063 bp, Homo sapiens
tgaaaaaatagtttggaatgaaagaaattggaaaaaagatataactttatagacaaaacttcaatcattgtattttttgatcattgactcgtgaggttatattttcagaaatattttatttggtcatcttagatgatctacaaagattacctattgtgaatatgtattataattttttaaaaatatacctgagtatattttatgccattcaaatcagaatttgtaccagagagctaaatattctgtataagtgataaataccttgtccaagccatagtaattattgccattagccaagtgaacctagtatcaccttcattcattacacagtctatcatgttctcagaaaggacgcaaggacaatttagcaaggatgtgtagtttatcatgtttatagccaggaggccaggaaaatttatgcagggaaaatttggcaaagaaaatttagtgttagagttataaacacagtaattcctaacatgttagtccttaaatggattactgtaaagaaggtagtaagtttaggtcagagctataacatatagaaacaagaatgattcatatacttttaagacagtattcaaatcaatgagttactatctatttttcttcaacaactgcttacgcatgtggcaatatgagcctaagacaggtgctgatgccttagtcacttggccacacagttttgtggtttacgagtcatgggaattgcttgtcttactctgactgctaaagttctgtcctattgtcttttcatgtaatagcaacatgactctgatgacaaagcccaactaattacacaacttaatttaatagtttaaagcgcaaagggcattccctgagcagtaaaatcttttgtttggaaattttaaaacaaattatattttactttatgttttatatttacgtaataagtatttacaagaacacaattttctcaagatttaaactgctcattgttccataaataggacacacatttagaaagaggatttttttttaaaggaatattttagtgattacttctggctaaaaacatgaaactcttttagtgcttgatgtt

SEQ ID NO: 39101 - DNA, 1050 bp, Homo sapiens
aaaaatcaaatccataaaaaatgggcaaaagatttgaacaagaacttcaaaaagaaaataactgaatgataaaaattaaacacataaaaatggattcaacatcatagtactcaagaaaatgcaattgaaaaccacaagataacattccatacccactagaatggctaaaataaacaatgtctggcaattttcaaagttagtaaggttatggagcaactggaatcagatcagtgctattgtgaaatgagtttcaatttctgttcatgttaaattctattcaaagtgatttgatttatgtgataaaattgtttctggaaaatgttattcatccatgcaattacccaacaattatgtatttatagttcataatgggtgaaacaaagttgttcgtaccttcaaagagcatgtagacaagtttgcaaattaaagccttgttaagtcagccactatatagttactgttgtttatcacattttcttgaatcccaaacacatgtattgtcttacaaccaatttcaaaataaatctgacaactgattgatcttcttaccaaggactttttattaaatcaatggtacattttacagttgaggaaatgcattaaatacatatagctattatattcaaatcagccagctgttctgtctggaggaagtacattttaaacatgaaaagaaaagggtaaaagcaatgactatctcctaattgaaaaaaaaatcataggaggttatagactctcattttatttattttgtggattgggagaagggttggttctaatttctgtcacagactgaaagcagagcctttaagggatttggcgaaggggttaagagttggactgtggggtcagacagacccctgtactgatcttttatttaccaagtacttcaatgacttaaatgcaggataattgcttaccctctgtgggcctcagtttccttctgtataatgatgccagacttaatgggcagtggtgaggttaaatgagtttcatttaaaaggtgttcaagacagtgcttcacatattgtaggtattcactaaattgca

SEQ ID NO: 39102 - DNA, 1600 bp, Homo sapiens
atccagaggctgataatctctttcctaacatatttttaacttaatcatataataggaacattttcccatgttgttaaatatccttgatcattacacattttaaaagctacatactatttcactttatgggaggttattagtgcaatttctgatggccagttcaatccataaaagatttctgtatattcctcagattccttatcttttattttcactacgtattatacattatatatctgcattgtacaaagcagacttgttcttcttcctttccttccacataaatcagctttgttatatcattgacaagatcatctaagagataggaatgcaataaggacacaaatatggaggttttcttattttggctttgttcctttgagtgtcatatcccaccacttttgtgcagctaaagctatcacaatcctgatccccagctgccctcagctctcccaaggtgaaagctgataaaatccaagaggcagtgagggaccaaaggaaaacatgaacacaaaggacatataccatctaacaaaaagacctctcataactagtagaccctttcttatccaggtgagaagaaataataaaagctccttatcagtcaacttgatctggagtggaaagaatgaatgtagtctttgaaacagcttaataaagtagaatggactcggtgggaacattttagacatagcttacattctactcttaacctttcaggacacagtcactgccctctgtcaattactgccatctctttactgacaagcctgatgggttataagtccaagaatcttccagatgcatgacaaaaaaataaatctctaacactggtgtggtacttctggtggcagaaacttagggtcagaaatggaggaaaccattgtagggaaaaaacaagcataagaactactgtctatcaaacaaatttgtcattgtgtttattcttgtatagaatatatataagagtgttttccttttttaaaggtaattttaaatgggtcttcatgaaagctaagagagtttgatttcttctgtctctctatttccatatcttattttcagataaatcttctgatggattcccacctgaacctgatcctaattccagaaacacaaagcctggattctttgtgttcactacatttattctgtctttccatgagctaaggctgtaaatcccacagtgaagcatgcataaacaccaactagacgggattagaccacactatttagttaatctcagtttacaaaagctcttctttctttgtctgaaaggctgccacagaaatccagcaaacgtgagaatgtcttgcactatgggtagtgagagggtaaaaataactgcttgccttcatgagccctctctctctttgagaaactctatgtatattttcagggtgaaggatttctactgtaaatgcttcaaatcatcatcatgggggagaagagcacagcagtatttccttccaaaatgtaagcagcacaaccttccaagaaccttgatgtgtagttaaaacgaccatgaagggagcctcccctgatctctgtcctccaatttattgctctctctcatgtttgaaaggtttgttttggatcc

SEQ ID NO: 39103 - DNA, 1024 bp, Homo sapiens
tatggaacacaatctttcatttgtatatcctgcatgctgcctgttttatcctacatactccatatgggaccattgccttccaagaactggacagcatttccacagatgtccctcctgtggattgatccggatcctatcaattacacaatggacacattaaattatagaataagcctgctgtcctgtttttgtgcaaatgatatttcacagagccctctatccttctccactcatccacttcttcaggcatttgacattgatggtttatatcttggttctgctcttcttattcctttttttcttttctgctcttctcctatattttttccttacattctctctttatttttattttcctctaaattatttgtctactccttcattctcctcattttctctaatatttatttttcacctgactcaattacttctttttggcctctgatcattaaaatccaattcagagtacttttatattcttcattgaattgtgtggaatgtatctgtggaaactgctagcctgttcaatggtgcgttattctactgtattaaattataattatgactgcttcacgttcccctgcaccattaatttaataccatatatgtctagtcttacttatttttatgtttgtattctccagagtccaccacggagaagatgccctatacgtgtatgtaaaatgctgaattaaataacattgtttaaccattttgccagccacagaaataaactaacttaaactcatatgtagccctggtacataatgcagtgtctggtatatagtaggtgctcaataaaggtctgtttaataataataataaatgtctgatggataaagtaaagataagcattatatacaaagcctggcttaacatattgttgccaacataaacatattttctgtgtttcttaggttgatgtacccatattttggagcaaactggtttacttgtaaagattattaagaactcaatgggttagtcagaatttcatccagtttctaaggcttgcatgtgcctc

SEQ ID NO: 39104 - DNA, 1066 bp, Homo sapiens
atggagctggtagaagacaaatcaggcaacaagatgatattgattttagtgggagagaataagactactggaagaccaacagagatgggagatgggtaggtgcagagagaagagcaggcagagaagcattgagatactagtttcacaccacaaagatctgggttgtcttaattctctttggcctttatttcaaatatttgagtttcccagctcttagtagccaaaatgtccctttttgtaaagccagtttgagttggttgtctactgattataactgaaagaggcctattaaatatccaatgcacatttctttagaacagtaaaatagagggatgcctcactgaggctgctatatctcatggccacgctgtagttagggtgtataaagtcaattgcaaacaagaaccagaattaatgaagaacaactgaaacatgtctctttttgccagcaagtgcattatgcatgtgacaccaaaaggctaaaaacataaaatataataatcatagttattgtcacaactttgactgaacatgaacattctcaagacaaaatgcacaaagtgaactcaagcttaaaactaaagacattgattaaagaaatagaaaaataaatctgcctggctcaaaaagtaaatgaggtcagcccatttaaaactgaacattaggaaaagaaaagcagcttagactaattttaatagaaacaaaggattgtttgtgagtaatgatttacccgcaaagaagaaaaaatattaaacgtgcattgaatagcaatgaaaaatgcatcagaacatttatctagggatctcaatcctaacaggaaggtatcaggaggaagcagcccatacttgggggtagatttctaaatcacctggagtgggagactgttcaaactacatgtgctcctcttactctctttttggagcttctcatatacgtttctaaaggggtattttttcctacctcaaatcctattcttaggagacaatctcagcaagagaatagcagttattgatattaactgctgatgatgtttaatatctgtagtggacatgatgtcattgtttgc

SEQ ID NO: 39105 - DNA, 1021 bp, Homo sapiens
ttttgattgcctgtgcttgtggggtattaagaaatctttgcctagtccaatgtcctggagccttttcccattttaaaaattagtttcatagtttgaggtcttagatttaagtcgttaatccattttgattttatttctgtatatggtgaaagataggggtctagtttcattcttctgcatatggatatccagttttcccagcactacttattaaaaacactgtcctattcccagtgtatgctattggcatctttgttgaaaatgagttcactgtagatgtgtggacttgtaccaggttctctattctgttccattggtctatgtttctgtttttacgccagcaccatgctattttgattaatatggctctgtagtataatttgaagtcaggtattgtgattactccagttttgttctttttgctcaggaatgctttgtctattctggatctcttgtgagtccatataaattttagggcttttctttttctattttgtgaacaatgtcattggtatttttataggaattgcattgaatctgtagcttgctttgagttgtatggatattttaacaatattgtttcttctaatccaagaacatagaatatctttcctttttttggtgtttgcttcaatttcttttatgaatactcacttctttggttaagttaattcctaggtatttaattttatttgttgctattgtaaatgggattacattcttgatttatttttcagattgtttgctgttgacatatagaaaggctattgatgtttgtatgttggttttgaatccttcaacttaattgaattttaaaaatcaattctaatagttttgttacagagtctttagttttttccaaatgtgcagaccttatcatctgcaaacaatgatactttgacttcttcctttccaatttggatgccctttatatctctctcctctctgactgctctagctaggacttccagtactatattgagaaacagtagtgacagtgggcatccttgtcctattccag

SEQ ID NO: 39106 - DNA, 1030 bp, Homo sapiens
cattaattgatttgtgcatgttcaacgatctttgcatctctgcgataaatcccacttgatcatgatggagtgatctttctaatgtgttgatttctgtttcctagtattttgttgaggatttttgcattaacattcatcagtgatattgacctgtagctttcttttttgatgtgtttttctagttttggtatcaaggtaatactggcctcatagaatatgtttggaagtattccctctttctctacttttcagaatagtttatgtagaattggtattagtttttctttaaatatctggtaaaatttagcaatgaagccatcaggtcttgggcttttctgttctggaagactttttattacagtctcaatcttgttgcttgttattaatctcttcaggttttggatttctttatggttaatactggtaggctgtatgtgtctagcactttattcatttcttctagtttttccaatttattggcacgtagttgctcatagtagccttaataatcctttgaatttctgtggtatcagttgtattgtctcccttttcatctctgatttaatttatttgagtcttctctctttttttcttagtctggctaagggattgttgattttgtttatcttttcaaaaaaccagcttgttgtttctttgatctttcatattgttttctttgtttccatttcatttattttcactctgatctttattatttcttttcttctactgattttgtgtttggtttgctcttgcttttctggttctttaaggagcacatttaggttgtttatttgaaggctttctacttttctgatatatgtgcttataggtatgagctttctcttagtactgcttttgccgtatcctaggttttggtatgtttggtttccattgtcatttgtttcaagaaatttctcaattttcttcttaatttcttaattaaccaatagtttccagaattcctcttgttattattttctggttttattccattgtggccagagagatgcttgatataatttcattt

SEQ ID NO: 39107 - DNA, 1053 bp, Homo sapiens
gtgtacttaccataatattaacagtgaggtttgtacctttaggtaatttatatttcctcattaatgtctttttatttcagattgaaaaacttcctttagcaactcttgcaggacaggtatggtgttgataaaatctcctaccttttgtttgtctggaagagtctttatttcttcttcatgtttgaaggctattttcactgggcatattactctaggacaaacacctctaggttgtttatttgaagtttttctatgtttttgatgtaggcacttatctgtaaactttctgtaaacctagctgtaaagtttcctcttagtactgcttttgctgcgtcataggttctggtatgttttgtttccattgtcatttgtttcaggaaatttttcaattttcttcttaatttcttcattgacccatagtttccagaattcttcctgttattgatttctagttttattccattgtgttcagagaagatttttccttcagcacttgaaatatgtcatgcctctctctcctggactgtaaggtttccactgaaagtctgctgccagacatattggtgctccattatatgctatttatttcttttctcttgccaccttgaagatccttttttcatccttgacctttgtgagtttaattattggatgttttgaggtagtcttttttgggttacttatgcttgttgttttataaccttcttgtacctgaatattgatatctatctctaggtttgtgaagttctctgttcttatccctctcaataaactttatacacctgtctctctctcttccccttttcatagtcaataactcttagatttctccttttgagactattttctagattctgtaggcatactttttttggtcttcttttcttttgtctcctctgacagtgtattttcaaatagcctatcaagcttactaattctcacttctgcttaatcaatcctgctgttaagagactctgatgcattctacaatatgtcagttgtgtttttcaactcccgaattgctgcttgattctttttaattatttaaatctc

SEQ ID NO: 39108 - DNA, 1048 bp, Homo sapiens
gaaaataaaacccaaaactagcatttatgttagagagtaagcaataagctatttacttatttgcttttaaccataggacaagaggaaaaagaatggaaaatttgaatgtgtttttattaatcatgtactggctaatattttaaataaactcgtaattttgactgataattttagaatttattttgccaaatatcaggaaatacttttttcaaaataaaaaaattcaggcaagaagctgtatagaccttgccaatcccaatatcaattacttaagaataccgtttgttacttattcaatgaatattttgtaaatattaatatttaaccaaaataatcatattcatattatctgctcacaatcttttctgtgctcgcattaaagaaaatttcttgcttttcaagtacagatgaattataataatttctatatggaaatgattatcatatggtgtttgttgcctattatagaaatgtaaatattatagtaatagaataatgctttttgggacaaaactctgaaactacagatagaaaaagaataaagtacaataaaacattaatattgaaggaattgtttgtgggcatgtgtgtatttgctgccagcatacttttaaaaattctgtattcctcattttaaaatatacatttttaatggactaggttgtaaggcagttgatatggtttggctgtgtccccacccaaatctcatcttgaattcctaggtgttgtgggagggacccagtaggaggtaatagaatcatgggggcaggtctcctgtgctgttctcatgacagtgaataagtctcatgaaatctaatggttctataaaggggagtttccctgcacaaactctttctttgcctgccaccatctatgtaagttcctccttgttcttccttgccttctgccatgattgtgaggcctcccagccatgtggaaatgcaagtctgttaaacgtctttcttttgtaaattgcccagtttgggtattctttattagcagcatgaaaatggactaatacaatagatattgatttttaattatttat

SEQ ID NO: 39109 - DNA, 1076 bp, Homo sapiens
ggtatgcgactttcaccattaactaagaaaccataggaatgacttttaaatatataaaatatattaaatatagtaaaatgttataaatgtttctgatttgagaaagcatgactttaaacattgataaaaatgactgtgctatattgtatatgtctacgttaaaactgtcttaacttctaatcatgagttaataccttaaggaataatacgtcctcattgtgagattcattgataagaattgtggctgtctattgttaaaaataatgaaggtaaatccatatttcaaatagtgttcttttaactaagatctttttctacatgactatgtgatctttctttcacatataatgtggctgataaaaaatgtataataggagctagcacattagctgtcttttatctggtgttttgcttgtgcttgagttagcattttttaatctgttgggttatttgcaagatttttaaaaatctacttgacattttttgagagcaaattcatttgaaaccagagaatctcttggttcttttaataggaccccccaaaacaaaatgtcagaatacagttgacccttgaacaatatgcatttaaactgcatggatccacttatacctgaatttttttaaatagatatattggaaaagtttttggagatttgtgataatttgaaaaaaacttgcagacaaaccatgtagcatttttagtattgaaaaaattaagaaaaagttatgtcgtaaatgcataaaatatatgtagatactagtctatacgttaattgactattattgttatttggctaaagcttccggtcaacagtaagccattggtagttaggttttgggggagtcaaaagttatttgcagattttcaaccgtgcagagggttggtgcctctaaccttacatccttcaagagtcaacagtacattggaaacaagcacatgagaaagtgtattgttgtagcccctgttatgttttgaaagtagctcctctcttaccttgggatactttgcccattacatgtggcagagggttctgatacagactgaacgagggggaatgtctacctatgcaacaaag

SEQ ID NO: 39110 - DNA, 1028 bp, Homo sapiens
caggaatgaatttccatccagatagttggatataaagagtataatgtttaaatttttatataatttagcttactacgtatttgtgttctctttatgttacaataggaaggaatatttatttccattaatttgggatttcctctccatatttccttagggaatgtatctaagatttctgagtggctgtgtagtaccacagcattgattggggaggggatacgtgtggtctctgtgtcatatttccatggagatatcatttgggatacccactttcctaattggtcttaggtaatccctctacatggtctgctgcagggatgtcctcagctccctgggcataattcctttggccatgagggctcttcctggcttctgcatcactcacaggaaatctttctgcttccatctaacatgctgacacattgacatctgtctgaggctatccatggtctcctaaacctttctaggtacttgacctcctagagatagagagagagagagagagagagagagagagactgattattgacttgtatgtcaataaacacctctcagaataagcatcaatagtttgtgtttcctagagcctttccgggaaaccagacactgtttgtttcagtgccctataaaactatgttagatccttgtatctcccttaagctctcctctgggaaacagggaaaaagactctctctctaggatccagggaggatttgctctccttaaaaattctttccgtctatctccatctcctctgctggaaaatctttatccaccccctagcagaagtcagattatcttaaatttaaaaagtgtcttggccaggcacggtggctcacatctataatcctagcactttgggaggctgaggtgggaggattgcttaagctcaggagtttgaaagcagcatgggcaacatggcgaaaccttgtctctacaaaaaatacaaaaaattagctgggcgtggtggcacatgcctgacatcctagctacttgggaggctgaggggggaggatcacctgagcctg

SEQ ID NO: 39111 - DNA, 1027 bp, Homo sapiens
aaaaaaagggccagaagaaaaaaagcataggtaaatatcacaaaaatatgattctaccacattttagtttccactttctacgtgagtttctgctatctgagcctttagaaaagaaagttaaggtcttttctatattttctaaaatgttcttagcattgaacaaaatagactcattcatctgagtgatgggtttctaagcatctcgtctctctcctctttctttttcatactacttccttcattaaaaaaaaaaatccccatcagtgtatgggagaaataaagtaacatacagctaaactaaaactcaaatcattagtatttttttataatataagcttaatatagatgaagatagattgctggcatggtttgctatattctgtgttatttttaaaactaaattatctgtgatttttctgagagttgtttgtaaacacacaggtcaataagtctcttctctctcttccccgcctttcacttttacctttcctagaagggcaaagatttcctactgtaagattgcatagaatctatggccagtatcaaaagttatgattgaaatgctcagacctaaagggcaactattacaagctttgcttccaagggaaatcagcttttgacagggtaatttaagccaaaacaaaggtcagactgtcagagatacacgtatccacttagggacggatggattctagacagatatattctagaatagaatccacaactctaatgtgttcatggctgaaatttttcagtttcgacactctgtctgactgagttttgttactaaattttttcaacatcctactccatacaggaactatcagtcaataacaggtgacacgcaaggtgcaatttatttgatatccttgactagtggttaaaaacgtgggttttggtatcagattgcctgggtttaagtcccaactctacagtttagagactgggcaaaacaatttggtcaagacgtttaactttttatgacttctcaaaaagttattttaaaaattatgtaaaatattcaatg

SEQ ID NO: 39112 - DNA, 2615 bp, Homo sapiens
attgatcatcctctgaaagacttgcttatgtaatttatccaacaaaaagaacaaaggaactcaagaaagaggtaaaaaatgagatcaatgaaacagagtacttaatatattgtgtattgtgattatgtagcagagtatctctgttttataggaaatataaactaaagtattcagaaatgatggaacaagaagtcagcaactttctctcaaattgttcaggaaaagatgctttgtattgtatcttcaccttttctgtaactgcatgattattttgaaataaagataatttaaaaaataaaatggagggaagaaattgtaaaagataacaagaaaaaaaaacaaagtcacctttcagtgagttccacacccttctatctgaaattccacccccgttctccattcctcagctcaccttcctaatatcaatcaacaatcgacttattattatatatttaatagtttatgtttcttgtcttttgcctctgactcaacaactggtataaacctttcatgaggaactctgttcactgctatatttcctgaacatggaacactgccaacacatactgacttcttgataaatatttgttgaatgaactgaaaaccttattattacaaacagtagcaataagtaaaatgtcactcttcacaaaatattattactaaaactgccactactcaatactgcttattattagagattaccacatttcactgcaatttttacatcgaaagaaatccagttaaacaccagttgtaagattattgtcccctgggatgttcttgaaattaagatgtcttttgtaatctatccaagggaaaagtattttaaatgccagttttcaattttaagagtattgagaaggtgatctgacacatcattctttttaatgaacaaggtataaatcaattttaagataagtaccaaaaaatttttaaaaagaaaaaataatgccagaatatcagttatgcagttggtctagaatgcaaattagaacagggagtatgagggctccaggaagaattttgtcaaggagaaaaataatttcctatcataaaacatatgattaagaagctacgtgaccttaatgacaaggtgaacccatagcattatgacaataaatgaagaaataaaaggattatgctgcccccacccctctattcattatttatgtgctctttccaacagcaagttaatgacaaggaaaccacctccactcagtgtccaatcacactacttgattctgcagggaactacatttaaataactataatattgtaaaagctggttttggatattttcttgttttttgtttgtgttaaactatagacaaagcagagttacttttagctataagaagacaagtgttataaaattgtgcataataaaatgtgagataatgcctaaaatggataagtcaagaaataaaggttatattttatttgaagacacagatgagcaaacaaaaacacttaataaataaaaatatgcctcttagagcctgggggtgtgaaagtgtggggatagggaggcgaaaaagcaatttaagtcagcaaaattcttcactcttcacaatagaggtagtagtgagatctagttttaactgataaataaatgaatgaagataaacatgatggatataaccaccaaaagaaacagaaatgtttgtaactgattatcagaaattaggagtatgattgagagcaaaggacagtttatttttaatctcgaatcctctcagtttggataggaaatgttaaattacatacgatgcacacagaaaaatgtcaggcacaatgagcactggctatgaacattggtttcccctacaagtggaagggagggatagtgagcaaaggactttgttacactcttcgttaaacaattttcaattacttttattttgcaatgagttattttgtttttgaataaaattatatacaatgatatgtatatgctattatagaataagaaggggaacaggcaacagacttcaatgctgcagtgaggctaaatcagataaagaaccaagatttcattggatttggtaatttggaggagacctaatgagtgtaattttcgtagagtgtagagacagaagtagaattgcaggggaactctctcctcaatgagaagtgaaaaggagtaggggcagcaggtatgaatataagctaatttaaagaagttttgatgaacaaggaaacagagagcatgtggaagctaaatagctgatatttaaagattatggttacctaaagatcacttagattgtaaaacagggtgtgtcatatcttataaatgaaaggatcatgatatacaaagagcattgaatggtcatctaaaggttttccaagaaaagataatatctgtatctttgttctccttttcattttggatgaggcaagcatcaaaaacattttcttggaggcttattttacaattttaaggctcttcctatctccctcccctcagcccaccctttcagaaatgccttttgtagacactcactacagaggcttctgaatctattaagacataattatgtttctatatggtaaatgtttgaggcatacttgactatatccttctacccatacatatttctaaaaatgca

SEQ ID NO: 39113 - DNA, 1775 bp, Homo sapiens
aaggaatgcttggttaaggaaatagccttcaggaactctcagataggtatggttaagtgctagcagtggtataggaaaatactgagtcaacattgtacatttctaaggagagctagtgagcagttatacaagaaagttatacttgttatcagttttcaacctccttccactgcagagtttataaagattaacaagaatttagcaactatttattgaacacttactgtgtaccaagcactgtgccatgtgctggagattacaaatagaataaaatgtggctcctacatcgtgagtctcatgaggggcttatttgctatattgtggattctgcagatcatagaatgtgtaaaatcggttggccccaacatagttaacaatttaaggacatcacttctttcttttctcataatgtgtgaaacttacaaggtgagagttttttttctccctcatcgctatgttttatttctccttttctttggtgtcatgctggcttttatcaaattattaagaaccactgtttgaacttgcaattatgacactgttaaatgccattagctcatcttgtttttaactacctaaaccaataaatctgacatagtctgtggatctaggaacttgtaaaatctctttatttctatggatttgaaattcaaaaaacataaaaaaaaacacctttctaaatgtctttgcatttgccttctagttccctagcaactgtgaggtagacagatggcaggatggcctcagtttggggccatgttcatatgatcataaatcaattattttttaaaaataaaaaatatttcttgagagctatacctagtgatagaaactaaaggatgcttttttcttctttgtatataaccttaatgcttttctgtaggtgttctgattacttcccaaatagccactaatatgtctatatttttgttctaaattctttgtctgatatactgactttagttaagagaaaataaaagtaataaggatagataattttctttcatcaataatatctataccttttttctgagaatcgctatagctagaattgaaagcaaatatcacaggctctctttagcacttcgaatggtaactgataacatgacttaatttgtatcttattctctgtctctgtctctctttttcctcttcatctcagagaccatctggcaggaaatattgttaaattgccacatcctcatgttatttatagtaaagctctaacctgtagtcatctggcttggtatttgataagtaaattccaattttgagacttccaggaaaaaaataaccaatttctctaataaaaattttacctcttacatatcaaatgctcttgctttcatatcattgccttttatggacttaagttaaatctatcttgaaacccagccatgaaatgtcagcaatgattttaaattctggacaatgtctgactttccctttcctgatgcaatgacccttgggctcctggactaattttactggtggaagaatttttggggaagggatgttaaaaaaatgaggaaggaaaataattaggtaatatttcaaaataatatactactacataaacccatgccttataatgttgggatagaaagtagaatataatattactctatataaaggaatcttggggcctctgtattagttatctaatgctgtgtgacaagtcagcccaaaacttagaggctaaaagaactgaacatttattatcttttatggttcctgtgagtcgaatttgggagtagcttggctgggcagttctg

SEQ ID NO: 39114 - DNA, 1045 bp, Homo sapiens
tcattgttaagtattaaatgatttaatgtacatgtgatataatgatataatgaaaggatgtaggtatgatgagcctggcacattgcaggactctgtaagtattaatttcattttcattttaatctttactactgcctgtaattttaggatttatgactctggtccaatatgggccacccacctgaaggccttctagtcaatctctcatagtctttgtacactgacaggtggaagctattagggccaaattatatgcttgaaaatgaataagtttatgcttattgtccctaattaatttcttcttccattaaattattataatgcttaggattaattaatttactctgctaaatttaccatagtgaaagaattctgtgattgctaccacaggaaagctctctagtgaggttagaagatggttaggcagttttgtttgcttaagaaaaatgagcaagaaaattttgcataatgccttttggagcagtcttattcttcataattgcctgagatatttcaaggtgctttgctataaatctgaagacttaaaaacattgttttacagtctggcccactaagaataatgacctctcctgttccttgtttttctgggtgattaagggtttcctgactggccccaggccatctgccatgactatttttttttcttcagatttagaaccataatgtcaaaaataatctcttactctgagagattttgctagccccagaagatagaaagtgtttgctgcgtgtgctccaacaccacatgaaaaattgtgcaaatgatggttcttgttgattttataaagcagtcccatcatttatgctccttaaactaaattaggtgtaaattatttcaaggaggctaaagttcttccctgtgttcctatgaggataatttcacaaatacacagcacgtcccttcaaccacagattttgggcagagagaaggaaacaagaagaaggagaagaagagagctatcgcctggggccagtgcacactctccacagggggtttccagcatgtgggtgatttctaaccaag

SEQ ID NO: 39115 - DNA, 1073 bp, Homo sapiens
tctattttatcatcatcattttcagcagcatcatagctctgtggtcattattcctatgcttcttatatattcaattatatattcatgttccaggctcatgaatcagtgcaattgattaaatagcaagaagttgctatctaactgcagtattggtttacaagatctgtgcagtgtcacagcttggggtgttggtgttacatattgcctcaataccagtagctttaaccactcctttatattgtccctacttactactctaaatattatgttctcaaatgagctcgttatcagggcagacattcaacacatgttcttgacaaaagtttgaaaccatttatgtttttcataactgcttagaacagataagggtaactagtaagaattacacggtaaccttcatgtaactagtaggtaagactgaattcacggagaccatcccataatatccctttttctgaggaagtaaaaagccccatgacttttcagaaaaattgtgaaagtggaaatggcagcttttgaagctccaatagaagaatcataaaacttcagagttagaagggcggaaactcatgttagaatctggaggcaatttgtgtaggcacttttagtctatcttgtgggaacattgtgtgtaaataagacctcccctagcaatttccattactgagaataatttcaacaaaatcagtgacaatggtctcttaatataggttttgtgtgtgtgtgtgttatggaaaatgaatgcagaatttgggaaaatttttatattgtcaacacatagagatttactaactaaagttggttgtcattcttttatgtattttgataaaatataactttaggtagagttcaagcagggagaggaaaatacttatattcctcacaaaactatataaatagaaagtaatgatgtgatcccaggtaattaatatcttttgatatctcaatttacctattgacagttaaataataaagtgtcaggactatagtttacattgttcatttaaacatttattcaatatttgcttgtcaaatatttgttaagttccctctttggaaaagatactggatta

SEQ ID NO: 39116 - DNA, 1035 bp, Homo sapiens
ctgttttgcttagtgtagccttgtagagaagcaagagcaaacaaattcaaaagctagcagaagacaagaaataactaagatcagagcagaactgaaggagacagagacatgaaacccttcaaaaaaagcaatgaacccaggagctggttttttgaaaagattaacgaagtagatagaccacaagacaggctaataaagaaaaaaagagagaagaatcaaatagacacagtaaaaatgataaaggggatatcaccactgatctcacagaaatacaaactaccatccgagaatactataaacacctctatgcaaataaactagaaaatctagaagaaatggataaattcctggacacatacactctcccaagaataaaccaggaagaagttgaatcactgaattgaccaataacaagttctgaaattgaggcagttatagcctaccaaccaaaaaaagcccaggaccagacggattcacagccgaattctaccagaggtacaaagacgagctggtaccattccttctgaactattccaaacaatagaaaaagagggactcctccctaactcattttatgaggccagcgtcatcctgattccaaaatctggcagacacaacaacaataaaaaagaaaatttcaggccaatatccctgatgaacatcgatgtgaaaatcctcaataaaatactggccaaatgaatccagcagcacatcaaaaagcttatccaccacgatcaagttggcttcatccctgggatgtaaggctggttcaacataggcaaattaataaacataatccatcatataaacagaaccaatgacaaaaaccacatgattatttcaatagatgcagaaaaggccttcgataaaattcaacaccctttcacgctaaaaactctcaataaactaggtattgatggaacatatctcaaaataataagagctatttataacaaacccacagccaatatcatactgaatgggcaaaagctggaagcattccctttgataaccggcacaagacaaggatgcctt

SEQ ID NO: 39117 - DNA, 1030 bp, Homo sapiens
tcatcagtactgtttttcatttgggtggacctcctcagctgtgatggtgttggaaaaaagcatctgtagttgtgcaatcatcaactgaaagctgctctgtttccacgtaactatatgtctttttgagaccaaatgggagatgcttaatgttaataaataagcagtttctgcataaataaagaccaggccctgaaatatatagacttgattattttttttctgtcccaagtcaaatggattcataaaacaagcgataaagctgtgaattatacacttagttacaaatgcattcagaataaatgtggtttctatttgtaaatacaaatactatagtgctatgggactcaaccttaatccattacagtagagaaaaatacaaatatatgacccttgtgcataaaacacattggtaccaaagtactatagcaatggataacacatttgtttttgtttttaacgccaaaaatgtggttcaaagtcctggaagacgtggtcaactcacctcttttttggccttctgcttaaccctgcaacctttaatattcaatgtgaccaaataggtacatcacatggtgattttcatacaagctgcatatatttgcatgcttttaagaatgcggcctcaaggccgggcatggtggctcacgcctgtaatcccagcactttgggagactgagggaggcagatcacctgaggtcaggagttcgagatcagcctggccaacatggcaaaaccctgtctctactaaaaatacaaaaattagccaggtgtggtggtgagcacctgtagtcccagctacttgggagactgaggcaggagaattgcttgaactcgggcgacggaggttgcagtgggccaggatggtgccactgcactgcagcctgggcgacggagcaaggcaccctctcaaaaaacaacaacaacagaaaaaaacacaaaaaatggcctttaaaaaagtagtggtgctatctttttttaaaaagaaaatgttttatacttctatgaatgcagaaactgaggacttttacaa

SEQ ID NO: 39118 - DNA, 1035 bp, Homo sapiens
tatctgcagtgagttttgacagacaaaatttatcagacaaggaagttctcttctattcctagtttgctagtagttttcttaagttataaatgtgtaacaaattttatcaaaactgttctaattctattgaaatattggtttttatcttttaatgtgttattgtggtgaatcatactaatagcttttccaaagttaatcatccttgcattcctgggttaaatgtatttcttaatatattactgatttatctttttgctaagatttttatttataatttttatctagtttataagtaaaaccctataatatttcttccttcaattgtctttatgtagtttttatgtgaatgttatatttataaaaaatttcaagaacttctctttcatcttactcctcttaagatctctcctctttttcacatttctgcaattcttctatgatgcctatgttgtaaattaatttctttttcctgcttgtactttaggaatctgagattttatatcttctgttgaccctggaaaattctaaaccacttaaaaaagtattgcctctcctttgttctttctgttctttccatttggaactcagcttcagttcatgttggacattctaattctatccccaacttctcttaatttctttttagtagtttccatgcttttattctctgttccaagttctagataatttccctaagtctatttttaatttaataattctgcctttggattttatgtatttgattattttaagatatcaatttttcttgcataaggtacaataacagtattgcatcattcagtttcctggttttgaccattgtattatggttatgtaagttgtgaacattatgggaaatggggtaaaagatatgcataaactccctacattatttttgtaatttttctggaagtcaaaaattatcttaaaataaagaaatgctgattttttcaattctccttcagatattttgttctgttatctcatactcgtgagcataatgttgctatgtgtactttctcactttggctaatt

SEQ ID NO: 39119 - DNA, 1047 bp, Homo sapiens
acacatatgttgtaaaatgatcagtttgggatgtatagcatgagcatcacctcatgaatttatcctttttttgtgatgaggacattcaaaagcttctcttttagctatttcatagtataaaatatttcactgttagccatcatcaccctactatacaatagaacaccagaagtgattcttcctatttaattataactttataccttttgaccaatctcttcccgtccgcctttctcctctctctcccttctccctggtctctggtaaacactgttctactctctgtttctgtgatatcaactactcttcttttttttttaagattccacatatgatattatgtggtatttgtttttccttctgtgtctggcttatttcatttaatgttatgtcctccaggaccatccatgttgtcacaaatgataggatttcattctttttatggctgaataatattccattgtgaatatatatcatatattttttatccttttattcattattggacacttagctggattccacaccttagctattgtaaaaactgctgtaataaacatgggaatgcagatatttctttgacttattgatttcatttcctttggctatatacccagtagtgggattgctggttcataaggtagttatatttttagcttttaagggagcttccataccatttacatagtgcttttactaacgtacaatcccacaaacagtatgtaagtgttcccttttcacagatcatcatcaccaacaaccttgttcttttctctttttgataatggccattctaactggattgaggtagtatctcatgtagttttgatttgcatttctctcatgattagtgatggtgagcattttttcatttacctgttggctatttgaatatcttcttttcagaaagacctattaaggtgttttgcccatttaaaaaattgggttatttggtgggttttgttttgtgttgctgttagttgtttaagttcctgatatattttgatattacctcttgttggatctacagtttggaaatattttctc

SEQ ID NO: 39120 - DNA, 1016 bp, Homo sapiens
tgtcattttgtttttatcagtgttttgaacattgtgacatatttggcaggctttcttggaattaagattctaaattaggtatttttgacctaaaattgactttgggatctttccagttgggcccttcaagggcctcaaaggatgtatctcttattttgtagagatattaaatgagtaggcttatttggtaaattacatgagaaatacttcaaatgacaggtgctactggattttctttcatttatgtttatgaatatgttattaatatgaatgtttcaaaattcaaatagttccaaaattatattttagaaatctagtatgtcatcagccataattccagttattatgttgcatgccaaaaaaatgaccacattttcttatcaatttctggttatggtaaacttccatcagatttttaaccataattattctaagcttttgtaatctatagttaatgttttgaattttttctaaagagacctgcaactggattcatggaaaagactctaacaactactgttaaatacaggtttcaaaaaactttaagataaatggactaaataagaagtttccagaagtctcataaagaaactggggggcagccaagatggccaaataggaacagctccggtctacagctcccagcatgagccatgcagaagacgagtgatttctgcatttccatcttaggtaccgggttcatctcactagggagtgccagagagtgggcgcaggacagtgggtgcagtgcaccgtgcgtgagctgaaggagggcgaggcattgcctcactcgggaagcgcaaggggtcagggagttccctttcctagtcaaacaaaggggtgacagacagcacctggaaaattgggtcactcccaccctaatactgcgcttttccaacgggcttaaaaaacggcacaccaggggattatatcccgcacctggctcggagggtcctacacccacggagtctcgctgattgctagcacagcagtctgggatcaaactgcaaggcagc

SEQ ID NO: 39121 - DNA, 1031 bp, Homo sapiens
cacagtataatgtaaataattggaattgggatgctttacctcagagttcttgtgagaatcaatgaagatagtgcatcaaaaatgtaccaaaagaatatccacctttcatagattgttcatattgtttaaattcccaaacctccgttttctccacatatcactagaacattattaaacacctatataacaatctattaaagatttctgcattatataaagcattaaaacaccacattactagttatttaacatttagtgaactgtgggagagtgtgcagtacacaagatagtgaatgttaagtattgtgtataaattgttcttcttactgcaaagatcacttgccaccatgtaaataacaaaataaatcatggtaaagacactatctaattggatctaagttggtagtgccctcaggtacctggcagaagcaaaggatggggaagatatgtgcaataatataaataagagtactacatatgattcttgagtggagattgagatacgactttagctcacttcacattttcttctgcttggattacatgtactttaacttttttccaaggaatgttcttgtagattagggcttttgttggtttggatggtgattttgagtaaaatacttaacaaagtgttattttatatgacatatcagagcttgtttatacatatatgtaatccgataatgttgatatatatattatctgaagatgagtacatatgttttgcttatatgtagagcttgtttctgtaaaaatgtacaagaaggtgtcagctatggttgactgggggatgagatggggaatatacttatttttgatagtttactacccttttgtaaactttgttgttttatattcttattttaaaataattatagactcaaaaggtgcaaaaatagtacacggtttccgtgtatcctttacccagctttccacaatgctgatatcttacataactatatttttttaatagactttaaaatttttcagtctgcttatattacctattttaaataattttttaaaaa

SEQ ID NO: 39122 - DNA, 1068 bp, Homo sapiens
ggacagagaagtactagtctagatacagatttatttgatggtcttgtggaagcctagaaatgtgcatgtcttggcattttctagggcctttaaattatcttgcaattataaacattccaacaaatttctacactattaaagtcaatgtaaatatttttctgtgggaaaaacaaggcttaagatattgaagaatatacacgtgttttttacatttaggatttttattaataaactgtaggtttatttacttaaaatagtagataagtttttttttaaaaaaagagatattctgactaataccgtcagtctttttacaactaaaaatctcctttttttatttgtgccacagactattattttgaaaataatctacttaacaggttgttcagcataagatgactagttttagtctcaaatgattataattccagtccaactataagaaatttaatgttgcagtggatttgtcctagtttatagttgtgaaatgtctgatttataatagactttttgagtctaatatagactcaagaatattgtttaactctttaattggtattgtttaactcctaatttagataactaaattgtctaaaaatttcaaattcgaaaccattaatctggacacttttggtttacaatagaagaaattaacatctagaggtaactaataaaggcaggtttttagaatctaggcatgtttcatattcattgagataagactgtttttagagaaatctaagactataagacaaaagattccctaatcacctggaaggtgatttccaatttggaaaattgggttttataaattcagtcttgcatattatgcacccaggactatttaactttttgttaaggaatgatgttttatttttcatagatataatatgaatcttatttttttccctcttacaggtaattctaaagaagagcagaggttagaagtcaaagaacatattcttgaaagttatgatgcattcttttgggtggtaacagatcataaagacattttttacacatcagttaatatgggattattaaatattggctataagtgatgtgtgt

SEQ ID NO: 39123 - DNA, 1105 bp, Homo sapiens
agttgagggtaaacactgatgaattacgattttgatttaaaccgtaatctagaggacttccattagtttgggatgttaagatatgttatgagaatcccaaatatagcagcttaggtaaaatggggaagtgggtgatttaggttttctgtggtggcttaactatttcatcaggctactgggctctttctgtttctcagtctttctgtgaaggcctttcttcgtctttgtgcctatccctctagttgaaagataactattgcatatccaggtatcacctttatgttccgcactgggggaataaaatgagaaacaggaaaaggcagtgcctgcatcaggaaggaaaaagctttttatcttattgacttgtatgtgtcatagaccaccattagctgcattggagtctggagagagtgaggtttgttttattttggttttggctgagcacagtaaaggttctgtaattaagggaaggagaagcagacaccgggtaggcacttctgagaaaaagttgttctgtagaacccattgattcttcaaaaatattaaactataaaattaaaaactttaatgtattggattggagtacttttagttgtttggatactgtattaggacttttttttttttcagtaggcttttggggaacaggtggtgtttggttacatgaataaattctttagtggtgatgtgagagattttagtgcacccatcacccgagcagtgtacaccatacccaatgtgtagttttttttttttgagttggagtctcactctgttgcccaggctggagtgcagtggcgcaatctcagctcactgcaagctccgcctcccgggttcacgccattctccttcctcagcctcccgagtagctgagactacaggcgcctgccaccatgcctggctaattttttgtgttttttggtagagacgggatttcactgtgttagccaggatggtctcaatctcctgatctcgtgatccacgtgactcgcctcccaaagtcccaatgtgtagtcttttatccctcaccctcctcccaccctttccctcaagtgcctagtccattgtattattcttatgtctttgtgtcctcatagcttagctc

SEQ ID NO: 39124 - DNA, 1034 bp, Homo sapiens
ttttatatttcacataattgagatcatgtgatacttgtctttctatggagtttttccctacattctaggagttttacagtttaagtttttaatccattttgaattgatttttgtatatggtgtgagataagggtctaatttcattctgcatgtggatatccatttgtccaaaaaccatttattgaagaaactgtccttttcccattatatgtatacttgaaagctttgtcaaatatcaattgaccataaatgcatagatttgtttataggctctctattttgttccactagtctatgtgtctgtttttacaccaatataatgctatattgattactatagttttgtagtatatctaaaagtcaggtggtgtgatgcctctgtttttgttctttttgatcaaggctgctttggatactttgggatcttttgtggttctatacaaattttaagtttgttttcttctatttctgtgaaaaatgtcattggtattctgatagggattgcactgaatctgtgatagctctgagtagtattaccacttaaaaaatattaattcttccaatccatgaacacaggatatctttccattccaggacttgttttaaaagtgttgtaactagtgccgtgtctttggtaaaaccttgctcaataattgctatgccatgtcccaagcattgttcttataaaatgaaggaattattttatttcatattatatttttacagacaaaacaataagaacttagtcccctaaatgctgaatattaattatatagtgcacattgttataagtttctgtaacacatttaatttgtttggttttattttgtgagtgacaatgactgcttaaactctactatggattgatcaaagatagtgaaacgtgatgtttacaattctccctcaatcaacatcagacttttggtaaaatacataaaactgaattatttctttcataaaattagattcaacttatacagtttgaatttagaaatcctttacaggggacatgactgattatatgtaaacattaa

SEQ ID NO: 39125 - DNA, 1072 bp, Homo sapiens
gagaagtaacaataattaatatcagaactccattgtataaaataacaatccattttgtgcctttctatttaagtttaaagttacagattttttaaagaaatgcacttaaaggcacaaagacaatacataatacctcacaggcatatttacatatggaatataaatagaaaaacattactggtccaagttaatgctggggaggaattttcttccttgggctttatgtttttaagtctaaggacctccagaggtcaactgcttgcttttctctccccacccactcatttctcctaaagggaacaggagttcattatctgattgatttgagaagaaagagttttcctttgtctgcttagcctctccctttgttttctttgcaggtctcagaaagaatgcccatgtgctgtccttcacatggtaagtttggtggagcatgttctgttgtcagaagttcaaatcaggggagagctagcaagccaactggcaaggtgcaaggcaggtcactttttcatctgctgtctaacttctttgtcttccacttggttctcaactcagctggggaagaggaggtttcttcctgggccccttcagaacctggtagttaaaaaaaaagttacctgctattcagcaacatgagcctgatagtttagtatctgcagagggttagaattttttccacattccatcacattaacaccagaaggacatgagatcaccttctttattaaaactaacaaagaaatggacaaaaccagcattcacctctacgtaaaggaaataagagataacatgatcagggcaaagtcttcaattctgtttgtaatgtttacttgattaagctcaatgttgcataagttaatgttgattatgttattcctaatatattttcacttgtctgacatatggtttaacaggttttttaaaaagatgaggtgtaactgaacttttaatatggaatgctgttacagaaggggaaaattggagaaggactttaaattttttaaagctcaacatttctgctcccaagattttctgaaaggaagatttctgaatctatattatagcaaaccgc

SEQ ID NO: 39126 - DNA, 1030 bp, Homo sapiens
gaacaacctgttcctgaaagactcctggttaaattatgaaattaaggcagaaatcaaaaagttctttgaaactaataagaacaaagagaaaacataccagaatctctgggacacagctaaagcagtgttaagaggaaaatttatagcactaaatgcccatatcacaaagctagaaagatctcaaattgacaacctaaaatcacaactaaaagaactagagaaccaagagtaaataaaccccaaagttagcagaagacaagaaataaccaagatcagagcagaagtgaaggagatagacacaaaaataccctcaaaaatcaactaatccaggagtttgttttttgaaaaaattaataaaatagacagactactagctagactaataaagaataaaaaatagaagaatcaaatagacacaatcagaaatgataagggggataataccgctgatccaatagaaatacaaaaatccataaaagaatactataaacacctctatgcatataaactagaaaatctagaagaaatggataaattcctggacatatccaccctcccaagactgaaccaggaagaaattgaatccctgaataaaccaaaaatgagttctaaaactgaggcagtaatgaatagcctaccaaccaaaaaaagtccaaccagattgaattatagcttatttctaccagaggtacaaagagaaactggtgccttttctactgaaccttttccaagcaactggaaaggagagactcctccctaacttattttatgaggccagcatcatcctgatacaaaaaccttgcagagatacaacaacaaaaaagaaaacttcaggccagtatccctgatgaacatcgacacaaaaatcctctataaaatactggcaaatcaaatccagcaccacatcaaaaagcttcctccacaatcgagttggctttatcctcaggatgcaaggttggttgaacatacacaaatcaataaatgtaattcattacataaatagaactaaagacagaaaccgcatgattat

SEQ ID NO: 39127 - DNA, 1722 bp, Homo sapiens
ccaaaacgatattttgagtcaaaagaagaaaaggatattaaatcttttgttttcacaatatcgatctttttaaagaatattattttatatgttaaccatatactaccaggaaacatctaacagcactgacagttgggaattcgaatgcgtatttttctcccgtgttagtaatagaaggtactgagccttttccattctcttggttgccttgtgcctgaggaatctgaatttgtgaaacaacatctttgtggatatagaaactaatttatgtaacacttggctacaaccacctgtgcttacttacggactatctttagttttcatggcgtgttaccttttgggttaattcaaatccaaaatgttgttaacggactgctaattaaagcatttagaacttagaattacagaattatagagtaggatgagataacaaaagactgggggttatgacttgaccaaggtcacacagataatttgccaaagagctttcttatttatgaaatggttgctggctaagaaacatctgtgtgtgatatgattaaaagacaatattcgttcacttttacatctcatgttttgaaataaaatgcaaagctcacttttttgttgttttgagaaaaattaaagggtttaatgggctagtataaagattgtgaaggcagtaagtagactgccacatagtaacgtcttaaagggaaataattctttaaagtatcagaccccatttagttgaaatgagttttgtctgaagtttccaagtatgacctatgctttttcttagctaatttttagcaggagatgatgagggctaaaaattgagacattagggcatttagttacatctctcaatttgtgactggtttataaaaaatactaagatgtgtctgctaactcacacctgatttatctactccttttatgtatatataattttttttgagttgtgtaccaaaagttggaacatttcaagtattttttctttctgtcactgagtgatttcatgtagaacatttactgttttgtgtattttgaataaatggcaaaaatcttattaaacattagctgttaataattagaaaaatacagtaagtcttcaaatatttataattgatatttgtctttgtttttatatgtatttatattgatgttatatgctcatctttttctttgattaaagataatcgcttgcttgaatctattacctgaaaaaaactcttgactttgatcttgtgactgacttgaaaagtgggagtatgagtattttgagttgttacaaattataaatggtacaatattacttcatttttagttgtatttatttttcacttatttgaatgggtcaagatttaaattcattgataatccctaaacccctttgtgtatttttaagttttacctgtcactgtttttttcctccagaattgttaggggcaaagtatctaatttggttttagactttttcttttttttatgttaccttcttcatacatcatcatattaagtttggtgtaaaatttacaggtcattcattccagtaggaattatgtatgtttgagttatttatgtttggcaaattaattctggcctgtagttgaaatcatactgttctgttttacatccccctattggttaaaataaaagcatcccttctcctccaactttaaaaaaactttggtttcaaataatgtgggagttttctgagggcttcttcacatgattgtt

SEQ ID NO: 39128 - DNA, 1034 bp, Homo sapiens
ttatacagctatgattcatactgcatctttacatttgtttaaatttcttgtaccacctcaagtggcaccatatgtgtctgtgtttactaagttttgatacactttaacttcttataatttctctatattttataatactaaatgataaaatagactatatatgttttatgcattcataatatacctaattttttcttttcctttttttgatgtttcaagactacatgattcatctgcaagttttttcaaattgtcacaaatctccaaaaaaatttccaacatatttattgaaaaaactgtatgtatataagtcaacttgttcatttccaacctgtgttgttgaaaggtcagctgtatgaggttatcgtcaaagatctttaaagaaagaaatgacatcatcaatattttgaaaattagagaaagccatttctaaaggaatcctagaaatgacttcaggccagaattagaaaaaaaaaaattgaagaaataggctaaataaatatgtctttggctgtgttcttttgaaaatggcattaatgtatagaaagatactcgaatgtgagttatggtcactgatacattcttttgtttactgctgaacataactggactagaggagtgtaatgagggcaaggatgttctttctgttgaaggagaaagtttatattgatggaaagtcattattcatagatactttgctgttatttcagtactattaagtaaatagttctctgctcctgggtttgtgtgtgtgtgtgttttctttataaggggctttttcaaataattttgctattgataagttacttgaatttaatcattagtcttcaaataaggaaagcagaatgagagaatgcatctccttgaattaaccagatttttttttagtacctttgttctagtggatatgtagcaaagcttttactttaatatttgtggctatagctttatttcagctatgtgaaatagttttataggaaagatcacagcttatttgggtgttcaaatatgggttctttagaggatttttttgt

SEQ ID NO: 39129 - DNA, 1995 bp, Homo sapiens
aaactctgatttgcaggtaaggaaatttagactaatggtttaactgagtgcctaagagcacataattaataaaggactctaaaactcagatttttagatttcttgtctagcattcatttcactgtataatagctgccatgattcaaggtatccttttcccctcactggatgcagcttttcattatatagttcttcagtgtgtttctccagggctgatctgttaagtgcactgatggaatttttatacattcccaaggtatgtacaagtagatgcttacaaaaaattttcatcggttggagagtttttcctctactttcatcttcatatccccattgtctagtatgtggcttgcatataatgcacatcataggtggttagtgttttcataattgttaaattaagatattgcaagaattaaaacatgactttaatattatatgtattttttcttaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaat

SEQ ID NO: 39130 - DNA, 1028 bp, Homo sapiens
ttttaaacactgctctttggttataagctaagaattattattggaattgacagcaataatttttaagccaaaagtgtatattttagctaaatgttccagattacgcagtaaatacccaagtgagtaattggcaagaaatgaggtaaatgagttcagatattcaaatgattaaaagtaagtctgcatattaatagtagccttcaaagtaattctgatgttcatatttaatatcatttaacatttatacatattagtcactggagctttacttggagtacatccacacgaaaaaccaattatttattaaattttcctttcttagcaatagcctctaaatttgcaggcccaccccaaactgttcctaaaagatctctttcgttctgtaatgcttcctccaaatatagctctctgcctgaacaaacagattttttcaaagctctaattacttccggtggcccttggatgaattgctttagccattcttgtgcctcttctagagatttagtttcatctgaagactgcaagacctcttcaaccattcctatgtttagagcattttttgaatccagtttaagggccccactcaacactttgagagcttgtctacttccgattatttcaactagccgggtggtgccaccccagcttggtattatgcccatctctttgtggacgaatctgatcttactctctggagtcattaacctgtaaaagaaaaaagaaaagcttaattgtaactctctctgtatgctctaatcataaagtactatccattcatgatctgatgtgaattctccatagatctttataggtaggtatattaaaaacaatgtttgaaaaatatggctgtttcatctagaatttaatttactaatagtatttaaaacttccctttgaaaacagtatcattttttgttgtgcttgtttaccctttgcaaacaagaaccttctaaaagcccaaagttgatctttcttaagtgagtggtgacctaatgagaggatgtggatcaagtgaaagtatgggagta

SEQ ID NO: 39131 - DNA, 1100 bp, Homo sapiens
aatgcacttttcaactactttctctacagcttttcatgtaaattagtcttttggttctgaaacttctctaaaggaaattgtatattttttgaaatttattccttattccttcttggcagctaatgggcttttgtcaagtttaaacacgaagtttatcataataacaaaaattctactaatataactactgtttccaaccatgtcccattatcccgtctcctccttcccaccctgaaaaaaatgagttcctgtttttactgggagagggggagattgattgggaaaaaaaagtaatatgttccgtttaaattttggtatatggcattttctaacttaggaaggcacaatgttcttggcccatcatgacatggggtagcattatctataagttttgtgcttccaatcactttttggtttttaagaatttcttcatactcttagagcctgccttcgattttgttcctttattctttctatttgtcaggtggcacaagattaccttccttttttagccttctgtcttgtcaccaaccattcctacttggtggccatgtacttggaaaaaggccgcatgatctttctggctccactcaatgtctaagacaccctgcttcctttgcttgcatcccacaaactatttccctcatcctatttactgcaacaaatctctccttggttgattagattgtgtttatctccctttaaaaccttgtgtatcctgaatggcctgtcattgtctgtctttcaaatcctttctctttctcttcctctattctctaaataatgatgggactaagttatacccaaagacactttacaaaatatttcctcagtactttgcagaaaacaccaaacaaaaatgccattttaaaagaggcgtattttttctacacctctttagaatgtaagcttcttttctccacctttttagaatgtaagcttctcaagagcagggacaatgttttctgtatgttctattgtgccttgtacagtgtaaatgctcaataaatattgatgacgggaggcattgagtcttgatgatatgggtgagaaactgaaatccaccccccaaaaaaattctagtatataaggaaatcaaa

SEQ ID NO: 39132 - DNA, 1061 bp, Homo sapiens
aaaaaaatctccaatcaataataagacctccaatttaaagacactgaaaacaaaacagtcaactaaatctaaagcaagcagaaggaaggaaataaacaagattaggatgtgatatgggtttgggtccatgtccccacccaaatctcatcttaaattgtaatccccacatgtcaagagagggacctggtgggaggtgattggatcatggaggtggtttctcccatgctgttcttgtgatagttagggagttctcacaagatctgatggttttaaaagtgggagttttttctgcactcaccaggtctctcctgccaccttgtgaagaaggcatctgcttccccttcacctttctccatgatcgtaagcttcctaaggcctccaaagccatgcagaactgtgagtcaattaaacttctttttgtttataaattactcagtctcaggtaaatatctttatagcagtgtgaaaattgactactacagagaattggtactaggagtgcggtaatgctataaagataacctgaaaatgttgaagtgactttagaactgggtaacaggtagaggttggaatagtttggagggctcagaagaagacagaaagacatgggaaagtttggaacttcttagagacttattaaatggttttgaccaaagtgctgacagtgatatagacaatgaagtccaggctgatgtggttttgttactggaaaggggtcctgatccagaccccaagagagggttcttggatctcatgcaagaaagaattcagggttattccacagtgcaaagtaaaagcacatttattaagaaagtaaagcagtgaaaggacagctactccacagacagagtaggatgttcctgaaagtaagaagaggaatgcatccaccctaggtacaatgcttgtatatttataggataaaaatagtgcttggggagatgtgctctgctacaagggtttgtgataaaggattaattttcttaattactatattttgcaagaatcaatattgttatctttatagcaaaattgggaatgtccttattctccagatatcagga

SEQ ID NO: 39133 - DNA, 1047 bp, Homo sapiens
attttgtgttttcatttttattcatttcaaagtgtttttgaatttgcctcatggtttttttgaccaattgattattttgaagtgtgtggtttaatgtctactatttatgcatccctcaaatttcttgttatttattttctcattctgttattgatttctttattccaatgtgaccagataataaactttgtatgatttcaattattttaagtgtgttgaggcttttattgttgcctaccatatagtctatcttggagaatgtttcattttcatttgagaataatgtgtctcatctaggtatagagtgttctatgggtatctattaggtataatgggtttataatgttgttcaagtcttctgtttccttgttgatcatcctcatagttgtttctccattgtttgaaagtggaccatgaagtctctgaatattgttgttgaatatgtatttctttatgtctgtttctcccttcaattttgttaacttttcttcatgtatattgagactgtttttaggtgaatatgtggttataaatgttatatcttcctaaggatatctttttattattaaagatgtccctctttctttcttgtagcatttttttaaagttctatatgtctaatattaatacagacatttcagcaaccttatggttgctatttgcatgatatattgtttccatccttttactttcaatctatttgtatctataaatctaaggtgtgtcaactctagacagcatatagttggttcttgctttttcatccagtttgataatatctaccattttattgaggatttttttttttttttttttttttaagatggagtcttgctttgtcgcccaggttggagtgcagtggtgcaatctcagctcactgcaacctctgccttcgggttcaagcaattctcctgcctcagcctcctgagtagccggaactacaggcacatgccaccacacctggctaatttttgtatttttagtagagatggggtttcaccatgttggccaggatggtctctgtctcctggctttgtgatccaccca

SEQ ID NO: 39134 - DNA, 1119 bp, Homo sapiens
actggtcatgtcaactacataatagctacccaagctttgtcaaattatttcaattgcctaagttttggaagccttatctgtaaaattgaggacattagaatctatgtgataaggtggttttgaggattgaaaaaaataatagagaacacttaacaaattgtattttttctggctttgtgacttactatgtacagtgccatttttaattgctttactcctttatttcccttgtgtgtttttatccattttcctctcaatggctttttttaaaaaaaactgtcacgtggatgatgaaatttgtaaatttttttcagttagcttttaacaatagagtgaagtttccatccctaagaaatctgtattgctttaaggttttctaagcaatgagttttagaaattaacctattacttgtattaaggtaatcaggtaattaagccatttagtgggtattatcatctgagttatttgataatgactttcagacccatctaattatctgggtaattgccatgtatccaattcatgtgctgtagacagtttgatacctcccttaaaaaataatttaaatgtcattttcttttactttatgaccctttttatctgagattcagaggtgacccaattgattatatcactgaagatttctaattcacttgcttcctacttaaaatccaagttgcttaagaaatctgattaagaaattgatttttcacaaaattaggatattagaaagaactttgaatgaatcatgaaattttctctcacttcattctttgcctattttatcctacctaggcttctatgtttcagtgggtagaggcatctagatttcctaggctaaagttaattcagttaatatagtcagcaaatctatagaagtcaatttcttatcatgggaacaggtttttgtatgcctcaatttttgctgttttgaaataacttttcctgtaaaatccccatgattgctatccagtcaagttacacccttcttcttcacattttttagcagttgccagaatctttttggtgaagttcaagccccttaagtttaccacaagagttttttggtggtctggcctctgctttcctctctggccatgtctcatttcactcccact

SEQ ID NO: 39135 - DNA, 1033 bp, Homo sapiens
gataggtattgtctcttgtcactattttgggtttataaacacaacagagatcagaaggaagaaagggacgtagaagaagacaatgaggaagaagatcctaagtgtagtcggaagaaaaaaccaaaattatctctgaaagctgacaccaaggaggatggagaagagagagatgatgaaatggtgagtgcctctgcctgacaccaggagcacagggatgcatctttagtgggtagcatcacagtcacaagcactgctctggagcccactgagttcaaatgtgggttccaggactatctgtgttagtgtcagtaagttacatggcctctgtgtgccttgctgtcctgatctcaaaatgggaatcataaacaatagtatccttctctcagggtgaaaaagtgggatgtcctgaaatttagtgctagggtgaaagggaacatttaaaaaccttcagtcttgtagatgaatcttaaattcctcttgacaacacaatgccaatctcatttctttaaattgcagacagatctcataaaactatctgagtgggctgggcgtggtggctcatgcctgtaatcccagcactttgggaggccgaggccggcagatcacgaggtcgggagatcgagaccatcctggctaacccggtgaaaccccttccttactaaaaatacaaaaaattaggtaggcgtggtggcaggctcctgtagtcccagctactcgggaggctgaggcaggagaatggcgtgaacctgggaggtggagcttgcaatgagctgagattgcaccactgcactccagcctgggcgacagagcgagactgtgtctcaaaaaaaaaaaacaaaaaaaactatctgagtggttaaaaaatggcacacaaatatcaggtatatttggggaaaagccattcaaaatgtgtgaattaaaacataaatatcatattcctaaaggcatctattaatggttttataggaaaagggaactttgagatctggaagtgtttccgttgagatcggtattgtacaactgttacttggga

SEQ ID NO: 39136 - DNA, 1049 bp, Homo sapiens
tttacataaacaaaggcacccgttgatccagaaacaccaataactatatatgtaaatattaaatagccatacataaagactaaaaccatgaattcacattgatactttcaattccaaaccaataccacagggcttttcctaaccttccccttcccaagcttctaactctcttcaacagtgagattcctggctcccattatatctcagtgtatttacttatgagcactaacatctgtgtagccaagctcccagctgtgaatggtcagccacaggaaagcctccaacacttatacactgctagtgggaatgtaaattagttcagccactgtggaaagccgtttggagatttctcaaagaacttaaaacagagctaccatttgacccaacaatcccattactgggtatatacccaaaggaatataaagaaagacgcatgcacacatatattcattgcagcactattcacaatagcaataacatggaatccacctagatgcccatcaatagcagactggataaagaaaatgtacatgtacaccatggaatactacatagccataaaaaagaatgaaatcatgtcctttgcagcaacataggtgtagctggaggccattgttctaagcaaattaatgcaggactagaaaaccagatactgcatgttctttcttataagtgggagctaaccactgagtacacatggacacaaagaagggaacaatagaccccggagtccacttgagattagagggtgggtggaaggtgaggatcgaaaaactacctatcgggtattatgcccgctacctgggtgatgaaataacctgtacaccaaacccccacgacatgcaatctacttatataacaaacctgcacgacgtatcccctgctgaacctaaaagttggaacaaaaagaaagccccccttttcacaaccccagattatgtcctacaaattaatcatcttaatcctttttctttctgttactcagactggataatttctattaatctatctgcagattcacagctcctttcttttcattttccaatatg

SEQ ID NO: 39137 - DNA, 1038 bp, Homo sapiens
aaattatgattgtttttttcttgtaaatttgtttgagttccttgtagattctgcatattagccctttgtcagatgagtaggttgtgaaaattttctcctattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggcttttatggttttaggtctaatgtttaagtctttaatccatcttgaattaatttttgtataaggtgtaaggaagggatccagtttcagctttctacatatggctagccagttttcccagcaccatttattaaatagggaatcgtttccccattgcttgtttttctcaggtttgtcaaagatcagatagttgtagatatgcagcgttatcaacaaacaaccctatcaaaaagtgggtgaaggacatgaacaggcacttctcaaaagaagacatttatgcagccaaaaaacacatgaaaaaatggtcaccatcactggccatcagagaaatgcaaatcaaaaccacaatgagatacatctcacaccagttagaatggcagtcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggactataaatcatgctgctataaagacacgtgcacacatatgtttattgcggcactattcacaatagcaaagacttggaaccaacccaaatgtccaacaatgatagactggattaagaaaatgtggcacatatacaccatggaatactatgcagccataaaaaatgataagttcatgtcctttgtagggacatgga

SEQ ID NO: 39138 - DNA, 1056 bp, Homo sapiens
tgtacttcacatttcttctcaagaatcacatttcttgggattctttgagtttctcgatttgaggatatgtagtttttgtggaatttcaaacacttttggccattatttctgcattcgttttctgcactctccctgtctttccttatcttccttccctaattaaattggtgccatggtttagtattcctattcaactcttgttgtaatatgcacctcactttcctactgcatctaccatggttcatatcctcattgtttctctttttatctgttgtaaaacctccctctattgtttttagagatgtggtctcactatgttgctcagactggacttgaactcatgggctcaagcaatcctcctgcctcagcctcatgagcagctgggactacaggtgcatgccactgcacccagctctctgcctctatatttgtccctcttcagtccacagcatggtacataggtccctttatccccacctgttttctagctttctttccccctaagccatcctcacctcacccatgactctctgaactctttatcctgacaatatggaatacttccagtactccaatgcatcgtgctttctcatgctcctgtgcacatgcatatgcctttcttatgtctggaaacctccctgcctctccatcatccctgtcgccatgcctggaaactcttattcattgagctgaaatacctctcctttaaaacttacctttttatcccatcccaactccactagaccttgagtgtattctgttacagcacttaatctattgttttgcaatcatcattgcaattaactaggtcatcctcctagactgacttgtgtgtggtcagagactgtatcttattcatttttacatacttagtagtggtacgtaataggtgcttactaaagtgttgattaaataaacaaataattggcatttagcaggtattgggcatattatttttaaaataagttgaactcagatttaatcataacctacattttagcatgcgatgtttcaggcaccattttaggcacttctcatacattatctttaatcctt

SEQ ID NO: 39139 - DNA, 1017 bp, Homo sapiens
aaactcaaaaatctctcatagtttttggtgtgtcaggagtccacgaaaggcttgactggacctgtgtgaatcagggtctttcatgcagctgcagttagatggtgacttagagttggaacagcaagggctggggcatttaggggctggccaggcatctttctgtctcttcttgcagtcttagggcctccccatgtggtctctgtgcacggaatggttgggattcctcatagcatggtggcctccgtgtaagggtaactgcttacatggaggctgaaggctttaagagcaagtattccagtgatgggtctacataagtttaaaataattggatagtattttatgttgtttggatttaccaaattatatttgctccatgatttataaacagaaatttaggttatttgcaagtttttgcaattccaaacactgctacaataaatatctctgtgtgcatatctttgtgtgcttatgtgattatttctagcagataatagaaatggaattgcaagagtggtaaatatgcacactttgaatttaggtagattcattgaaatgaccttttagaaaggaacttacacttctgtgaaggcagtgtgaaagaatctatttctccttatgtgcttgtcagagcttgtgattatcagtctttttaatgtttgttcattttgttgggtaggaaagggactcattgatttgtagttctttgattttttttaatgaaaatgaatgttttatatttttattagctattttctttaaatagttggtttattacttttggtatttttaaaaattggattttttttctacttgatttttataccctattatctattgtcatgtaccaaaaatgtcttatccttgttcccccatcccaatgtggtggatttttgtttttttggctttacaggaatttccaatttttatgaactcaaatgtatcaacttttccattatcatttttggattttgtgtcatacttgtaaagcaaaattgtaaaaatatttgctcatctttt

SEQ ID NO: 39140 - DNA, 1067 bp, Homo sapiens
acacgcttgtgtacagtttggggactataggagcagcgtgcctatggaaaatagaaaataggttctttttgtttttgttcttgttttttgcttcagaaataattatagaaatctgtgtttagaagcagtcctaagaagttacatgcaaagaagtaccagtcttggaatgagagtgaatcatacacatacactcccagttaatatcctaggtggtttggggcaaataactgggctttcacattcggtctaaaaatgtgataagacattcttctttgctcacataatgatattgtaatatataaataagaagaaacattaaccaaaatttgggtgacggaaaagattttgaaaaaagtgaagtgataggtacagctgaaattctgtcttacctatcagatcttcaactaatatgagtgctacacccatgtttaacgaatttaaccttggaagtgaaagaagttctgctctgcatattaaattttttgttaaagttacagcatgttttgggattttttttttctcctaggcatggaacaaggcagttgtaagaaatacatatatctgaataaatatttgggggatgttaaaaatattaaagttatctatggacctgcagctcgattgagaccctctgatgtcccagataaatactattcatgtaagtatatctctgtgataactttgaatatggtcatattaagaataccttcctttaggccgggcacagtggctcatgcctgtaatcgcagcactttgggaggccaaagtgggtggatcacctgaggtcaggagttcgagaccagcctggccaacatggtgaaaccctaaaaatacatatacgatactatactatatctatactaaaaatacaaaaattagcctggcttggtggcagctgcctgtaatcccagctgctctggaggctgaggtacaagaatcgcttgaacccaggaggcggaggttacagtgagctaagatcatgccactgtactccagcctgggcaactgagtgagacttggtctaaaaaaaaaaaaaaaaaaaaaagaataccttcctttaaatcatt

SEQ ID NO: 39141 - DNA, 1060 bp, Homo sapiens
gtcttcttaattgtttatgcttctaccctttgtaatcagtttttttaatagttaaaagtaaatcttcaatataattaagtagaggaaaggattagatgagtgtatcacactatatattatcatataatgcacactaactacatttattttcatcctgtgacccaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgcaagtatttgtcacctctttatgtgtggccatttcaaattaatgattaagcagaacattaaatgcatagtttctcactgttcaccttggctttatactcagttcccgcattagaggaacactgaagagggagtcagaaaaattcagttccagttcaagctctgccactgagcagctgcatgactttgagaactcagaccaaatttcttctgtgaaatgagggtcgtgcagtaaagattctcttttgggctgtgcgcagtggctcatgcctgtaatctcagcactttgggaggccgaggcgggcagatcacgaggtcaggagatcgagaccatcctggctaacacggtgaaactccatctctactaaaaatataaaaaaattagccgggcgtggtggcgggcgcctgtagtcccagctactcaggaggctgaggcaggagaatggtgtgaacccgggaggtggtggagcttgcagtgagccaagatggcgccactgtactctagcctgggtgacagagtgagactccatctcaaaaaaaaaaaagaaagaaagaaagaaaagaattctcttttcctccccgaccccagttttaatattttatgattccaatttataattgcatgaaatcagccttaggatcagtcacagttacccatttctaaatacatggctgtgtgaggacaagtatttccctcagctgtccaaatctaagggggccctcactgtttggcaaagcca

SEQ ID NO: 39142 - DNA, 1028 bp, Homo sapiens
gactattgtaacaatgtcctatctggcaaagtggaggcctacttcttcctgttttagtctttcttccacatcatcacgagaaagagttatctttctaaaatcaatctttttgaaaaccaaagctgatcatgactttataaataaagttataaataaaatcttaaactccttggcatggcttccagaatatcacccaatctatacctgctgcctcagttcctaatctacttcctattgtactagggatgtagaagcaaatcaaacagaggcccaatcttcctggagtttagaaattagtaagacaaacaatcttgaagtaaataatttttataacttactaaacaaataattcattataatttatttacctaacgtaataaacaaaaaaaaattacaattttgataaatttcgtcggctttcactagttcttatcctgggtcaatgtgaacataaacgtgtcctgagaatagagttaaacttggtacctgtaatactctcactcatatgtctaacatgttgagattctaagtgattctgagctgacaactcagtaaaccaaagtaacacctgcttctcaccctgcacctctcaccgttccctggcagaaagagtcctttctttttttttttttttgagacagagtctcactctgactcccgggctgaagtgcagtggcacactctaagcttactgcaacctctgcctctcgggtttaagagattctcctgcctcagcctcccaatagctgggattatacgtgtgtgccaccatgcctggctatgttttttgtatttttagtagagatgggatttcaccatgttggccagggtagttttgaactcctgacctcaagtgatctgcctaccttggccttccaaagtgctaggattacaggcatgagccactgtgctgggccgagtcctttcatacctccatgccatgcatggggatgccttagggccccagcagcctttcccttgtctcctggtagattcctatcacatctgcaataaagctctcctcagtc

SEQ ID NO: 39143 - DNA, 1359 bp, Homo sapiens
cacaggggacctgaaaaacccttaaataccggcatgcgtgcggatgaggcctctttccctgccgccgccgagtcgcgcggaggcggaggcttggggtaagttgagcgaggcggcaggggggtgtattggttataatttgtggctcgttgcgttcttgctgggattcgtgacgagtatctggttctttaacaagtcaatgcttttgttttttagtgcgttcaagattcaacttcacccgtaacccaccgccatggccgaggaagggtgagcccaggggccggggttggagttggggtcggggtgcggctgaggcgtggggctagagctggcggaacaggactgggtcaaacgggtcgccgtaagcgcgtctgttgtacacttagcttttgctgagtgcaaggccttatgtggtgtgaggattttaactgatggttctgatgtgtcgcgtttaagcattgctgctggaggtgtaatggacgttaatactgctttacaagaggttctgaagactgccctcatccacgatggcctagcacgtggaattcgcgaagctgccaaagccttagacaagtacgtgtatcagtctcaatactgtgggttcttgcaaccggaacaaaactgccacccaagggaagaaggcatggagttcatggtgttagcgcaaaagttctgaatggcatccgtcctaccggaaacctaggaaaaggtatcagaactcagatctataaagcccacttaaaatgtgtgggttgctgtttggaatggggataagcactcaaaactacagtgtttgaatgatgactttaattgtcggataccccttcactccttttatgagtgaaacataagagtctgacaaacctgtaggttgtggagctagtcagtcttatacttatctggcagatagatgagatggagagccacattacatctggtagtttgcaaaacaagcattaatttaatggaatttcaaactcaggtttcagaagcatttggtcctagatgaatttagtagtataatagctgtgatttatttgaatttgggatatttgttaatgtatttgaatggatcgagttaatgtgttttttagggtggtggcattgacaaatcaacctactcttgagctgaatttaaatgcagttttaaggttttacaggacaagttcgttttggtgtaatctagccagttcaatccgatggaaacggcattattgtttaatgtatttagtaggtcctagtatgagtcttctgtatttctatttcggcattattgcatggcatttcataactgttccattaatgccacagtcttttttttttcttttttcttttttttttttgagacaaagagtcttgctc

SEQ ID NO: 39144 - DNA, 1074 bp, Homo sapiens
tcttcagactcaagcaattttgtacgcatttatgtgttcagtggattggctgcttatgtttcgcaagtgttagtgcaaagataaccctcctaaaatgcaagaatgatggatttggatctgagttttagctccattttcattgtaatttgaatttcaggcgccaagcccatctttgtgtgcttgcatccaactgtgatgagcctatgtatgtcaagttggtggaggccctttgtgctgaacaccaaatcaacctaattaaggtaaggctgctaaggattgtgttgggactaatgttcagtgatgcttgtatatgggggtaaattctgtgaagtctcaagctgttcattttgtgcaggtgtaaacattacgtgcacctgatactgtcggccattttaaagatgattgtaggtagaagcattttatacctgcagaattgaatcctaattttgacgttggtatacaacaaagattagtagcaggcttgtaggtgatcttagtgctgtacatgatgacaactggctccctctactgaactgccatgaggaaactgccatgtcacccttctgattacagccaccttttgggtttcatttaattttggtagtgttaatgtctattaatgtgattttttttttttttaacctttctcccaataggttgatgacaacaagaaactaggagaatgggtaggcctttgtaaaattgacagagaggggaaaccccgtaaagtggttggttgcagttgtgtagtagttaaggtaagtcaccgtttattctagggatgaaggttatgctgggtaatcatataaaaccttgtattgaaataagttgaggatcttataaaaggaaaaaactgattcaacaggtttaaagcattttctgcatttcaggaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacaaatcttagtgatgggaaacatttttataa

SEQ ID NO: 39145 - DNA, 1032 bp, Homo sapiens
atgtttgcttctctgcagccttcctgagacattctcccactcccacagcttcccctgattcccaagtctattttgttttctttgatcaactctaagctgtaccagacaatttcccaaggaagacccacttgctcttcaaattttgcgtgccttgaagtgaactttaccatcactaacatgtttttgttagaggaaaagaaagctgactgtgtggtatgcaccatactgcattcattatcacttgttactgcgtaccactttcccaagccaaaggccttggcatcctcaactcctacctgcgctgtataggtcttactactgtcagtctcatccagatgattttcaagacatgagtcactccactccagttactcatccagacttctgagttacagttattgaaaagtgatcatgtccatctcttcataactttggtttgttctgtttgaagtacctctacttttctccatctagatatctcctactcattcttcaaaactcagtgcaaatgtaatgtcggcttcagagtgtgatttgcctgtgtagcttatatggaattcactggggagcccactgaagcaaaagtgccaggacagaagcagatgtcttcattgttttatgggggaaaattgttttatgacattggttgctgtgtgtgctcagaatcttgttgaggacatccctcatgaacccaaaaggagagctgtttgagcctagcacttgatgttttcttgcacccatggacaatgagacttgtgactgcctgttttctttggctgtaagagcctccaaatgaaagactcaattttctttctgttctttattctttttttttttttttttttgcctcattgtgattttattagcgtattctatgtatttctgataaaccactttaaatgctttaaaaaatgaatgagaggccaagcgcgatggctcaccccttaatcccagcactttgggaggccaaggcgggcggctcacgagatcagggagtttgagaccagcctggccaacagggtgaaaccctgt

SEQ ID NO: 39146 - DNA, 1078 bp, Homo sapiens
agagtggcaaaaaaatagtcccattttatggtacaccatttggtagtatcttgtttctttgcccctcttcacagacatgtctgaatccacttgtattttatttacaaagacacatagtccttcttgaacatcctcccgcttctttacaacatatacaaagtttaaatgttatttaatgtatgtaaacagtggcagaatatagcattattctttcctctttgtgtttctcaaggcacatatgatcatattgaaacgcacgtggagcgggtctttaggtcttcctgtaaaagtcaatatgacggatttggaagggtcctggatagccatggcaggatgtctttttaggtaccttctagtttgcagggtttacacaggaaaaacccttcctgagggatgggactagggctaacaggcaggtcaacggaaaatcagccacttaatcagtggcagccccaccaaagccggctgaaaacttagcagttctcccatggagagtatgcaccgctggagcccaaagatggtggaggactgacaaggccagggctgccttcatatttgcaaaattatgacaagtggaggaggaaatcatttcttctctcactgcaagctgcctgccacctactgcgatacctctaacagcaacaattccacccacaaccacgccagcggcactagcagcaacatacacccctgcactctcactgggtatgtaacactgcttcccctcttccttttcagctgcctggctcttaccatagttgtctctagaaataacatttgaatagcaggccgggcgcagtggttcctgcctgtaatcccagcactttgggaggccaaggcgggcagatcacctgaggtcaggagttccagaccagcttgtctctactagaaatacaaatattagctgggtgtggttgtgggtacctgcaatcccagctattcaggaggctgaggcaggagaattgcttgagcctgggaggcggaggttgcagtgagccaggacttcaacactgcactgcagcctgggcgacagagcaagaaccatccaaaaaaaaaaaatgaagagcagtaccaaaag

SEQ ID NO: 39147 - DNA, 1030 bp, Homo sapiens
tactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtcattcatgaatcttaacctgagggcaggggaggaaggtgcaggtccctctgccctttctgccaaggtgcagaatagcgcccgggcgtgtgttttggttccagagcagttccacgtggagcaacttcgtgtgtgtgtgtgtgtgtgtgtgtgtgtgttgtgtacttgatctgtgaggaggtaacaggactctggtgttcaaacccagtgggccgttggccattagtttgctttcctggct

SEQ ID NO: 39148 - DNA, 1024 bp, Homo sapiens
aaatcatacgtaaaagagatatattgtaagaagtaagtttttcattaaatatatttttaaatgatttttgaatttcctttcaaagaccatgaaacagacctttggagatttatgccgtttctgcttaatgatgatgtcacattttgatgtcttctttgattttctacttggaaaactagtggtggaaagactaaggcattgaaatcatgatgcatgttttagacagtctaaacaattttatatacgtcctttattattttatttcagatatgctggatattgttgaatatcagaagtataaaaggagaaagtatattattagcatgcttgttagtcattttaaggaggaaagaaaccatagttctcaagcgcttttagtattttactagattcattgcaggaccaagaatgcaccagcttgatggcaatccttttaagattctgatttcccaagggaaaggctctttgcaacctttcctcctagcttgttagtggtgtctctgtgacagtagttctttagcgtgtggaactagaggcagtgggagggcttccctcacacccccacgccttcacactactggaagctgtcgtttgagctgttttgcatacggacaactcatgatgttacaagtaacaagacgtgtgcttactgagagtgtgttctgcagtctgatgctgttccttttttttttttttgatgctgttctttattagcttatgtgatcatgacttgatcttacagtcaaatgtttctccatcaggcaactgaggagaagatacttatatctaataatgtggttctagaaaaggtatatgtgatgagtttaattttaagagggatgtatattctggtgccatttgaagttgatttgatttgctttctagtggatattttatttaaaagaaatgatagccatgcctttaatttggatagacatgaccatagtctaatttcaatatatattatattatgatttatttcacatggcatcataggaaaaatgtaacaaaaaattataaagtg

SEQ ID NO: 39149 - DNA, 1060 bp, Homo sapiens
ccccccgagtagagtaactgggactacaggtgcacactaccacaacaggataatttttgtatttttagtggagatggggttttgcaacattggctaggctggttttgaactcctggcctcatgtgatccacctgccttgacctcccaaagtgctgggattacaggcatgagccaccgcacctgaccctattagtaaatattttaacaggcagtcataagatagcagaatgtatggaaattaaatgatagttcagcaaattcaattaagtaagcatttcaagacttcttgctatcctctagaaactttgctatactagggattaaaagatgaatataataattccttttctccccctaaattttagtttagcataagattatatgatactgtgtaagttctattcttagttcttttaaaacgagacttggatagctagtactaattcattcagtgaatatttgtggagcactgctatatttgaagcatggttttcattgttggaaatacttggtggacaaaatggacgcatattactgttcttgtggaacttatattcttgtggagggggagacaaacagtaaacaaatatagtatgtcagatagtaataagtgcaaggagaaaaaccaaataaagcagggaggaggataggaagtgcttgcgggcagggtaggtaggtgaagggacagctgtggttttttgtttttttttttgtttgtttgttttttgagatggagtctcactctgtcccccaagctggagtgcagtggcgcgagctcggctcactgcaagctccacctcccgggttcacgccattctcctgcctcagcctcccgagtagctgggactacaggcacccgccaccacgcccggctaattttttgtatttttagtagagacggggtttcaccatgttagcggggatggtctcaatctcctgaccttgtgatctgcctgcctcggcctcccaagctgcggtttttggagagtagttagggaggcctcactgagaagatgttgtgcaaagactcaagagaggcgaggaagtgagccatgtggat

SEQ ID NO: 39150 - DNA, 1032 bp, Homo sapiens
ctcctacttcattttgcagaaatttagctgtctttgttatgccctcaccatccaatgtatgcccagataactgtgcctttttcatccaaagatccactaaaagatgacagtgtttttattttttatgagacacatcacctgcagaatgatttttttttctattacagttgacacatagagatgcattttaattcacatgtagacaaacatttgatgaattcctttttttatatatatacttgggaaataggtaaattttctgctatcaataatctctcagaaacacttgatgactgaatactatagttaaaaatcatgaatgagaataagaaaggcaacatagtattttaggagggacattatcccactcattgaattaccatataacctgtcatagcaccttaactgctctgaacctctttcctcgtctataaccttcatcctggcctgcactggagtcagagttaaactgtgccttgtaaaacataaagttctttataaatataacagttagagcctgggcgcatgcctgtaatcccagcattttgggaggctgaggccaggggatttcttgagcccaggggttcgacaccagcctgggcaacatggtgaaaccccatctctacaaaaacatacaaaaattagacaggcatggtggcatgcacctgtagtaccagctacttgggaggctgaggttggaggatcacctgagccctggaagtggaggctttggaagtggaggctgtggtgagttgtgatcaagccactgcactccatcctcggagacaggaatgttttatatatataaatatagatattattttacatatatatattacatatatatataaaattcctgtgctccctagggtgattttatatatatatatatatatatatatatatatatatatataattctattctatatataacattctactgtagatatatattttaaaaaactgttagatattatgatattatgagttgcgacagtgatgatgatcatcatctcaactaggcaggtct

SEQ ID NO: 39151 - DNA, 1094 bp, Homo sapiens
tagatgtcaacgttgcatttgttagatatttcttaactttctctcttatttgagtatctaacatattgtatttcttttgctctagtgtaatatagctaaattgctagactctgaattaatatcaataaacatttatatcacacaagatagtgttatactaaatatatttaaatgttttaaatggtttcaaagttaatattttgagtaatatgctatggatggaaagcttattcatgaccagtataagttatacaaaattaatgtttcaaaggatgtctgaatttcaaaaggactcttcaaatgatcagctccataattatatttttcatctaattttatgttcaagtgctcccctagagtggtgataagtgaaatcatcgattaatgctaggactctaagctgacctagaaaaactacatttgaagctgtattcaaagaatttcatttagccttactaggacaactgtcattcttatgtaacattttaaagttttgcattgagattgggcttgaaataaatgcctgcatttgctcagagactgttaaggagggagatagagtaggaagttgtctccagaaataaaatgataatgaaacctattgtttatcgagtacctactaattataaaccacagtgattatatatgacataatttttcatagatactaaatatatgtatgtatatttgcaatttttatccttgcaaaaatgacaagtataattggggtatttacattctctttttaaagacaggacaataaaatctagtaaggttaggattttgcccaaactcatatagaaattagcaaacatgagatccaaatccaggtctgtcagaccgcagggtctttgtttactctgctatatcatatttattattcattgatggatgtattaaacaaagattaattcagcccttcccattgccaggaactgttatagatgctgaaaatactgcagtgaaaaaagacaccaagttcttgctttcaaataatttatattctagtgaaggaaatagaatatacaaatatgtctagtggcattaagtgctacagagaaaagagcaaagcagtgtaacaggatcgaaagtga

SEQ ID NO: 39152 - DNA, 1026 bp, Homo sapiens
aataagtgtgtggatttatataaagtgctcacagcagttcctggctcagaggatatacttttaaattatttgctaaaaatatgaggtcggaccgtgtgaaactgccactatttgactgtctttaacctacagaaataatttcatgcggttcatcctgataaatgtgaacaccttcattgaccgaatgccttttaggggcagcaccctttgctttaaggtccattttgtttgtatccacagctctgctgtggataaagataagtaaaagagtctctgccttgaagaagctgagagattaataatagagctataaataaagtttcctagcactgtagtgctttctgcctgtggtgggggaatgaagcaggactcttcttaggttaccacaagcgacttgggggaaggagacaaaatctggcagtctgctgaacagggcggaattttagattgaagaccctagaattaaggtgggaactccaatgggatgtcctcagggagtcacttaggaaaatgatgaaccacgtgtgtgcaataatgtgtgcaatttgacacacagttttaatgcagacaaaaatctttaataatcatgaagctatttccataatatgaagaaatttaatatatgttaaaattctatgtatttctttgttgttttccttttttagaattttctgtgtgtctttcttatgtgccggaaacccaacctcagagcagtattttcaccattgagatggtgccattaaacacttaaaatcggctgggcctgtgatcccaggactttgggaggccgaggtgggtggatcacgaggtcaggagatcgagaccatcctagctaacacggtgaaaccccgtctctactaaaaatacacaaaaattagccaggtgtagtggcgggcgcctgtggtcccagctactcgggaggctgaggcaggagaatggcgtgaacccgggaggcggagcttgtagtgatccgagatcgcgccactgcactccagcctgggcaacagagtgagactctgtctcaaa

SEQ ID NO: 39153 - DNA, 1049 bp, Homo sapiens
agtgtacaatatatactcacatataaattggcatggtacaaatcacataagaactaataagaattatttatagacgtgaatggtgacgtgatgtcaaataattctgaagtggtgtgtttgggatcaattctaaaggagaaggaacatgatttgtcagaaaaggaactcagattgcataggaatgaacaagagttgtctaagaaagatgattgaattgggtcagagccaggaacttgaccatttaatgaaacaatgtacagtgaggcaggagagcaggagagaaaaaagaaaaggaatggaaggtctcaagagagttgaaaagggtatctataagaacttactaattgtagcagctgactaaaagtggaacgagcttcctagcaaagttgtgatatccactgatagagataataaagtcaagagcgtctccttataggatgttgtttacggaattcatacattgggtagaagacaaactagatgctttctaagatatgttccacctctgaaatgctgtgattctcctatttgtattgctaattagccaatgaatatagtgtgtgaaagatatgacagcacaattgattgctctgtaattataaattaccccctctgctaattacaatgaagttttttgaagattttttaaatgaagcagtacacttctttatgggaagatcatgtcacattttctaactgattttgtaaatcccatttaaaaaatctcctctactattagaaatgacaaatatcaaaactacaattttatactgagatttatatatatatatatatatacacacacacacacacacacacacatacttttttgggggggataagaagcattaaaataaattaagtagaataattaaaagctgtatgtttagctggtaatttttggagtggcacagattttgttatacactgtggtattcaaaaaagcccagatttgtcccaagtaaataaagaaatgtcttttaaatgttttcacctctaaaagtctggtttggtggttttaatattttcttatgttgctatatcaggat

SEQ ID NO: 39154 - DNA, 1049 bp, Homo sapiens
gttcaaatgatagtaagttcatagcttattatacttgaaaacaagcatatattacaataaaatatcactgtgggtagtaatttctttactttggaataaatttcacatgtaaaaaccatgtctgtaagttgtgctgagaatgtttattctcccacaatgaagataactttcctgaacaatgtatcatgatagttattgcattatcctctatgtctacttgacccataagtttctcaattatctattattcaagattctatttttaacatcttgccagagaacagcattggcatgtgagtatgcctgtgcttccatgctgtgtatgtgtatgtgtgttataaaatgatggttcgttagttctgttaggtgacaaatgttgagatgagtgaagactgtccacttttccttccaaattttgcttctaggtaagaatgaaagaaatgtcaaaccaaattctggcttacatatagatattttttgaacatttcttggcaagcaaacacacataaaaagtaactctatatttgttctgtaggatcaaggacactttagctcttatgtccttttagatgttttgaccattacctggtatgaaaactccagttgagataaacgtgaaaattccaagaccggattctctcaccttatgtctagcatcaggcaattagaatcttctgtagttcatgactaggcataggaatacttaaaaagacttagccaaacacatcctcttgaaagtgaaagctgcaggcttatctaatttttacacttgatttacgtaagggtggagagtattgctaaaatattttagtgatctacttatcttgagtagttttaacttctattaaaatgagatgtgcgagttcatttctgccattcacagtgctactcaagaggctactgttttcgtcagtgaaaacccatttctgacattaaatattctaattttcaaaaagttgtttgttgatggaaattcagataaccagaagacttttagtactcatgtgagggaaggtgggctttatgatgagaatgctacctttctgttg

SEQ ID NO: 39155 - DNA, 1034 bp, Homo sapiens
aggccaggcgcggtggctcacgcctgtaatcccagcactttgggaggccgaggcgggcggatcacgaggtcaggagatcgagaccatcctggctaaaacagtgaaaccccgtctctactaaaaatacaaaaaattagccgggcttcgtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagagcagaaaaaactaactagtctctttatttatgcataaactctaccagttttatttcctagcaaagaaaaggggggacctttgtattattctcacaaaatgtattttgcagaaatatctgaatgttgttgaagtagcaaaatgaactgtagagaggtgaattgttttgatctaattaaattatggtacctaatctaattgtaagataatttttgaactgaagaaattattcagaaaaattccccaaatatccttccattctcacactatacatttcagaatttcacataaatccaaacacttccatttccaggtcaggtcaaaaaatctaaactgtttggtttgtagcagttttcacagacacaggagcccattatccagaaacagctgtcttactaatacttatttctcttaggaggcactccacacaagcagggactcgctggtgttgtgtttgttctgtattaatggttaagggaaggtaaaggggtctttctgatagtttttcctgtggcacagattttgcgctgtggtaatgcttgttgtcattttgggaaaaatagtttttttatatataatacttatgtaatcattttgatacagttctataaaattatatataatatgaaatatatatttgagaaaaataattatctatattatctatatctgtttaggccctgtttatctaaagtattgctaagtcttgctacggtataatattttcc

SEQ ID NO: 39156 - DNA, 1050 bp, Homo sapiens
attaggcttttcccaactttcagccctcacctcatcccccttccacattaccttctatagcatctctacccagtttgtttttttacaacctttcaatggtcttcactgaccaaaggttaaattccaaattctttaccgtatataagggcttcataatatgcttcctctggcaaacttcttgacactgaaatacctactatttcccacatacagtctctgaagactcaattcagaacttactttcttcattgccttctccatcttcctttggctaagttaatttgttctatgaacactcacaatactttagatagacttcccctagagtagtcatggtatcctaaatattattcttctctcatttgaccaagaacaaatgaatgaaacctctaaaaataaccactctgctaaatggttattttaatatctaaaggaatttctaattcattctttcatcacatgcctgttaagcattggttataagtgtgggactctgtgggtactaaatagcaaaaccctgtagatgtgttctctgcctttactgttactactttgagaataaattaaaacaagcagaactttctagtaagttctttggggtaattatgctttggaaagccgtgggtgttaaagactaaaaaaagttaaatgataggaagcttgtctgtctctgactttcagttgcgagcatatgtctagtttgtggtggtctggagcttcctcagccagtcccaaggtccagtcatcatggtcttgaggaaagtgacattcacctggggataatttctgtgtattcattgggcagttcatatagttttttggtgataaatcataggcaagaaccagtaggaaagaaggttctttttttttcagatatgctttccttttaattcttgttttcctcatacaaatttaatggacataagacttgtgggatttggagttaattttatgtttacatttttaaaaaagtatttctccctccccaccctttccccttttctcctcctacgccttattcctcttcctcctcctccttgttcctcttcc

SEQ ID NO: 39157 - DNA, 1015 bp, Homo sapiens
tgttttgtgctaaatgtaagagataaaactggaaaaaagaaaagggggggaggacagtgcaagatatcagcccttgttgcctagtcaagaaacagaggaatcgtgaaagaaagcttattttccatgtttgcaattcctgggaatgaccaaactggttttgcaaaccatgtgaattgagtccatgtgtatgctaggggtgagggagttattgagactagtttatttgagatattctgggtgtcttttactttctaaatattcttactccttttcttatgggggaaagaattttatgcaatagactttcattaaattgaattttcacaaccaaattgaagctgttatcagttggttgaactcttgctaactgaatgactataaggacaggtttcaatttcttcttatttaaagagtctgatttttttcagctgctattttttttcctcatattttcatgttgcctttatccagttggctgtttacattgtcagtaataagagttagaacttctaagtgtgacatgtgttttttatttcaaggacttctactaaaattgtttcttttgcatgcatgctatggaaggcttgcttaaaaactttgagaagactctaagtagagcccagaatttcgctaagaatgtggaccttttctttggtaagttggccatcctgtagaaagcgaatggcagtttcctaaagaaaaccctaatatggcttctttgaaaaaaaattgccaacatgcagtgccaaatcgtatttagtaaaaccttgtccccaaataaaaccagggaaataggcacaaagaagagaaacaggatacatcagtgcatgttgcaggagggttggatttgttgaaagattaatcataaagtatgtggacaaaagtgaattaagtaagtataagatacaatgtcactacctatttattcatcttttagctaaatatatgccttcccatgtctgcggacttttcctctcttattttgaccagcgccagctcacctctgctggtgccc

SEQ ID NO: 39158 - DNA, 1100 bp, Homo sapiens
aaaggtcatgcatattttaaagctcctgaacattttgccagatagcattccatcaagcttataccattgaaaagtcaaagccagcatggcagaggagttcttgtctcatgcctgtcagcaccttgttttgtcattgtaaactataattgttgctgttctgttcccttcttcaaagtcatttaaatggatattttaaaaagtagagggttattaagcttctgaaacacttcaaatacaacttcaacctatgcatatctattaaaagtttaatgcagcaaatttactaatatttgcaaaaccagtttagacaaagataatatatagatatatagccagatcatgactttcatgatgtaagtgttggttaagtaaaaattatgagttttttagtttggcagatttttagtttatttttaaaagtacaatatgcaaacagaaaattatacatatcataaatatgcagttttgtgaattttcataaaactggatacacccatgtaatccgtacccagagaagacatcgaatgtgatcaattcccagaatcctccctcatgccctcttcacaatcataccccttcttcctgactttcaacactgtagatcaatattgcctgtgttctactttgtataaatggaatttcgtgtaatgtatgtattttttgtgtgtctggcttcttttgcttaactttgtatttgtaaaatttatgcattttgctatgtgagagcatgtgtttgttatagtctccattcgtttttgttttgtggccctaatgttgagtgagacctcattaagatgtcatgtcttgatacaccttacatggtctctgaatgatctttgcttgtttcctattcagcatagatctcatggctcaccttttcaaccactaatcttccaacagtcttaagttcctgtctccttttctcttcatcttctttacattgtggcctttggctgctggttgtttttgctgtcctcttcatcggacttcctttggtgggtttgaagtggctatttccatactcaccacagcccagcagctggatgtggtaaggacagggagaacaagcctgcacacctctcttacactcccttccatta

SEQ ID NO: 39159 - DNA, 1085 bp, Homo sapiens
ttctgttccttttgttgataaggatgaatagaatgatataatgccctgttctctccctctagtttctgggccactgttatattgtctaataatatccactcataggacatagggtggcctttctctctttttataagggtataattatccagtagaaagtcaatattcctttcatcaatttttaaaattacttaatttcttttgtttcgataggtataggccctgcacggccttacaaatgagtaagggatacagcccaggagcaatgtccagctgcactgtttttacttacataaactcatgaacagtgtgtcagccagctttacacactgtgaccgtgagggatgtattttcccaaacattactgatcctttattgaaatggaaaatttagtttgcatgtggaataatttccctttgcaagtcaattgtgatttattaaatttccttgtccttcacaagatgtcaatggtgttatctcttgatacacctcaggacacgtcttgtctgtttgtcgtcactaggccttcatgatatacagcctttatgatatgtcttcctgaactctgaactcttgtaggaaatggattctatcatataaaactcagtatcctccaaatatgcctcagatgaagtagatttcagataaatatttgtaagttaatgagataattttatcctgtatgaaaataattctgaaatggaagacagcatgtagatacatcgtaaatattgttcactctatgtggacatctctccatggcaaaagaagactcagacaaaccaaactattatactaccaccaaaaaagtctgtgcaattaaaaaacagtgcaacacaatgcaacaatgcatccagccatgatggtctgaataggtgcaatctcattaaggcagaacacccccatgactgcttcatcttgcatctgtggtgcctagcatggcagccagtacatggtgggcattaaagatagacatttatgaatgaatgaataagacgccccacatttaaaactcagaaaatatgttttatgctattagttttgcttgaggtcccatttagtatgtgttatgtgtgaaggtggga

SEQ ID NO: 39160 - DNA, 1027 bp, Homo sapiens
tgttgcatttgcatacaacttacaattttgaaagcatcgtctcaaacatacattattcttcactccatcttccttgttaggacaagagctgtttttctggtttcatacatgaaagcctaaataatgtctctcacctgggaaaaagtagagacaggactagagcccaagccttccaggcatccattctttctgcctgcccacttagacttaaagtaagactctgacagcaggctcttgaatttacctttgcttatattataacaacatccaaagcagggacaaccttgatgaccttgaccaactttaacacttgtgtaaatacaagaaaaatcaactttgctaaacttgtggtgtgcccataggtgacagtaagctaaaatgctaactccatggcataactgcatttgctacatgcagacagatagagttgatgtttgtcatggtatgagcccagggaatcagacaagtacttctctaaactcttcccactcaacttaatacaaggtaagcaggtcctgcagtagttcaaggacctgctgcacactgtatacagaatagggtactgtttaacagccttttatctgtcatacgtttcttttcacttactactgttactgtagcctgcctccacatcaagcttcgctgcagaaaggagatggatagacacctttaaagaattattcttcccccacttcttccctccatttggcttcctcttagactgtgcctcaagtgaagacaaggctagttacggcctcattatgcaagaggtcagagtgagatgtgaggtgtctacctttctctctaagcagatgcacccaaccaaagtgtgcagaaagaaccactgctgttcctactacacgctgattacagttgcacctggagccacattccagcatcagtgtcattcagatcgtcttagttctatccaagaattcttgtagaacctaagaaggagagctgatcagactaccagcacattaactcaaacatgccacggagtctaaataaatcaagtaatatcata

SEQ ID NO: 39161 - DNA, 1023 bp, Homo sapiens
ttctttatatttattcctattaatacatgtagctctagctcatttattataaccgctgtatagtatttcattgtaattatatggcatagactatgctctcttttagatagacatttaagttatttctaattcttaactcttagaaaccatgttatggaataatttttctggagttgaaacagaaaagaggaatttggggacttagtgcaaggtacttgcttcaccatttattgtgtaatacaagttttaataacagtaaattaaagtattagaatgtgtgcattcaataataacattttgtaaaaatatttcaaagatttcaataaaaattaataaacacaattggtagaatatccctctgcctgctattggctttgctgcctccctagtctttagttccctcaacccagaatacccttggaattgccccttctgacttggctggccctgtaagggcttcctgtcttcctgctgagtgtatgcagctttgagtgaagttctttctgtatctctggcaacagttttgttttctctctctacccaccttgcccactctctgactgcttcccatcccaaaggagagatgtgttttcagatggcacttctcatctctactcagcctttttttggagggtgagtggctagatatgggcgatggggaacacaaagggaaatgctaagacacaaggggttttcatgagtggtaaaatgactggagggtttgcaggaggatcagggaggagaaagagtaaggaaaggggaaggagagagggaacagggaaaaatctaggaggggtggactaagatattatagtttcaaatatcagtatttatgcaaaatacacaaaaatatatgctagtactttaaaatggcacctattaatggaaaattaaaaaccggtgttacagttagtagtagtgtaaacacattttcaactttactagataatgtaatatttctttccaaattggctgtaccaatttacattcccaacagcagtgagagaattacccattttacca

SEQ ID NO: 39162 - DNA, 1033 bp, Homo sapiens
caaacatgtgtgcacacacacacaccccccctcactcatttgggagatctaacactgcacatataaatattgaaacttccaggctgggcgcggtggctcacacctgtaatccaagcactttgggaggctgaggcagttggatcaggaggtcaggagttcgagaccagcctggccaacatggtgaaaccccgtctccactaaaaatacaaaaattagccaggcgtggtggcacgtgcctataatcccagctactcaggaagctgaggcaggagaattgcttgaactcggaaggcggaggttgcagtgagccaagatcgtgccgttgcactccagctctgggcgacagagcaagactccgtcttgaggaaaaaaaaaaaaaaagaaatttccacatgcatttccatcagagaactaattccatctccccttacctagccccttgctctcctgcctagcctgtgggaatctttgaagattctttgtattctaagaactgtcccaagaacaaagtagatgctcaagcaatgtttgctgaactagactacatttgattccatgtaaccaaatgactttatctacatttttttctattccttttattcattagcacccactaaatatactccactattctaggaatagggaaaaaaattcatgaacaaattagaaaacaatcctaccctgatggtgccttacagtcttaattacgtgaatagaagctattgttgttattcttacttttcaggtaaggagaattgaggcttttgtcacataggaagaaaaaattatgagcaagtcttgcccttaaaatcattctgatggtcaaatgcaaatttgctattttggtggactcttgagaatgtgggaaatagacccatgtccactttatgcaaagagaaaaagctggcatgagtgggagtgtttgaacatcaagaatgcttttgcatttcttgggttgtgaacaactgatggagtcaacttataaataagcaggatcatgactcattaccaggatctgtacagaataaataat

SEQ ID NO: 39163 - DNA, 1030 bp, Homo sapiens
gtatttgtatagttttagttttaatgtttttcaattttatacttaaatatacttttcatacttaaaattatgttgctagaatttagatactcttaattctatagcagggtctttttctctaaagggccagatagtaagtatttttggctttgtaggccacatgtctgtgtttcagctgctcagctctgccatcatagtgcaaaagcaacatagaaaatatgtaaatgaataagcatggctatggtccaataaaacttcatgggccctaaaatttaaatttcatataattttcatgtgtcatgaaatattgtaattttgacaactttttaaacatttaatatgtaaaaaaatgttcttagcttactggctgtggtctgttctcaaatagtgtttaacacaagcaacattataatagtgaatatgtgcaataaatagtaatttacctctgatctcaaccagaaacatttttctaagtggtaagcatcaggctttcctggttcttaatgtcagtgttaaaactcgtgagtccatgggagaagaacaaggagttgtgcgtcagggccactgtggatctggatcttagcactacacatactggctgtgtcaccttgaacaagttacttaagctctctgagcttcaattcctttctataaaaggatgataataatacttcttggcaagacttttgtcttagataatgtatataaattgcttaacaataaatatcagtatgtcttcctttctttaattagtaatgcaataataggcaacagctttttaaggaaaatgaaaatatgcattgtgttaacagactccatttggtcagataaatttagttgcatttagaaatgtgtaaactgggctaaagaaagcaaacttttggtaacaaaatgttagataaactttgattattaataatgtagtcctggtagcatattatatgaaacttttaatgaatttcaatgacttttttttttttgaaacggagtcttgctctgtcacccaggctggagtgcagtggcgcgatct

SEQ ID NO: 39164 - DNA, 1032 bp, Homo sapiens
gcccatcaggctaatttttgtactttacttagtagaggctgggtttcaccacgttggccaggctggtcctgaactcctcacctcaggtgatctgactacctaggcctcccaaagtgtcgggattacaggcgtgggccactacacccagcctaattttttttaattgatataagtagatagtatcacctttagattttatcctactacattggtgctctttaagtatgttgcaatattcttgaaagtaatttaatgtgtttcactaccttaatcctaattatataattacatctgcagatttatatggaacatagattttcctttgaaattgttagcacttgtaaaattattaaagtgtaaaatatagagatagcataaatgcaagcataccttagcaaataaagcagaggtcaggccttgtgggctgtctgctctctgttgtcgctatttagctctgctattgttgcacaaaagcagccatatacaatacctacacaaattaacgtgattgtatttaaataatttgacttatgaacactgaaatttgaatttcattaaaatgttcatgtcacaaaatattctccttttgatatttttcagccacttaaaaaggtaaaaaccattcttagcttaaaaccatacagaaacaggccatgggtcagatttggcccaactcctgatatagatctatatgtgtatacataagttatgttgtacatataagaatgcatgccaattatatgaaaatttacttccagatataggtaattccagattctaatttgctgaatggtgtcaggattcatgatgaactacacttcatatacaaaaatacttagatctattgggagggctagggcagtatctaaaagagtaaattttcactttctcacttaattgaaatgtatcaagttcctattatatgccaagttctatgccaggaaatgggaacccagtgacctaaagaacacaataccagccatccaggaaccaaaagtctagcagagggaggcagacatgaaaataatgaat

SEQ ID NO: 39165 - DNA, 1149 bp, Homo sapiens
tggcaaatttgaaaaacaaaaaaatgaatagtattattttctattaaatgatatcaagatgatctctaggaagggagacattttctgcttgtaaagagatttctgtttccttggactttttaattttctgatatttattttttgtcttcagcgtgtgtttgtctgggatttggatgaaaccatcattgtttttcactcactgctcaccgggtcttatgcacagaagtatggcaaggtaagaaatcaagaaatgttactccaagaaatcttgttaaattttttgtgtttgtttaaaatcaagggctatttaaaaattcttttaagtgtttttttattgcagtctgtgaaatcttctcttaattatctatttctagtgtcttatagttctttaatatgaactggcaaatttaacaaagctaattataaattgaattccttgctatttcttcaaaaggactgagttttctacatcaagaccaagcttcttagtctcacataattattttagaaaaaaaattgtaaatcgaaatggacttcaaaacattataaaatcatatattatccccaataaaagagctttaagaaattgtttaaattaatttgttgcaattttatagcaatagcgagtaatctttcgtctgacagatcttttggatttatgaatgagtgttttttctgtgacttgagtacacatatgaacagcaaccgaggtaacaccccctcccatacacaaagtcagcaatagatggtctcatgcctcacctgcctttctctcttgctattgtttttattttctcttttatttatttatttcattgttattattattattattattattattattattattattattttgagacaaagtctcactctgtcccccaggctagagtgcagtgacatgatcttggctcactgcaacctctgcttcccgtgctcaaatgatccacctgcctcagcctctcgagtagctgggatcacaggtgcccgccaccatgcctggctaatttttgtatttttagtagagacggggtttcaccatgttggccaggctggtctcgaactcctgacctcaagtgatctgcctgcccctcggcctccaaagtgctgggattacaggcgtgagccaccacacccagcagttat

SEQ ID NO: 39166 - DNA, 1032 bp, Homo sapiens
gtagaattcaatctgtagtttcatgttaaagatgattctgctgtaaaagaaacaagcaaaagctcatattaaaccacattgagccagaagtttcttagaattggtgggaaaaaatttaactacaaaataaaacatgcaccaccgtcacataaattgggaattctttgtgtaaccttgtgcccagatgtttggtcaagatttataccagggcatttagttgaccctttatcagctggtgcttggagcattatcagtgaaaatcagacagaggaactaaccgaggcaacagaaagaagtcctttctcaagtagagagcctcaatcattgaaggacggtggttagcaagcattatctttctggaatcccatcaaaaataaatataaacagttattaatgtcatttcaaagactttcaacaggtttattttatcttttaaaaaaatcatgttttatgtcagtgtatcattctcatgcatagtgtcaactatgattatcatagtttttaaaagttcaaataatctgtaggtaatatcaaaaccattttataccccttcatatattttacaggtgatatcaaaacctttgctatcaaaactgtgatcctggatgtgcttctatatataaaataaaccttggtgatatcttattagaatcaattttaggtaaacaagattcctaaaatttgctattaggtcacatcagattaatctcccaggattttgtttctttatgtgcttctctttttttctaaaaaggaagagtaattgaggaacataaactagaatccaatatactaaatatacatgtgcatactatacatacatatattcacatatatatcatagaatacaatatagtaaataaaatgttcatatatagtatataatcacatatatccatatacatcatgagggtggggctatgtgtctggtcaccttgtatccccagtgcctagcagtgaaacacataagagatgctcaacagatacataataactgtaagagaacaaaaaatgtagagccaaagaggataa

SEQ ID NO: 39167 - DNA, 1023 bp, Homo sapiens
gcttatccctactgatgtttttggagtgtgaaacacatttgtttaatcatctgtccgaagtaacgccttaccttattcaaatatatgttgatttcataaacccagaggttgtgagccagttcaagtgatgttcaagaggcattaacttaacactttatgaatctttaggttaatgaatgcagtggctggaagaataagcagtgcattgtttttcaggcaaggaaagctgttttgagcgtatagtgtccagatttggcactaacataacttatgttgtgattggagatggccgagatgaggagcatgccgctaaccaggtaacttcactctgaactttatctcatttatcttccaggaaaagaaagttgctttgaacgaataatgcaaaggtttggcagaaaagtagtgtatgttgtaattggggatggtgtagaagaagaacaggcagcaaaaaaggtaacctgtctcaaacaatgtcggtgtgatacttctaatgcaagcctttttgtttgcatttctgtagtttggcccaatggcagcttgacaaatgatttaaatttatagatgcaaagcaataagagcatgagagggtcaatacttacattcaaataaaccatttggagtttagcattttttgcctgaaatttgataggaaatgcagggaaatttagttatatttatttatgtgtttgaaagtatatacatatagtaaatatatatagtaacatatatatttgtgtgggcatgtatacacatgcttatatagatgcatatgtatatattaatacacatacaatgtgcacagatatagatgagccaggggatctgcaagaaagattgggggggagaataaccattgttaagcacatgaaatttagcaagatagagattaatgagctccatacaaaagtcatgtgagtagttcatgagacctgcatgccatatggtcctcgtgagtgcctggaagtaggcatgctccatgataaggaatgctgagggcagatttaatagctgaagaaaaac

SEQ ID NO: 39168 - DNA, 1034 bp, Homo sapiens
tggtcttatatttacaacactttaatgggttttttaaaaatctgtggaggttgctggtacacaccaaatgagtccaaactggaatgagcagctttagcaaagaactcttaccctggcaaagcagcaacacacatgctccgtctgacaaggtggtcaacaacattcctcaaaatgggagatcttctcagccctgaggtttgaatctgactttagcctacctaacccagaaaatctgaattggaatgcactcagactgtataaggacagtcctatttagacatgtaatttgtgtaaattattgatgaaaataatttactgtgactttattagcagctgactttcaaagtggatgcaatttttctttcttttgttggggaggggaatgggaggggaaatgggaatataatattgtctcttttttaagtttggcaaacagaatgttcatactgatgtgttgtgccttaaagacaagacagcatttgtgtgttacaatgtaactttggttaaaatctctgtagataatgaaaaaaaacaaaaaaaaaaacctttgtgatgattcttaacatgaccaaatttaaaagtcaagctctcagagcttaattaccgcatcagcaagaaactgagtattttttgcaataagaaaacaacaataataaaggaaagcttgtgtttcatttgggttcttaataattccaataattgtatgaggcaactatttgcgcatccaaccatgagtggaaggtttgggaaagactgtgggacctttacttagaaagtgaaatgtatgtagaagtctcaagtaccccttctacagttttactggagaaaactaagagccatattcatgacaacttgcacagttttgaggttgagacttttgatatgtgtaagttgcatagaggaggatattatcatgcaaatcatgagcaattatcacataaacttttttagaatgtgccatgaacatggcataaaattcacattgagtgcacagggcttaaaataaagctaagtatgtttattcccaatgccat

SEQ ID NO: 39169 - DNA, 1044 bp, Homo sapiens
tttcattttctttggatatgtattcagcagtgggattgctggatcatgtggtagttctatttttaattttttgaggaacttctatactgttttctataatggctatgtgagtttactatcctaccaacagtgtgtaaagtattccctttccttcacatcctcaccaatacataggtgttgttgttgttgttgttgttgtttgtttttttataatagccattctacctggagtgaggtggtatctcattgtggttttgatttgcattttccttatgatacgtgatgttgaacattttttcatatacctgttggccattggtatgtcttcttttgagaagtgtctgttaaggtgttttgcttattttttaatcagattatttcttttgctgagttggttgaatttcatatatatattctggatattaatctcttatcagatatataatttgcacatattttctcctgttctgtgggttggcttttcaccctgttaatagtttcctgggctgtgcaaaagctttttagttggatgtaatctctgtcatcttgatctaataatcgttaaaaggtaaagcagtaatacagcattttttggtgctaaaatactgtgataactactatacaagtctgtgctttatcttagaatagattatccaaatttgtttggtggcaagattccagacatcaagagtcatctgaaattgtatctcaatgtatttgttactgagttcaaacagtgaaagattttaaagttaaattgcagacaagacattcccccaagtatttgagtctacatctctaaaaaaagtctgtctacataaccactctattttctcttctaacaaaattaacagtaatttcataatttcatgtcactcagatctattcagatccactcaaatcactcaaatttctctcaaatatcttttatactgatttgttaaaaccgggatctaatcaaggaccatgttatacagacattttgtcattttaattaaaaataagggccttacatttatcagtgataaattttattttgttggt

SEQ ID NO: 39170 - DNA, 1046 bp, Homo sapiens
gagaatcatttgaacccaggaggcggaggttgcagcgagctgagatcgcaccactgcactccagactggcaacagagtgagactctgtctaaaaaaaaaaaaaaaaaaaaaatatatatatatatatatatatatatatatatatatatatacacacatatattttctggtatatgtatccatagtatgattttttttttgtaaattcatgatatcttacatttaaaattctcatgagaaactcataaatttcacagaggttttacataagcaaaatattaaatataattggtacctgtttgttatgtttgtcttgctatatcttttaatctttatttggagaaagggtggtttcagaaaactaggcattcatgtcagagagtagcattagcatgctgtgtgacattttaatggtactatgattataaattgtacagaggcattgcttgggagtcaggcccaaccttaggcaaaaaagaattaaagaaaatgtctttaatgtccttgagctttgttttttctttcttcaatccacagaggaaaataatttagtctctcaacaaataaactttagttttgactcatcccatgggtttttccatcttccttggggactttcaaaacgtattcccaagatcccacctgcatcttaaatatgggatgataggagacgagtctgtttgttcccttctttcagctctctgtttctacactttggagcatggatgtctgagaagccacaaagcctattgaacaatctctactaagtatataataaaacaatgcatatgtaaaactctgtatttactgagttactagatattaaacaaaacaataacaaactgaagacaattcacctggttaagcagtatgcattatttacttagatcaggaatagcctatgaaatgttactgaattggttcccatgaacaaagcatagcaaggtgggggtaaagtgagtcaggaaggacctgaccaagataggatgtgtggttaggactttcagagagtttacagtgggtggatttgttagtttcctgggtct

SEQ ID NO: 39171 - DNA, 1101 bp, Homo sapiens
tggctgtgagagaagaaggggagattagcaggctgtgcagggctggaagggcattggaaggcttctgctcttgctggagagccactggaggattggagcaaaagaataccttgattgcattttaaggggtcattctggccactgtgtagagaactgatgggaggggacaaaggcagaaatggggaccagtaagtgggtattgcagtaattcaggatggagatcatggtgactcagaccagggcagccgtgaaggtgttcaggctctggatatattttgaagtaagagccaacacaacttcctgatagactgaatgtggagtatgtgagaaagaggaaagactccaaagtttgtggccaaagtagtcggataacattgacatcaactgaggtgggtaaggcagtgagtagaataggtttgagaacatcacaggttcaatttagggcatgtgaggtattaggtatctgttagacatttggaaagacatgtagagtaagcagttgaataaacaagccttgaattctagagagatagctagagacataaatttcagaccctggcatatcaatgagataaaaactgtaaaactggctggacgcggtggctcacgcctgtaatcccagcactttaggaggccgaggtgggtggatcacgaggtcaggagatcgagaccatcctggctaacatggtgaaaccccgtctctactaaaaatacaaaaaaattagccaggcgtggtggcgggcacctgtagtcccagctactcgggaggctgaggcaggagaatggcgtgaacctgggaggcagagcttgcattgagccgagatggcactccaacctgggcgacagagcgagactccatctcaaacaaacaaacaaaaaagaaactaacattgactgagatcaactggctggtgagggtgatagagaagtggtcaggggactaagccccagggcacaccaactttaagagaggaagcagaggaatagagaccataggtaagagataaccaggggacgggtcgcagaaggatgtgaggcaagcatttcaggaaggactatccccagccaagagcactatctccagtcaaatgctggggataa

SEQ ID NO: 39172 - DNA, 1051 bp, Homo sapiens
atggaaaaagagacccagcactagaatcgcatgctttcccagcctccttcagctggatggctgcagacacttactatggcacactttaaagtgtaaatcagatcatgtcactgccctgcttaaaatccttcagtagcttccactgcaattagaatgaaaccaaactcttcactcagcctgcaaagccctgcacactagtctctacctacttcctaactcattgtcaaagattacagccttctttccatttctggaacaagtcaagtgtgtttctgacttagcctttgcactacctgttttttctgtctggatttactcccctatcttccaaggttggctctttattacccaggttttatcttaaatgttacctctcagaatagccttctcagatccgcccagttgaaagtagtcctttagtcacttactatctaatcagtatactggaaatctcatggtgattgtactcgctgataatgttattgtagaacctagatcagtgcctggcacatagtagatgctcgataaatatttgttgaataaatgaattggatggatggatgaatgaagaaatgaccacatcaaattaactgctaaaagtgaaaagtaagtttgcctcagaactgaaatatttacaaaacattaacttgtttgctttctccatttgtgcccacttaagctggggggaaaagtaaatcacagctgaaacagcaaatatggcaaacatcacatcccattttgagtttgtagcttgcaaggcagaagttcaaaataaaatcttttcaaattacattattgcagaaatcttttctgacctctcagctgagtcactgtttattttataagaaacttaacatccttggaagaatattcgttttttcagctttttagaaataggggtagaacccagctccaaatgtagaggaaaatgctaagcaatgtgtagtatcatgtttgaagttaacttgatactgtagtttcctttcttagaaatagacattgggatttctacatcaggacggttaccttggtgacaaaagttgattcattg

SEQ ID NO: 39173 - DNA, 1021 bp, Homo sapiens
taaatcagaggggatttgatgaaaatcaagtactggacctgtaagctctaacatatgttcttcaaaaactttccttgtgaaatggatacagtaaagctgttttctaccaatttttatgacttagggaactcattggaagattgatttttcaaacatttgccattttcctgaaataatcctttgtggtgatttacaaatattagtctacttagtactttttaaaagattcaaagttcttcttccactctgcaaaaatattggaatgagttggggtgtagtaaaaagtcaatgcaagttgcaaaactctcactgtgccttagccatttcagagacaagaacatttactcactgggctgtgtaccatgcgtttgtaagcaaatgcagtgcttagatcttctttgcttcacttgttttcatacatttcctataacacttgtgtattcttttacatagccgaatgccttacatagccaaacacgaaaatatttttgatagttattatataagatatgggagtaaccatcttattcaaatttttaaaacatactgagttcattttgattgttgagaaggacgctgctagtgagtcagtcagatatttattgaatgtccatcatttattggagattcagtgaggaagacaacagatggagttcctgcactcttagagcatatagtccagtaggaaagaggaatgctaagacaaaatctagaagcagctagtgatgaagactgtgaagttctttaaggagaggtaatatagcacagtggtcaggaacaaggattctggagctggactgcttcagatcaagttctactttcctgctgttaggagactttctttggtcatgccatttaaacctcttgtctcctcattcctcatttctaaaatcagggtgataatggtatccacatcatggagttttgaggaggattaagtggctaatgtgcataaagggcttagttagaacagtgactggcagagtaaaagctctgtgagcattacctctttttttttgag

SEQ ID NO: 39174 - DNA, 1063 bp, Homo sapiens
tagtagagatagggtttcatcatgttggccaggctggtctcagactcctgaccacaggtgatctgcccaccttggcctcccgaagggtagggattacaggcgtgagccaccacgcctggctaaaactccatctctactaaaaatacaaaaattagctgggcgtggtagcacacatctgtaatcccagctacttggggggctgaagcatgagaattgcttgaacccaggaggtggaagttgcaatgagctgagaccgtgcctccgcactccagcctgggcaatagagcaagactctgtctcaaaaaaatatcaaaataaataaataggccgggcgctgcggctcatgcctgtaatcccaacactttgggaggctgaggcgggtggatcacgaggtcaggcaatcgagatcatcctggccaacatggcgaaaccccgtctctactaaaaatacaaaaattagctgggcgtggtggtgtgcacctgtagtcctggctactcgggaggctgaggcaggagaatcacctgaacctgggaggcggagattacagtgagccgatatcgtgccactgcactccagcctggcgacagagtgagactctgtctcgaaataaataaataaatacataaaaataaataaataaaattttttagcttttttttttgaggagaaaaatacacttatagctggcccgttaaaatatagtatacttgacaatgaaaagtaaaaaattctccattttggcttggtagactttgcccgcctttagcagtaaaattgttactctattgttggtttctagtacaatacactggtacagagtgatcactttatttcctaacacgagaattttcagggcctttcctgcctcgaacacacaccagctgtgtgtttagtcaatactgtgtttatctcagcgtgagattcaaattttcctcctaatagcattatcacggtgcaacgtcactttttgtattccttcatttgaatagttcctatacattattatggtttaaaaaataagtctgaaggtggcaatatcctaacactgaaagcagtgtattt

SEQ ID NO: 39175 - DNA, 1029 bp, Homo sapiens
aataaatgcatggaaatattatgagtactatgaatgaaacaagaaacatgagaatcttttttgatgtcttctgtttcattaatcaccaggttgtattaattcttctgcctaaataaatctccaatccatcaacttttcttcatcatcacagtcagtaccttaagtccaagctgctattacctctttttggaccactgatcttcccatacccactcaagccctcaagtccattcttctcactgtggccagagacacctttgaaggcaaagctgatcatagaccgatgttaacagtaggggaacctggctgttgaggtgtatgggacccctcttcactatcttcacaagttatctgtaaatttagaacttttctaaatgaaaaatgtttattaaaatgttttaaaataaggcaaactgaccacacaaatttaagttgctgcttaaaatccttcagtggctttttttttctttttttaaagagaaaatcccaaattcttcaaatgacctacaagacctgtttgacctggccctgcttacgtcctggaacattcttccctttccctgcgccagcctcatgggccctctggtcacacactgtcaggctccttgcagacaagcaataagctgctcttctgctgtctccctggctaactcctcaaccttcagatctgcagctcagatgtcacttcctcaggacgtcctcttaagtcatcctgcattgtcttttggggcacttgtcaattgtcattacgtttgtgttttggtgatttttaaaaacatgtcagttgatcccactgaactatgagccgcacaggagggctgaggccatgtctgtcttgcatatggtgcttagcacctacctggcacatggaaggactcatcagttgttgaatgaataactaaatgatgtgaaagtaagtgttgtgacatttttgctccttgctctaaagactactgtgcccaagcactgcaaatggagaggagtatatagtgaaatttgcttaaaatgataaaaacacaacaaaaatta

SEQ ID NO: 39176 - DNA, 1063 bp, Homo sapiens
cccttgctatctttgcttctcttttcccttttcttaaacttcaaggtctccttacatgcatctttgcagggttgaataaatctatgaattagtgggctactcaggtatccctacaccgaagaagccatcgatagctcaggttatgtcttagattagaatcatcctccccatgtcctttttgcttcataagcaaaagcccactcaggatgttccctaatagtgacagatttggtgaaaaatatgaccaagtacagttgccactgatagtcactgattccatcatagctatccactggtttttcaaccaagtaatatcataagacttggaggctaccgatcaagaacaattagaatattctgcagttgttgagtagaatattgtgtaaatgtctgttaggtccatttggcttaaagtccaacttaagtccaatgtctctttgttgattttctgtcctgacaacgtgtctaatgctgtgagtgggatgttgaagtcccctactattattgtattggtgtctatctctttctttaggtccagtaatatttgttttatgaatctgggtgctccagtgttgggtacatatatattaaaattgttatagtctcttgttgaattgatccctttatcattatataatgaccttctttgtctttattgtttttgatttaaagtctgttttatctgacataagtatagtgattcctgcttacttttgatttccgtttgcatggaatatcttttcccacctctgtactttcagtctacacatgtctctacaagtaaagtgagtttcttataagcagcgtatagttggtagttggatttttttttttttttttttagacggagtcttgctgtgtcacccaggctgaagtgcagtggtgcaatctcagctcactgcaacctccacctcctgagttcaagtgattctcctgcctcagcctcccaaatagctgggactacaggcacagcgccaccacacccggccaatttttgtgtttttagtagagacggagtttcaccatattggccaggctggtctcgaatgcctgacctcgtgat

SEQ ID NO: 39177 - DNA, 1054 bp, Homo sapiens
agttcaggctgggctcggctgtcctgttcttttgctgatcccagctgtgcttgctcatacatcttcggtcagttggtggcttggctggggctggctgacttacaattgctgcatcaggtccaggtgggaagattggtacctctttctataaggtctttcattttctagcatggcaggttatctacatggtggcagtggcagggaaaattgaggaactcagaggccccaagtgttttgggggtttggtttgtttgcttgctgatgtcccattggtcatttcaagctaatggtcactccacacctcatatttaaaaggtggggaaatagattctgtttcttgatggggatatctacaggggtaattaagaattttagaacaagaaatgtttagctgtttaccatattacagccttagtgaggttgatgtgattttcatggaattgaacaaaagaaattatttggtctaatatgtcaatatttatttgtgatgtttagaaactgaaattaaggattacaacctggggaaaatgttgactctagaaatagatttgtgagtcctctagttagagatgacagttataagacttggccaggggagaaggtttagaagggagaagaaaatataaataatgaacagattatttgttcaagtgaattagctaaattaattataactaatatttatatattttttctgtgactatcactgttacagtatttcctagaattcagtgctaagggcatatctgatgaatatcaataacttatttctagtggcaatcaataaaggccagaaaagaacccgtgacatgaccataaaccaatgaggaatttgaaagattttccaccttgagtatttaggagctctagcaaaatctgttgactaaaaaatctctcagaatagctgtttgccagaaatttggcaagttgagccagagagtgatttggttgataacctgctaatagtggtagatgttttatgaaataaaataacaatgcattttcttagggtcaaaaataaagattgaggttgtagcccagctacttgttgtga

SEQ ID NO: 39178 - DNA, 1024 bp, Homo sapiens
tgtgctcatttagtactgccctgaggtagaggaagaaaaacattaaaaatagttggtcttgaatacaatgaacaggtttaaaaatggaagctctagttctatgaatcttactagtttaccaatatattattacaggaagtgtaagaaactttcctttagaagatgtcaagatagctgagaaagcatttctttctgggtacctaaagataaccatgtcatcaaatacatggtaatttttatatttaatgggatacctttttgtcatattcagtctttacactcccaacttcagccaaatgggcttcttaaattaatactttttttagctgagtaagcatgcttaccttttccctgaataaaatgcttactgcaataagtcatatccagtagtatatgtatagtattagcaactaaacactaaaaacagtgctggcattaaaactaaaaaaagaatacattagatatttggaaagttcttgtctgtttacagcactgcgttatataaaatccagttcctcatgcatgcactttctttcatgagtctaaagtgaatgatgtaattttttaacagagattgcatagtggtatgtttctcagtattcaagagagtttatattaagtgtgtagttcagctctcaaaatagctcctctttcatctgtaatgcttttaaggcttaaaactcccccataaatttaaaatggcagagcttatagatcttgaagatcaacagttataaagatttctggggaaaatgtaagatttaaagaaaactgttaaattatgaagtacaaatgatacacaatggagagtttggcttcatcaaagtgaatcactgcactcatttagatgtatcttcaaagttttaaaaccatttcatcgcatgcaaaagtagaagcatttcagggttaaaacacctttcagggggtaggtagggtctctgtcacccagactggagtggcacaatatcacggctccttgtagcctctaccttcccaggctgaggtgatcctcccatgcctggag

SEQ ID NO: 39179 - DNA, 1047 bp, Homo sapiens
attttttaattattttttgtaaagacagggtctcgctatgttgcccatgccagccttgaactcctgggctcaagcaatcctcccaccttgccctcccaaagcgttgggattacaggcatgagccaccaggcctggctgaaggtgtgcacttataaaaactcttcaccgtattccaacatgttcccagacctactgttgacccagaactaagctcactggctgttgctcataagcacttcctgtaagggatacaatgagagtgttggttgtcctgtggttagctcctgtgatggagcaagccactccatggtgtgccctattatcagttcctgagcctaaatccatggatctacatgaaggaaatcaataatcatttgcttgcttgataaattgtaaattcccaaagataagtgattgcttcatgagcataagtgaagtgtctctggagatgtgcacattcctgcaggagcacgttccacctctgcttctgttggggctcctagaaaaggaagctcgtacgctattaaagacatctgtgcaattgcaaacctttccacacatccaagagtaagaatgtaaagtgcagtctctctaatccttctgcaaggtatctgtcaaaaggtgtcatcagtgaaggaaacctcagcacatttgggaatcctccatctctacttctccccacttgccgcccccttacccaatacacaagccttggtttagttcagggctctgtgacgtgaagaggcagcagaggcacttaggagcctgttagtgagcagggtgttatgtggtcaccttctcatgcgatctctctgtagaaggacttcatgaagcaggtgcagaccagcggcgtgctgatggtcttctctcaggcctggattgaggagctctaccatcaggtgctcgacaggaacatgcttggagaggctggctattggggcagcccagaagataacagccttcccctcatcacaatgctgaccggtcagtggttcgttgcaaggccttggggcacgtggtagggtgggacggctcacgctttaaagc

SEQ ID NO: 39180 - DNA, 1069 bp, Homo sapiens
taccataattgctttttgctgcttatccaagttggctgtgaaaatgttttagaatctggaaagtaatatacaggtgtcaggtggaatataatattcatcactgttttcttactaggaaggagggaggagaaatggtcaataggacccagaaaccaaatggtatcaaaattggaagttacaaaatagcaagaaaaatatatttgtttcaataatttataaatgtttaatccgctaattcccatcttaaaacttgcgtgtctcattttcctctttcaagaaggactcatgattccatttctattagagaccctctccctgaagcagctcatggtgcccccacagcactgtttgccctgcggtgtcactaggcttggagggcagatagcagggtgacccaagagccatggaaggctcacctggcacattgctcgttgtggcctcataaaacagatatttgatctttaccattcttcattcccgtgaccttcaaatcctcccctaaattctgctactgtgctccccgccttcctaaatccttctgctggcaaggtctgtgcccagctgagtgggaaagaaaaagaacctgtaagacccatcatattggggaacattctttcttccaaatagatacttgagttcccatcacatccaggcctttgggtgtgtatgaggccagtccccgccctggaggggggcttacaggatctactcttagctgtttttgtatcttttccagcattatactcataaattatagacaaacaaaaccttattcattaatttactggggttttttgacatcatttatgaaattgaagctaattctgaagattccattcccagttactcagtttctgggaacaacgccttgccatctttcagcttcttgccaagcattttatgagtgcctaccatagcggagctagaccatgagggcacaaagatatttttaaatatattctttgtgcctttgaattaaaatctcacagttagagcagacttgtacacagttagaatagatagaataataccatacatttgtctacagtgtttacacagcatttccatt

SEQ ID NO: 39181 - DNA, 1037 bp, Homo sapiens
ataaagatgacagctccagtgacaagctacgtggagcctggttcaggtccttttagtgagtctaccattaccatttccctgtatattccctctgaacagcaatttgatccacccaggcctttagagtcagatgtcttcattgaagatagagccgaaatgactgtgtttgtacggtaagtggtagataatttatagccttgctgactgctagttttacttgcgtgcactcacagtttagctccaatgcaatttcaaaaggctttttcacccttccataaaatcaggtctaatgcattttgtgatgttttcctactggctttgttgtatatgttactgaggtctgtcacaagataataatcacttcatttaatgagtctattgcatgcccttcatataagacacggtgcaaattatatgctcccaaaacaaaagactgcaatatagttagacctgaacaaaaataccttaaaacagaagtcttagtttgttcaggctgttgtaacaaaataccgtaggctgggtagtttatgaaaaacagaaatttctctctcacatttctggagacaaggaagttcaagtttaaggtgctggcagtttcagtgactggtgagggcccgtttcctggttcatagatggaaccttctcagaaatgccctcatgtggtggaagaggcaaggcagctttattggacatgttttacaaggctctaccctcatgacctaatcactttccaaaggcctcatctcctaatactatcacattagtgattaggttttcaaaatatgaattttgaggcccagcactttgggaggctgaggcaggtggatcacttgagcctgggagttagagaccagcctgggcaacatggcaaggccccatctctaccaaatgtatatatatatattagccaggcctggtggcacatgcctgtggtcccagctacttgggaggctgaggtaggaggatcacttgggcccaggaggtcgaggctgcagtgagccgtaattgcaccaatgcactccagcctgggtgactga

SEQ ID NO: 39182 - DNA, 1094 bp, Homo sapiens
aaaaaaaaaagtcctagtcatttctaccaactcgaaagccctctaataagcagtctctgctctggagctttttggtgggctgctagagactttgttagatcctaccgttcctctgctcaatcctgcttttcccttttcctttcagagatgtcacttcaccagttttgtactcctaactccatctcagcctaaaattggcacaattggtaccagtggcccacgaacgtaggtggtaagacagcatttgcaggctgagtgactcactgtctggctggctcggaggcccccatccctggtggataggtggcacagacagtccctggcacaagaaggctgtccagtgatgaagacttcagatgaaatggcatgctggtgcaggggaacgcaatgactggtgggtgatttgggtgtctcaaatatgggaagggtggataaaagagacaaggacagtgggcttccatggttattgctgagttggattgacgtcctgcaagtggataatgaaaagctgaggtcaattaacaaacaaaactaagtgtgagccgcagagtctctgtggtagcttgccaacaatcctcatctcatgctgtagccaagcagagcaagctgaaggccaagcacaggatttgatggtaaaagtagctaacagccaacaaatactcaaccaagccaggtctgttagatcaaggttggaatcaaacttgggatcccaaaacatgggatgggagcatttagtggatctccccaaccatctgcctccctagaaaactccctgaatattcacatccttcagaagaggcccacccttccccatgaagagctggaactaccctcccttcctgcctcttccctaacacaagggaagacagtgtccaaggtctttccccatgaagcaaaaggtgtccctcaggactggtccctccccttctcctggctaccaggcctataacgagacttaagtcacaacataactgattgcggctgaggggtctgatgagggagaaatgggatctatgccagaggagccacctaacctggcagcatgtactgcaggggccaggggcgtactcttgggactggatcctgagggtgct

SEQ ID NO: 39183 - DNA, 1743 bp, Homo sapiens
ggaaagcgccggctgctccttccctccctccggattggagagggaggaggaagcgagggaagtgccgccgacaccgggcgagagggaggggaggcgaaagaaaggaaagggggaggagaaaagggccggcccgggaaccacctgcggctcccgcggctgccgcgcccagcgcccgcagccagtggcggccccggcgcctcagcgcaccctgtcggggcgggtgcgggcgcacagtcccgggacgcccacgtcgccgccccaactccccttggcagcccccgggcggtggggcagagccctcgcccgccccccgggccggggtgcagcgcagtgcgggcgccgggagggcggaggcgccaggacggccgcggccagctccgctcgctctgctcacctgcgcccctgcccacggcgctccgcagtcaggagcgccccgccccgcggggaacgccccgggcccctcggggtccccctgctctctcctacttcccttctggaaggtggccaacacttctgggccgcccgggtggacctcaaatagaacgtctttaaatgtccggtggccaagggttctgtagccgactaggagtcagcgtccgactcggaacaactcaagacctcttttcagggggcgtccagtgagtttttttcagcaaggtgactccccctgtggctgcctgctactacagctggaaaggtccaagctgaaatgtgactaatctgagtttcttccaccaagcatgttagttaggggtggaggactagaacctagaaccctgaattcgagcctggaagatatgtaagccacatgctattgagatcgtggtcatgggacacccgctaacacaaaccttctggtaggaagtttttgagaagactgggtccaatatccccaagctaaaatcccactggcccatcgctgtgtttgctcagaaaaggaatctgggttctttggtttctgctttccagttgaccctggttgctcctctgttttacggcattttgggagtcggtctcccagagcagcgctgattgtaatgagaagcgcgttccctctctgggggacaggagcagtgggagaaaaatgggcctgggaaagagctcctccaaataaaacttattagacagatacgggttatggtgttggtggtggtggtggtggtgttttggtctttatcctgttgtacagcgcctcattttttacaatgtgggccagtaactatttcgtatcacctactctgaccaccttcagggttgttatgaggctcaaaggaacggctgctgtgaaaaaacatgctttgcaatttatgaagcactggataaacatcaggaacggtataaaagcatgctgcttactcaagaaatactagttgagtgcctgtgtgttgggcactggctagagataaggtaatgtgcaaagctggctctgtccctgccatcatgagactctcgtgtagtggaccatgcataacatttttaaattatatacaatatggccgggcgccgtggctcacgcctgtaatcccagcactttgggaggccgaggagggcggatcgcctgaggtcaggagcttgagaccagcctggccaacatggtgaaaccccgtctctactaaaaatacaacaattggccgggcgtggtggtgggggcctgtaatcccagctactctggaggctgaggcaggagaatcgcttgaacccgggaggcagaggttgcagtgagccgagatcatgccgttgcac

SEQ ID NO: 39184 - DNA, 1054 bp, Homo sapiens
agcctctgaagcttctattgttctcatggtaggtcacctagatccgtcctctgactctcatcttttcccatatgatttctacctctttatatttttactgtacatttacatacataaacacaaacatacatacatacacacaaacacgtatcttgagatatttctgtttcttccacttgaccttccaggttactaatgttgaaaaacatgactaaaatagaggaaatatgacatattttactgtgaagaaaggacgattttgagagagccataactagcttcaacattagtagtccttaacataatgtcgtatagtccatttatgaagatgttataaagctggctagaggaaactagcataatttacattaattcatatttatttaggatatgtacttcaactttagctgaggtatattttacctgtatagtacctttaggaaaaacagaaaggttttttttttaaaaaattctactatcaagggattgcagagtctgtacttaaactgaatgaaaagataatacgttatgtgtataaattagttgctctgggcagataatgtcacttcagaggactcttggtcaatatgtaatgtaagacctattctttagcaattaagttgtcttgacaactgtgtgtacaattaaaaatattacatagtgttgctcatgcttcatgccatttttcatgcttcataaatatttttatttatatttcttaaaggaagaatacataattggttgaaaaaatgattcacatttgaagtcgttattgaactttttttttttttttttttttgagatagagtctctgtcacccaggctggagtgcagtggtatgatcacagctcactgcagcctcggcctccttgagctcaagccatcctcccacctcagcctcccaagtagctggtactgcaggcacacaccaccacacccagctaattttttttttttttttttttgagatggagtctcgctctttcgcccaggctggagtgcagtggcgcgatctctgctcactgcaagcttcgcctcccagattcacgccatt

SEQ ID NO: 39185 - DNA, 1023 bp, Homo sapiens
ggtaatcacaggttgttgacaagtttgtaaaattatatattttaacagaatgagtatcttttaatataactaataaaggattggaggtggagcctgccatggaccctcaattgtggtttttcaatgaagcagagggcacatggcacatgctgcttttctgcccaggatgacagtgttgcaggatccaagactgctgtatggaaagcctatcttaattgtgggcagcagcagcccagtgctttctgagccatgtgaggttactaattgaggttaacatcagagaactagatgccagtgggagggattgggaccatttgagcaagtaagattttctctagaggcaggggcttgtccctatggtttatttttcgtacctaggtagaaagtgtatatctctgtgccaagttgtactaattatcttggtttgtcattttatttttgtcaacatcttaccagtttttaaaacaataaactctggtgaggggaaatgctattttgtacagagtgactgtgtgttttaattttgtatatttcagaaagcttccagttttcagtggttagcgaaatagcaacttgctttatttaatcaacaggatgttttagcttaattgtacttgagagctttttataaactagcaaaaagtcagtagcatttctaatactttaaaatgttacaatttttcagacaaattacttttgctaaattgtacagatgaggataatacttgaaaagtctaagagtgagaaacaagaaagatactaagaggaagcttaaagaaaagtgaggaaaaaggaagatgaagtgttcaatgtagtcatataattgcttagatagcatttaatgagaaagttagcattgttctcatatatacacgtaatatagtgtatttcatagatttaaatagtcaaggaggaaaaactttctctactctcttaggcttagtgattgagggtctgcaaattaaattgacaagagacagattgcaagataaaagacatttaatcatagaagaatgtgagcca

SEQ ID NO: 39186 - DNA, 1030 bp, Homo sapiens
ggaccagagttcataactagcatgtgattatctttagggtaaagtcctagcagtaggatcactggtttgatacatattgccaaactgctcctacagacgaggtttgccagtttacaccatcagtggtggtgcagttccttcgcactctgtaatgtaaatttcgattaccattttcatctttgccaatcagatagatgaaaaatcacatctcattgtcataatatttgcattttttggatcatcagtgaatatctttttatatttatattgatcatttgtatttttttcttgtttgtgatttttgtccattttactaatagggtatttgtgttcttactgattttcacaaagtgtttgcgtattcagggtactttttgacatacgctttccctaatttattgtttgcctttcagccttatttatggttgtctttgctggttagaaattttacagttttgtatgattacattaacatccacatagaaataaaggtaaaggtaagggagtgtgaggaaagttgtgaaattacttgtaggcaaagcagtttgggcatggcataaagttagcaactttgagttcatttgtataccagtgcacagtaatgctattacatttatgaggttgtgtttactttttaatttggaaggctctgtttctcagaattggttgcaacccgccaggtgtggtggcttacgcctgtaatctcagcactttgggaggctgaggcaggcagatcacttgaggtcaagagtttgagaccaacttggccaacatggtgaaaccccatgtcactactaaaaatgctaacattagctgggcatggtggcgcatgcctcttatcccagctactcgtgaggctgaggcaggagaatcgcttcaacctgggaggcagaggttgcagtgagctgagatcatgcctctaaactccagcctgggcattagagggagactctgtctccaaaaaaaaaaaattggttgcaactcctgctgccctcccttacctcctctccgagtctctggccactcactg

SEQ ID NO: 39187 - DNA, 1032 bp, Homo sapiens
catattctgggtccgtattcttttgggtcttgacgtgtcttctattagacaaggaaaatatgaatcttctactttatagtcattattgatgtgatttcttactgagatcagagcgtcagagccagaatggaaataacaggtaaaatagaaacctagagttttttatttagtttgaatttgaggctgggtagacttgtgggttttaatttcaaagtaagaaaagggtgggtctaggagaacagactaaatatattaagagaatgttaaaaacccaagttgtaaactgtattgaagcattggatgtgtgtgtgtgtgtgtgtgtgtgtgtagcttccatgtttattttgacagagtggtttgcctgagtaaaagcttttcgtttaaatcctactgtaagcaaagaaaaacatgtttaactgaatgtaattgccttgtgctcaatttgctactcactttggagcaggttcacacactaaaataacataaggggaggttaaattacatcaaaggttaagacagataagcttaagtgatctcattgtagctcctatactaattaaaacaagttgacaaaatatttttgtaagtactagccttcctttatgtgtagtgcttagtgtctttatttttagtagaaaaaaggtcttaaaaatatttgaggaaatttatattaaaaccttttgagttttcatttaaataatacttgccggttaatcaggaaatgattctttaaatttctttttatttttaatttttgtgggtacatagtagtatataggaaatgattcctaaacaccctgtgaatttgaggcacagtgtggagcatcagtgggctgcagttagcttctttgtccactcctgtgtcttacctaatttccatgttacagccacaggaatgggccaaggctgaagcagagactttaccctagctggtgatcagatggaaaagcaaggctggggcctaattacaggagctccttgaacatgacccaagaacttggagcattagtctgagtttctgaggtttctgaa

SEQ ID NO: 39188 - DNA, 1019 bp, Homo sapiens
tatgtagagaggtgggccttgaagcagtaggagtggggaggaagtttactagatgccaggtgctttctcagcatttcatgtgtatagtttttttcatttcattcttctgaaccatttaaggtacattctgttgttttctgcattttatacagaggaaactgacacaaagagaagttaagtaagttgtccaagagcatgcagctcataaatggtcctgcctggattccaactcaggcagtctggttgcagagtctgaactgtgaattgctgtcagtggctgaatgggatttggacaaatgaagattaaggggaaaccacggtgatcaaatattaatacatagaggtagacaaattggtttagggccattttgccaaggccctggaatcccacacctgaaggggataattgtaacatatgacagaactaatatttgtataggctttatgggtccacattgccaccaccctctgctgattgatttggtggaatgttgtgtctgtggttcagtgtgcagggataaggttgggaaggttgttgagtagaggagtcacatggtttgttccctctcatatgtctttaagctgtcgtgaggttttggcctgtattccctgagctcatgaacatggtgttaaggctcagcctctgctgtcttctgtaccctgcccatgctctttccctgccctacagttaccctctggaaagagtttcctggagtctccctgtttctgccttttcacctcactgtctacctctgacctgccctccatcattcccgctggagctgttctccgtgaggagacagtgcctggctcactgctcattttggctgggacttttcaggtttattgcatccagtgaattcttaactcggggtgattttaccccctaggggatacctggcagtgcctggagacattgagtggggctggcctctacgggatggacagtgaggttgctgctagctgctagacatcttacaggatggctcccacaacagagatccagcccaaatgtctgt

SEQ ID NO: 39189 - DNA, 1079 bp, Homo sapiens
acaagacagattgctctattttggtgtagttttcaccagtgttgtttttttgttctagtcaggtgctaggtaacatttgaatatttcagcttcgcccagtgacgcggtgattttttactctgatgtcacagtaccaagtacagttgtcctagcggataattttgtgtgttctgtaatttgaagaaaggattgccggtgtatggttttgcataatggggaaggaaattagtggagttgttgcatatttgtcacttactgtaaacctgtttaatgggcccatctagctgtgtatcctcttagatccttataaacataacagtgaggaaaagcagtggtcagaaaagggccaaggtatttttagattagttgaattaattttgaagtttatgaaagatgagagtgtgttgatagcagcaaaaggtaaacaggattattgaaagctcagacattagcccggtggtggtggtggaaggaggggcgatggggaagcttattattcctgtggatggcatataaggatttggtacatttcagccataaattgaatgacacgaggttggttagtataagaaatctgtcagttcatgtacaactactgaacttccataaagatgagacacatcacatataacatgtttacactttaaatgtgtgctaaaaagcttgttgtgaaaatgatatatccccacctgtctccttcccaccaaccctgctgtgtcagtacccagacaaacattttcaaatcttagctgatgcttcaagtttttgacatcgtgattgtaaatactgctgtcttcattctccagctttacatattatctgtttattgactggctttgaaggtggatgactgtgcatccccctcctccttcctctcaggataagataccacaattattagttaaatccttaatgtttactaatgtgaatatatatatttaatattgagccaagaagtatagggttttatcttattatatagtaccatatagtctaggactccttttgtttttattagggttaattgattattttgatttgcatagtttttttttttttttttaactttggctagttct

SEQ ID NO: 39190 - DNA, 1053 bp, Homo sapiens
taacccacctaaaattttatagtgaaacctgctttatattgttgttctgaagcttacaattgacctatacattgcattcagcaagctcctgaatttagaactgccgtcagtgtagtgtatgctgtgttccatgttgcctttttagatggctttctaccccctgaacaataaataggatgaggttttactgtaattgggtaaagtttactcttggacattatttcgatgctaaagtaaggattctgtggatgttacttaaagagaaaagcataagagcatgaagcatatctgggaatatcttttgcctttaagacgattcattcttgtctagagggaaaatctggctgatttgggaataaaatataatcgaatattcaacaccatgaagataaatcttattttggaaatctactgaccttaataccccaagcttgccctgaatactttgattggaattggaatatatcaaaaaaggttagtatttttgttgtagttaggatactaaaaggatattagttacccaagagatccaatttgtttttctgatgaatagtgttcagtaaaatgaagcagtcttaagagtgactaataatttcaaagtgatttttcgtctattcttaatattttttaattatttatttttaagagttttataccttgagcagatacaatgatctgctttagtgagaggacaatttctgattgattgttttctcttcaggccatctcacctcttcattctcttgttacatttgaagcagttgatataatgggtttatactttaaaagatagacatggtgccatgaagttggggagttgggtgaattatcccattctagttacagaggagctttccttaaatgccctttaacttctaggttttgttcaagaagttcattttctgagtaaaaggtattttcatatatgttgggggaaaattaactcatctaaaaagaatcttattaggtatttgaactctaaaactaacagataagacagatatgtaccttattagagcaccagaactaatttgctaagtcttttgtttagtc

SEQ ID NO: 39191 - DNA, 1050 bp, Homo sapiens
tttgattttcattacatcatttaataggaagtcaggagtggctttttcttaaaattgttgttacgacaggagttccaaaagtatttatttaacgaagggatgagtgaagtaagtattctttattagcaggcattcattcatgcttccttccttcccccccccccctttttttgggtcaaatagtgtgcctaaattatttaatttggaaagtagttagatatgttttgtacaaaaactgtataataatctttgacacagaaatcccttcacaaaggataatactaaccatatagaaaagatctgcaatatatttaggaatagaataacattcagttctattttttggaataaaatttgcttttgtgtatcaatatgtattctattgagtgccacattttttaacctatcaaagcctcactcctcacagttgcttttatatctttttgcgtgtgtttttatcatgcgtatttcatagttttatgttcttatggataagcaaggatgtgttagaatgttaatgttcaaattctaaggaactttggattacatataccttcagaattagtaaatgtttgttttctaaatgtctcacattaaattaaattcaagttggaaagtatttaatccttttgcaaatatgcctcattactcatcatcaaataatatttattcataaagataaacacatttccttgatgaaataaatcaaatatattttcttatagatgattttagctaaatgtttatttgttctgtttttgtaggtattttccatgttagacattaatttttcatcgtattgctgctgctagaatgaattgcttgtctcagagttctttatgaaagagatccttttttcatccctgtggcaaaaagatgttttagtgtacttaaactgagttttcttaagtgaattcaaggaattttcctttttattaatagtagaaaatgtatcttatggtaaattttttgtacttaagaattctttgcaatgtaagatatttagaaatataaaagccaggccaatttttgtcctaaatcttttaatgc

SEQ ID NO: 39192 - DNA, 1007 bp, Homo sapiens
aatattattaaaatgacaatactacccaaagcaatctacagattctgtgcaatccctatcaaaatgccaaagacattcttcacagaatgacattttaccaaaaaaaagaaccctaagatttatgtagaatgatagaagaccctgaatagtaaaagcaaaactgagcaagaggagcaaagctaaaggcatcacactatgtgacttcaaaatttactacaaagctatgataaccaaaacaacatggtactggcataaaaaacagacacatggaccagtggaacagaatagagaatcctgatatacatttatgcatttacaaccaacttatttttgacaaagatgccgagaacatacaatggggaaaggacaattttttcaataaatagtgctgggaaaactggataactatatgcaaaagaatgaaagtaaacccccatctctcatcctacacaaaaatcaagtcaaaatggattaaagacttacatctgaaacctcaaatctaagacctatgaaacttatagaagaaaacattagagaaatgctccaggacattggtctatgcaaagatttttttgtgtgtaagacctcgaaagcataggcaaataaagcaaaaatggccaaatgggattagatccagctaaaatgcttcagcatggcgaaggaaaaaatcaacaaagtgaaaagacaacccatggaatgggagaaaatatttgcaatccatctatctgacaagggattaataaccagaatatataaggaactcagacaactcaatagcaaaaaacaaataatgcaattcaaaaatgggcaaaagatctaacatttcgtatatgaagaaatgctcagcatcactaatcatcagagaaatacaaatcaaaatcacattgcattatcattttaccctagttaaaatggctcataccaaaagacaggcatagagaacagtgcagaggtttctcaaataactaaaaatagaagtaccatatgattcagcagttccaaaggaa

SEQ ID NO: 39193 - DNA, 1050 bp, Homo sapiens
cctgtttctatccttatagggcagtttttttctgtttatgatttgtctgttctctttgaattttgtgtgaatactgtttctttgatcattgttttattttctaatgagtttatttctttaatctttgttgtcttttatttatttacgtagcccatattgagtgatgagataactacataaatcgcatttaaaaagtggtagctgtttcttctactgttgaataaatatacagtacttctcttttcaagttttcatgtagttatttatggaaagtacagactttgctagtttcattcatcctcattttattagcatgttgcaatatgaattaggaattgaaaattcagtttttagactatgcagtttaatttacttgatatgaaagttaattttaattacagcatttttggaattaaagtattttttctagttacatttttttgaactttgaaataagatcttggtggctgttgaaaaaactaaattttctgtaaacagcaaattatatgaataagccaattagaggctgaggaatgtgaatgatatctaaaagtaaactgtttcttcattttctggttttgtcactgaactgagcaaatttatttaagtccgttctattttattctttgttttctcctggtgtatgtattaggcttattatgttttcctttagaataaagctaaaatgtcaattaagaaaatcataattcttgaagtcttatgtatttattacttggaatttaatcaagatttattaatttcatatttataatatatattatcataaagaatacattttaaacatcgtggaaatagattatctgctaaaattgcttattcacgcatcaagaaattaaacttgtattgagatgtgaaaacttttttttccaagcctccaagtgttttaagagtttcagttatttacttgcaaaatccctggcacttatttaatggcttcaaaacagaacagatctttcagtgaattttgtgtgtgtgtttgttagaattttattgtaaagccattttccttattactgtcattattagagg

SEQ ID NO: 39194 - DNA, 1037 bp, Homo sapiens
cagctgtaagttctcaccaactggagtggcgaagcttgtctttaaacaatgacttaatccagggatactttttcatgggccattttaaaaattgttaagctatcatagtcacatctatgttcacagctatcattatattcattatgtttgcctcatcctgaaatatggcttgtatgcgaatggtaagcagtagatcattttagagagagcttttcagagttaattatgagaagagtagagcacctattccttgaaattagcacagatatttaggaaagaaaacttgagctattctttaatttcacctagccttgaatagcaaatatttcacatattccttcttattttttaacaccacaaataaattactactataatacttattaatattcatagtttcataaataaaatgtcactgcctctccactagacattccataactagtttaaaaacaatactaccactttgtctttggcgtgaagacagtaactgatctcaataatataacgtcttatcttattcatttctcctctgaatatgaagaagaaacaatttttttgtgaatccagagctttcacatataagcaaaagaaattctcctctacctgacaaaataatgttacttacttttacctcagtgttaaattaatagttttgatttctgcttttgactatagctgtgattgtagtggaacagaaaattatattactttaaattgtagaaccaaaagtttttaacagggctttggggatacatttctttgcttcccatagaggtatttcctttttaaagaccttcaaagtcaaccattctataaccttcttaagtaatatgctgaccaatcacagagtcgattttaagtatttattttgtgaaactttttaccataaaaagtatttgcaaatgcctcatggagatagaaaatcatttgttgctattctgaagaaattatatcacattcatgaatagtaacacttttatagtgttagtaaatataaatagttaatttctaatagttagaaatggtaatttcaa

SEQ ID NO: 39195 - DNA, 1049 bp, Homo sapiens
tcacgcccgccctccttgccgcccagccggtccaggcctctggcgaacatggcgcttgtcccctgccaggtgctgcggatggcaatcctgctgtcttactgctctatcctgtgtaactacaaggccatcgaaatgccctcacaccagacctacggagggagctggaaattcctgacgttcattgatctggtaaggccgtcccctccccctgctcgccccgcaccccgtgcctgtgtgtgcgtgtgtgtgtgtgtgtgtgtgtgtgtgtgtggatgcgcgagcacctgcgcacgtgcgcgcctccagcatccacccgtgtcctcgcctcttccccagtgattgcgtgtgaaggcctggctgcccccgcagcggcaccttctgaaccactcaccgttacctggtagctgggtacccttacctggcaactgggggacaaatggaggtggggcgcagccaggtggtgggctctttggagggggacaccgaactgcttctaagaggtgacacgggaagaatcttcaacaaaagcatcggacctgatcctgaatggcctgagacccattcgccctcaaggtgcttttcagagcacccaccgtgggatgaacttgttgcaactgaaggaaactgggtattgtctagtgatttggaacttcacctgaaagaaccaaatccttctcataagggagagaaagcacctaataaagttgtcttctttgcatctgtttttttcccccattgtcaataatttactttcaacctttaccccgtacatattaggagacagagatgttcaaagtgcatttccaaggtgactgtacacacttctctgtcttcccatgtacaaatttacagtagtttgcataagcagctcctctgttggcacaatatgataatcttgacaggtgcaggttattattagtatatcattttgaaagtttttctatttctggcactaaaaggccctcttcaacctccctggagaacagaacatgggcataaggcccaataatgaactcatggatggacctaggaatttcagggtaaaggtg

SEQ ID NO: 39196 - DNA, 1059 bp, Homo sapiens
tgttggaggaagatgtgactggaagaaagtcagagagagatacgacaatgctgggtttgaagatggaggatggagccaggagacaaggggtgtgagaggtgtctagaagctggagaggacaaaaaaatggttttcctcctagagtttccaggaacacatacctgctgacagcttaatggtagtgtattttggacttctgacctccagaattgtaaaataataaatttgtgtcatttaagccattcaattgatagtaattggttaccacagtaatagaaaactagtatacttggctttaaagcctctgacttagaaaaaaaacttaactctttttgtacttatatgaaataaatgcagtgactcagctagccctttatgtatagtagataactggttaattttagctttaacaaaaatgcaagttttttcctacttcatccatgaaattatgtggaggagacatacatatgtgtaacagtgggcaatatgaggatttgtaaagactggactgtcaagcgtgtctgtgtgaagagaccaccaaacaggctttgtgtgagcaataaagcttttaattcacctgggtgcaggcggactgagtctgagaaaggagtcagcgaagggagatggggaaggggttgctttatagaagttgggtagctaatggaaaattacagtaaaaggtggttatttattgttagcagagaagggggtgacaaggtacatggtggggagatcataagacttattgtccagaagaagaatgtcacaaggtcggttgatcagttaaggtagggcagggacaagtcacaacggtggaatgttgtaatgttggttaatcagttaaggcaggaattggctgttttacttcttttgtggtttttcggttgccccagacttcttggctcctgcaggccatctggatgtatatgtgtaggtcacaggggttacaatggctgagcttcggcttagaggcctgacatggacaactttggaaaaactaggtctttactatgaagtatttcagagactatcattaagtaacatgtcaggccaggagaa

SEQ ID NO: 39197 - DNA, 1050 bp, Homo sapiens
cttggggttttaggtactcatgctaaaggaaaaaaaaagagggaatcataatctctagcagagattatgatagaggacttttcctctatcctcagactggaaagaaggggcttctcctggagtttttgctgtcagtgtttgcttcccagttctagaatgcagtctgcactcaggtcaaataaggggaagaaaggagagtaaaaatccacaaactgtacccttatgggtccttatttatttttgctttagttcccaatgcacctgtcattgtgtaattttcaaagtcctcaggcagttgatttttgtactctgttcagagttcttagttgtaatcaatgggattgataggctgtagtcagcttactccatttgggctggcaccagaagcctacatatgttttcaatatctacttttttacacttaaaatattttataaacatttttccgtgccattatacattctcccataacataatttttaagactgcatattcattcgagtgtttatattgattgtcttagtgaatatatgaataaataaatctttacacacatctgtgattattttcttaggatagattccttttttttttttttttttttttgcagttgcaagatttaatagagtgaaaacagagctcctatacaatgggaggggacccaaagggggttgccactccgtgctcaaatgcctgtgtttatatcccgatcattatccctgccccatgctctctggcgatatatgatttgactatttctttacctcctctttttagcctaatttgtattttagtgagccctctttatacctgattggctgagtgtgagctgagttacaagccctgtgtttaaaggtaggtgtggtcacctttcccagctaggcctaggaattcttagtcagcctaggaaatccagctagtcctgtctctcagtcccacctctcaacaggaaaacccaagtgctgttggggaggttggctgacaaccgctcttaactgcttcatgctgaattggggcatagtaggggtcgtgcagttgagatttccttgg

SEQ ID NO: 39198 - DNA, 1042 bp, Homo sapiens
tggctttctgagtttccttaattagtgtgtataatggcctggctattttgccatacctgttaatccatatttggcagaagcctgttatgccaaggaacattcttaattgcttcagggttttgggatgaggataagccgatataggctggatacgttcctcactgagggccctggtgcctttggataattttagccgtaagtgtttaacctgctgtaagcagagctgagcctttggtttggaaaccttgtagccacaagtggcgaggaagtttaaaagcgcttgggtggcttgatggcacaaggtttctgaacgggcagctagaagtaaatcatccatgtaccaaaggacatgagtgtccaagtatgagaactggctcaagtcttgggctaatgcctggccaaacagataggggctatccctgaacccttggggtaaaacagtccaggtgagttgagacattgggttcaaaggatcttcaaaggcaaataagaattgagagtcaggatgtacagggatgcagaaaaaagcatccctaaggtccaggactgtaaaccactctgcttcctctagtatttgggaaagtggagtataagggttaggtacagctgggtatagagggacaatggcctcattgataatcctgagatcttgcactaacctccattgtccattgggtttctgtactcctaaaattggagtattgcaggggctactgcatggttttactaggccttgggcttttaggtccttaacaatcttttggagtccttgctgggcctcgggtctaagtgggtactgcctttggtagggaaaggaggcagaatcctttagtttaacttgaatgggatgagcattctttgctcgtccatattttccttctgttgcccagacttcaggattaattccttcctcaagtaggggacaacaaacgtgtgttccttctcctatgttcaggtgtctaatggcccctgcttttgctagaatgtcctctctaacaaaggagtggggctttcaggcataattagaaaggcatgtgaaaag

SEQ ID NO: 39199 - DNA, 1050 bp, Homo sapiens
gctgtgagagtcctagatggcatcttcttctaatagaaggttgttttgtctacattgaaaatctgttgtttattgcagtcatcttcagcaatgatcttagttggatcttctgtataacttgctgcaacttctacttcagcacttgctgcttcaccttgcagtttatgttatgaagacagcttttttccttaaacctcatgaatcgacctctgctagcttccaacttttcttcttcagcttcctcatccctctcagccctcatagaattgaagagagttaggaccttgctctggattaggttttggcttaagggaatgttgtgtctggtttgatcttctctccagatcactcaaactttctccgtgtcagcaataaggctgttttcttttttatcatttcagtgttcactggagtagtacttttaatttctttcaataacttttcctttgcattcacaacttgggtaactgtttagcacaagaggcctagtttttggcctgtctaggtttctgacatgtctggtttcctcaccaggcttaatcatttctagcttttgctttaaagtgagagatgtgcaactcttcttttcccttgatcacttagaggccattgtagggatattaataggcccaatttcaatattatttaatcttgggaaatagggaggcctgaagagaaggagaaaaatgggggaatagccggttggtggagcagtcaaaacacacacaacatgtatggattgcacttgccatcttctatgggtgaggtttgaggtgccccaaaacaattataatagtaagatcaaggattgctgatcatagatcaccataacagatataataataatgaaaaatttgaaatattgcaaggattaccaaaatgggacagagagacaggaagtaagcatatgctgttggaaaaatggcactgatacccttgcttgatgcagggttgccacaaaacctttaatttgttaaaaacaaaacaaaactacccatctgtgagttgagtgcggtaaaatgaggtgtgcctctatgtgattgatgtccc

SEQ ID NO: 39200 - DNA, 1041 bp, Homo sapiens
attttcttacaaaaaacttcattcagtgtcctggcacagatcctccagttgaacaggggccttctttccaaagccccaggtaaggactttctcaacctgtattctaacatgatgggatgttgtcttctttgctttcctatcttatcattgcaaactctcaaacattttctacattatcatcatttatatttatactagcacacatgtttgaaagcgatatgatccccattgaaaactcttttcctttaaaagtcaatcccatttctagaggtcttgacaatgctttcttctttccatgccattgaagttgcattaatgttggtcaaccctggatggctcgggtctcatactcagaggttctgatggattcagtctgggataagactgagacactatctatttttttttaatgctcccttacatagctcccttacacgtttgaagatctttgaatttgttggtctcacaagcatccctggggttcaaaaaatgtgggtattggaagaacacaaagtgagggaagctgtcctggtgatatctagatgtgagctgaatggagcttatggcaaagagacaaacctgagttaatctgcataatcacgcacacttaactctaatgggttagttatagggtggtatctctgcctcagtttctattgcaataaaatactggcatcatctcaagattctcagaaaatttaattaatattaatatttaatataagattaaaagcatactacaagtttcaattagcattaatcctttaaaatatggagttaaatgatctgtaactaattaaagactgcagttaacaggggacatgagttttttctgggttatatgaaacaaaatataaatcttttatataactcaatttcctacagaaaaaaaacttacttgtcagtgggattttaaagttttattttattttcttggatctcattacttttccatgaatcctataagcagaattacaatgaggtgagtcatagacttaacacttttttggagtttcttctgccaaagcagcttgaaatata

SEQ ID NO: 39201 - DNA, 2066 bp, Homo sapiens
aatatccaaataactgcacaagtagatgacctatgatccatccatttttataaaaagttgttgtatgaacattcaagtccaaacaaatttacaaggaataatgatgacacacagagggtggatctggagagtggagtacataaatctttaagtaactgctaggggccagccacttccatatgctgtcacatttgttccctaagtagccctgagggggaggaatcatcaccaccattccacaggtgaggagctgagactcaaaggagttgaggaatctgtccatgatggtgcaaccaagagcctgagttcaaatcaagtgtgtccagctccaggcactttctgcccatctaaactgcctgctctgcaaaaccactctgaagagattttctattattttactcaatatgagtgtatccatgcaataatctctttctaaaatttagtgatagaagccatattgcctcacctgatactgatatgttcctttctgttaataagagctgtttccacttctcctctgacacggttagtgcctttaagccgtagccagcctatctgtggcttccaatacagttttctgtctttcattcctaccatatattttgtctgattcttcattttgtcttgactttcaccaccctgagccttttattgcaagctaccttgaccttttgagaagtagtgagaatatatagaaaagaaatagacttctgtggtgtaaattccacaaagctctctttttatatcctccacatgacctagaacagggccttgcacttagaagtgaacaataactattggttgttaaatgatcatagcaatagcaattctgaaggacagttctgcttattttaaggacaaccaagaagttgatggctctggctttatatgtgaacttcatcataaaatgtacttactgctttcctattccttaatagagatttgtctcttgtattttcttctgtttaccactcataaatggaatgtgaaggacaatgatcacagctcacttgcgtcacattcctccctcttgctgtgctaagcccttttagatagtatttattgaatcctcacaacctgattattatcccatttcatggaagggcatactgaaggttagagaatttcaggggtttaggaggaaagtgaggaaataagctttctcctgatgattcagcaagaaataggaaaaaaataggggaagaaaaaggatatatatttcagtatagatgagagatacaaattgctttaagtataatcagtaaaatgtaggagaggctggagaaagtcacaaatgatttatgagggcatgattcttcctgcttatcccctgtatattagtccactctcacactgctataaaaatactactggagactagataatttataaaggaaagagatttaattgacttacagttctgtatggctgggtaggtctcaggaaacttacaatcatggcagaaaaggaagcaggcgtgtcttacatggcggcaggtgagaaagagcaagcatgtgaaggaagaactgtcaaacactcacaaaaccattagatctcatgagaactcactcactatcacgagaatagcatggggcaaactgcccccatgatcccatcaccacccacgagttccctccctcgacacgtaggggttatggggattacaattccagatgagatttgggtggggacacagagccaaaccaaatcgccctattatgttgatgagcacggaaaagtcctctgcaaactgctgtttttaaatatgagacattctcttgtcaggtgatcataacttgggttgacttatacatttctcgaatccatctatttatttggataatttcaagttgagtagtttatgtgtggataaaaacctaaaggtcttctctatggtttctctggcctggcttgtgtttttgggagtcccccaagatgctgtaaccccagtacccctggagaacctgaacgtgtgcttgatgtctccacgtcacggcaggtggcccccagcatgctgcctgtcatcactgtccccgatgctgtcccgcagcagcaccccaaggctc

SEQ ID NO: 39202 - DNA, 1520 bp, Homo sapiens
ggagaatatcttagggaggaggagtgcagggtagctgaggagagcacttccagaaggaggcagggctggcaacgtcctgggcacacggaggtctgaccagacaaggacagtggctggcacaggtgctcccgagtgccaaagtgaccacaagaaaagccgccagaagaaaagaggagccttgcctggaaaacaaaaagcaattaaacatcttgtcatgtggcatgtttttaggggaaagatgatggatggcttcatcttttacttgatcccgaagcaagggcagattgagaagcagagtctgagggacagatgattttcccctctggccttggctccttctgaccttctattttctcccagtgaaagaggtgctgtttctggcctgtggccttatttagcaggctcagaactttttcccagcttcatgataatggcctttggtgctctttctactgcttaatgtactgtcatccagaataatccttttctatattgatctgaatggtaatctgtaaataaaaaggagaaatcataggagaacttgcagaaaaatgggaaaaagtagttacttgttttgcacatttctggaggggaggagagagaatctttaaaataatctcccatttgtgccttctcatttgtcagcacatcaaaagcaacaaaagcaacacacacacacacacacacacacacacacacacacacacacacaccccaatttgataagttggaaaactggctgcacgacttagagtatatgtctttctttaaaattttctgaaatctgatgtggatatttaagagctttcagaaatttccataggcatgccattagagataagccatttgattctgaggggattcaaaaagggaaatgtactttatctaaagagatgaaattggactcaacttggagaaatggttctctgaccagatgtcatttaaaggcattggactttgggctccaggcgttgactgtttctcaagataaatatgcatctaggaaccaagaagggcattttcaaggattgctgtgagttggtattataatgtgctaagcacacccctgacgtctttggaggtctgagcatacaaatcagacataaatgcttctcagttccttctcataatttctctgatcttactggcaataaaaaaaagaaaaaaaaactcttcaggagcataaaatgttattgaatttgcagcagtcgtcatggttacctgcatagtttcattgctttattaatgtgtaattcctcttatttctggaaatatcattatagtgaaacataatagtctgcagcctcttagcaagtttctctgtgtatctcagagatcctgacaatggctgtgatgaatgtgtgtgtggtttccgggtcacttgcatgctgatgatccagcaactgggacatcattgtttaggaaaagacaacttgaagctaatgactcttgagaatcccttgaaagttcaaatgtttctcgacacaaaagtgctttttttttttttcctgtaggacagt

SEQ ID NO: 39203 - DNA, 1035 bp, Homo sapiens
aatctgcagtttaggtgctgaaggaccctgagaaggttctgcattccctcgtgcccctggaatgggagatcactgaaaccccagaagtgttttgagaaatcccagcatatggggaacctggatttgatttctagagcttcacttcccgggagaggaagcaagcagcatcacagaggagtggaaggccgcaatcactagcggaggtgtcccagcaacatggaaaatattttaagattcatgtcccaagaggctgccctgagagagtcagaagggccttgataacctgatgagggaacatcattagtaaatttgatgtgcattctctgtgctggaggctgtggaaacagaaacaatgtctgcagcaaaagcagtgtgggtagaagtctccatcaaagatgagaaggtaatgaaccagatacctcccctatgatgccatgatacatatgggccttcttagaattactatcccaggaaaagataaggaaagttagaactctaatttgatcatgtttaaattctgaatatgactgcaaaataactgaacaagatttaatctcttggaaatggctgtagtttcagcagctgaattactgaaggtcacatagctagacagtcctgtggccaggattctagtccaggcagtctgacttcacagtccattctctaaacctccacactgttttgtactgttctatactctactatctccatgtttcccacagccagatggaatagtggctcgagaccttaagttaaattacattcaagaaagataaagggtgattacaaaattcaccttttgactttccacattaatttcaagatgcatgtaaatttcagtaaaatgttttagactggaagaagttgaagatatattcacctctctccatctctactaccagtgcctaatctatgtcttacctagactgtgccctctaaactggggagattaggcttctctatgtacttaggagcaagaaaactaggaccaatggatggaagctttaaaaacagaattctgtatagaatcagaga

SEQ ID NO: 39204 - DNA, 1008 bp, Homo sapiens
tatgatacaagatggcgattcttaaaaatgggcgtcacagcacaaaggaagcccttggcaaaaaggtaaaaatgaaggacgcttcattcattctcaacattttgaaaattgtgtcttttattatcttcctgaacctctgctactttctgacccctgattccatagttttctctttaaccaattttcagctttagttttccctcaggtaacgcagagcaattcaacatttttataatcctttcagaaattgttgctttaatcctcttctctcaaacctcactcctagaccctggctgaaacatcttttggttctgaggaaacctctgtgaactgaaaatatactgaaaactggtcctgtattcgttgttcaaaattaattaaatagaagagttactttccaaaatagcagaactcattagagcatcagaactcagatacacacttatatgaaagggaacacatactggttgacatagagctgaagagtagcaaatgccatatctgtaaagatcagaataagtgttctaatgtaataaagcagatgggaaacattaaatcagaagtcaagagatggaccctagccccaggttgctgctaattagctaatgaccttcaggctcagtttgaggctcaggttccttatctataaaactgcagtcaggccaggtgtggtggtgcatgcctgtggtcccagctacttgggaggctgaggtgggaggatcacttgagcctaagaggtcgaggctgccgtgatctatgattgtgccactgcactcttgcccgggtgacagattgagctcctatctctaaaaacaaaacaaaacaaaacaaaacaaaactggagtcaattggtgattttcaagccttggagttgtttttagcaacgcaactcagttttcaaatgaaaaatataacaaaagaacagatgcctgtagaactcctctgattggaataagggccagtggcctagaatcccaccctcttaactctctcttccactactcaggg

SEQ ID NO: 39205 - DNA, 1051 bp, Homo sapiens
ttttagaacaggagtaaaagtttatttaaaagctttagagcaggaatgaaaggaagtaaagaacacttggaagagggtcaagtgggcaacttgggagatcaagtgtgcagtttgaccctttgacctggtgtgttatgtgttggcgtgcttccggggtcttgtgttcctttctccctgattctttccttggagtgggctgcccacatgcacagtggcctgccagcacttggcaggggccgcatgcgcagtgtgtttaccggagttgcgcgcatgctcacttgaggcatccccccttaccagttgaatgctcctggaaagtcatataacaattaaactccaccatttttcctcttagtgtgcatgactgagcccactcacccaactcctgagatcttatcaggaagctgttgatcatgagctttaggtgtctttctctattgggagactgcctttccctggtgccagctgcaaccaattattattttagagaggcagttttaacaacaaccgactgaccatcacctgatggttgcctgacattcttgtttgttggggggtggcagggggatgctctcctgccctttcacgtctgactagctacctgctgtaacaataagtatctcacattctgaagagagctacctttcttggggcttacaagagacagccgaaggactctgctcacttactatcaccaaggccatccatgcttcactatgcccgtcttccccaccctcttcccaagatggggaagagggacagggtctttgcagtcttgagttttggatctaggggagctgttgggggaaggaagggcctctccacactgaccaaagccaagtgtgaggctctaagagaatccctggtaaataatagctatgaggcaggaatttaggaagctgactcgttagccttccttatatctcctatttaagcaaggaaaagagtcttggaaggatatggcagggcagagggagggggagctgtaaagccgcctgtgatcccatcattgtacatgtcaaagtttcttgtagatctggtttgacataga

SEQ ID NO: 39206 - DNA, 1049 bp, Homo sapiens
ttctcaattgacatttcagcaatttgatactaaaacaaaccccccctcttcctgatacactctgttcctctgatttaggtgttgtaaccatttattttccctccattctgaagatgatccctctcagcctcatttgctggctctttcaactccccccaaacctcagtgttggaattcttcagagctcacttccaggtcctcttgttttactacccactctccctaggtaaacccatccacatgtgtttgcaatgcctccatttcggaactccatcccatacctctctcctgaacctactccatatctactcacttagcaactgcaaaccaacctcatgccatgccagatgtctgcatcccaccccaaacctgcatccccttgtcatcatcccaaaactagttgtttatgctggaaatctatgagacatcctcaacccatctctcttgggcccactccaggcagttgttcaccagtttctgagttctgtacctccagtgtacttgtagaatctttatgctttgctccatctccactgccaacactatggtccaagcctcagttatctctcctctcaaccactgctagaactgtctatccaaaggatcccagagtaatcttttataaacaaatgtcatcatgctactcccttgctccaagactgtggatgacttctcattgctcctcaagataagaaccaaaattcctttacatgttttagggggccctgcattaccggacccctgctgacctctggcctcatcatattcctccttcccttttgcttgctagctccagacacagtgatcttctctgattgtcaaaagcaataagcttcatccaccttcaaagctttcactttctttgtgccacaaacaaatcccacctctcccccagtcatgtctcgcaccagtgttagtttcaaatcctgctcctctttcaggcctcaacttaactctttttctcggggaagccctctctgattctccagacttggttcagcttctctgtgctacactactataatctgttgatttctgccaggggattt

SEQ ID NO: 39207 - DNA, 1044 bp, Homo sapiens
cctgtgcttatctaataatgagtttggacaagaataatgctgcctcggattgcaatgttcaaggcagtcattaaagttaataatcagtgctcttgtatagaagctttatgcctaacattgatcagccctttattgtgtggcatttgctagtattcaagtagcaaggagctcaccacaaaggccatcaggtaggtttccatggtagcagtctttcttttgttattcaccttggtaacacagactgggtgcaagccccaagccttggcagcttacacgtggtgttgggccattctcacgctgctatgaagatatattcaagatggagtcatttataaaggaaagagatttaattgactcacagttctgcagcactgcggaggcctcaggaaacttacaatcatggtggaaggggaagcaaatacgtccttcttcacatggcggcagcaagaagtacagagcaaaggtgtggagaaggccctttataaagtgtcagatctcatgagaactcactatcaaaagaacagcatgggggaaactgcccccatgattcaattatctttacatggtccctcccttgacaagtggggattattataattcaaggtgagatttgggtgggaacacagagccaaaccatatcagacagtatccaaatactcaccatgtcactgcttaatgaaaataaatagaatattgatagtgctagtagagtcaagaacctggtctctgggtgtgacaacaaggcaaggcatgatgtctaccaaggttttcttttaagcagctgtccgctaagctggactagtgtccttttgatcttattccaggttaataaccctccgttgtcttatattattgccctggagacaaatagaactcaatggtgactagaatagtttcattaatgctgaatcttatgaaagacaagtttgtgattgcacagtaataaaagtacaatataaaaactatggaagaaaagagaattctacttttttttttcagagaaactaacacttttatttttttattttttatttttttctttct

SEQ ID NO: 39208 - DNA, 1050 bp, Homo sapiens
cattccaccaccactactctgacagcacaaaacatataccaggagctggggttatgtggtgggggagtccttcctattgtaagccctaacattatgaccctctggggttaaattttataattttcatattgtggagtcccatattttgttctgctttccactagtccaggcttctgaggtcttctctgtgttcattgcttattaattttattcagcaaagattaattgagctcctgcaatgagacacacacactatgttaggtgctggggaacaaaatagggaagggccctaccctcagaaagcttgcaatttatgaaagaatactaacaaaacctgcaaagtggtattttaagttattttgtttcatttttgctattgaaacaaagaaactgagaatttggtatgattcaaaaaatgtttaggtacaagaaaaagaaaaaagcaagaagcacttgccagatttaactataattcctaaaaatgatgaacattttcatcttcaggaacatgaaacatcatcgactattctctacagacaacaggcaaaggttcttactggtccagtacatacaagtccttcaggaagaaaaacatgattctaccaggattgggttgaatagagagagaattgcagtttaagattcatgagtatggaaataaacagctcttatggctaataaactctctatgaactttaaaaagaaaacaagaaaaaaaaaagcatggctttttaaaatccaaagtccttgccttaggaagagacaggactaaagtaaaaataaatgaagtctgtttgaaactcatgagttgcacacctcatgttgccagaagctggtttaaaaagcagtctagctgggatttccatgcaaactcagcaagtcatgaatcaacttgaagccttgtctcccagaggccataggagctgggtgtgtcccagagatgctgtgtcctgattctgtggaaagggtggggaagagaggtcactgaggatgtttctggagaaagttgtgcatggctttccttcttagctaggagggaatagggggtgt

SEQ ID NO: 39209 - DNA, 1088 bp, Homo sapiens
cacaaaatattctgggcccacagccctgcattctgactaggccagacatcttatttctttatcccactcaggtttaatatttaatcttgggttttttgaaatcaaacttcaaaactccctctcccttctctttccccttggtccctggagaaggagaatgacttacgctttcatagcaaatgacatcagaggtggtgagttccttctctgcctcttggtccaatacaaagggaccaacatcaagtgctagcattgtctttccagtggggatgatgaaattgttagctctttagggagctccatgagggcccacccttgcactgtcctgtcctcttctcccttaacgccatggcaacaagcagtccacccaaaagtctctgcttctgataaacccagaccatcttccatggcatttactcatccctccctgcccagccaagggaagatcacaggctgccatagggcatgctcacagtttcagcaacaatagcatcaactgttctgccagctaagtggcatcccccaggtcccaaccctgacagttcttcctgggggtatagggaaattggagaacacagatttcatcagaacagggtggaacacattgaaacttccttgctccctgcctcccagtctctccaccaagggaagaggagggaaaaggcactgttcatgctttatggactctgcttccttcagtgctcccatatccttgccctctctgtgtcctttattttataaaacccaaaagagtggggcttaagaaactggttctgctgaatgccttatgctagcaaatcccacagtggaggactggcattaagaacccatttttctgcccttgaaaggtgagatatttggcaacttttatcctgaactatggactctagcaggctgttccaggaaagcacaaatgtcccttatgaccactttatcactttttaaaaatattaatttcatactatagtagtcattaatttttgaatttttgtattgcaaaatggttttccaagacagattcccaatttataacattttgcctctaagaactaaattttccatttaaactaattcaacttgagactgta

SEQ ID NO: 39210 - DNA, 1064 bp, Homo sapiens
catggtaactctatgaataggtaagatgacatataaaaatgttatactaatgaatgctctaaaaaaatggtgctttgcttgtctttttgttccagataacaacaacaaacctattaaatttgagtgcctcattttttaacaaattaaactctgttaaaccaacaacttcttcactagcagaagctccttcttggtttcagtattaaaacttggagtcttccagaaactttgccactatattgaagtactttagttgtaattacctttctataagttgaattccaattattgtttttttttaactctttagaatacaaaactcacaatatgttttaattttaatgcattctctaatgttattccattactgcaggccattttggtctgcatatttcaatattttgttccttataatacccgggcattgttggtatagattctcatttgatgaattagctccttatagttctacaaatgcttaaatgtattcattccagtccttattacagaattaggaacatgtattagtgcaattgttagtgattttaatcataactattactaaatcatggacttatgtatgccataaggtatcttacggttttttatatctttgttatcccaacacaaatatctttggtctcatattagaatttatactctttaaggatttctattttgcagttttttatgtcaaactcggaaaataatgggtactaaattaatgttgactgactgtaaactcattcattaaaatttgagacacatcctttgaagtagctttaaaattttttttttaattggggacacagtaattgataggcaatatgtatgtgcaatatccaatttaattcttaaatacatagggccagaagttacttaccagattctctgagacccttctttattgtagagaaaagattaatttgacattgacattaagcatttggaatgcttacagccataaagtatattctctgaagtaatttaaatatcaacataaaatctttaaaaaaattttaagttatacaaaaataaatttcagctcaagaccaatcctatat

SEQ ID NO: 39211 - DNA, 1078 bp, Homo sapiens
gtctaagaggtcaaaagtgtaattttgtctttccctgattactattgaacctaggaaatattttatattattagccatttgcattttctttctctgtggtcttcccagtacatatcctttgccctttgttcctgttgcattattttcttaactcttggtgtgttgagttgataaataatcctttgtggtatatacattggaagtatttttctgctatttggttttctttcattttgttcttaggacgttttgttactcaggaacaaatccagttttgatgtgtgaaggtgtgtgtttccatacacatacggaggatttacaaatatgctgtagatgtctgtatttgctttgaaatgcccttcaataaaaaccatcccagcttctgtgattcttatcttccctttttagtgtgggaggcttcctgctttgctttgtctgcacatttacgtcgagcctgccgagcttaattttaacctggggaaaaatacagaagagaagctattttcagtcaggtcatattactgagaacacctgtgaaattcaggatattttcttgggggtaagttaaaatgtaggacgccaccttgcctgaagcacatttctattgtggttgctgtacaaattgggaggtgttacttggagccaaaaaccttatcactttcacaccagcactgcttctaagttgcatgcctccaaccctcaatccttggtattaattctgaaacaactagtataaccatctgttgaaaagttctgtgggaaaaaaaggggtctttgtggcctgtgttattcacttccctgatgatcaacacagaaatattttacattttggttatcagtctattttttcctgcttttcctcttgctccagtttgccttcctaaatgtctggccataggcaaataaaatatacccccaccctagatgattatggtgtcaaaattcccttaatcacacagtagccccagccagctgtttgagtaatatttttcctacctcatcgtgtgaattgtcttattgttttggtgaaatgttgacgctaccacctactctcatcctcccacctccatttgcagat

SEQ ID NO: 39212 - DNA, 1220 bp, Homo sapiens
ctcacgagaactcactcactattgcaaagacagcaccaagccatgaggaatctgctcccatgacgcaaacacctcccaccaggccccacctccagcactggggattacaatttaacataagatttgggtggggacaaatatccaaactatatcacttgactgcctctccagtgtgactctgagtttcaagggtaataatcctgtcttaaaatttatgtatatacaattcatgccacagactctcattgtgaaagaaaaaagcacattaaagaacatatctaaggcattggaaatagatcatccacagttattcctaaaaggtaatgagtagttgaattaacaaaatatggtatttatgtacatgagtattatccagccataaagaggaacatatgctgcaacatggcttgaaaacattctgctcaatgaaataagccagacacagatggataaatattgtatgattccacgtagaggatttacctagaataggcaaattcctagagatagaaaatagagtataagcttctaggggctggaggaaaggggagaaaaggagttattgtttaacaggtttggagtttctgtttgggttgatgaaaagttctggaaacagtggtgaatgtacgtaatgccactaaattgcacacataaaaatggttgatgtagtaaattttattttaagtattttttaccacaattctttttttaaaaaaagcaacaagaagggaagaaacaactgaaaaaattagcagtaaagtgttccaatgacccaaatgcagagagtagttcaaaagtatgtaaaccagttacgtgtgagacagggcactataggctttttatcaagagaagaaacccgggggctcaagcctgtactcccagcactttgagaggccgaggtgggtggatcacgaggtcagcagatcgagaccatccttgcgaacatggtgaaaccgcatctctacgaaaaattaagccaggcatggtggcacacacctgtagttccaggtactcaggaggctgaggcaggagaattatttgaacccgggaggtggagattgcagtgagccaagatcgcgccactgcactccagcctgggcgacacaaactccgtctcaaaaaaaaaaaaaaaaaaaagaagaaaccctgtgttctttctcttgacatagtgtttagggaatcagtaagattccatcaacataagcatcatattctcttat

SEQ ID NO: 39213 - DNA, 1025 bp, Homo sapiens
ttatttatttttctagatttgtctaaatctggtccaagacactctatcccccgttcgtttgccaacacctgtgagaattccacagtcaacttgcttactaggcccctccctttccctctcatggattaaatcagccatagtccaaatgcaaagagggaaggagcttcatttactgttgttccttcacaaaggaaccattgcagtcaagtgcagggctccatgagagctggagaggggtccccagacctccatcctcacggtccaggatggggaagtcatagccagatttagcagttcccctttgtcagtgcaatgcctcatcctccatgtttccccttctaggatgatctagtttgattcaactcttcttggcccttaactttcctcagggaggcaggggaggccagaagtcaagagaatagatacgtggcattaggctttccccataagaaaggttgagcatggtagccatggaaggatgtgtaggttgttcactgctcaagagcattgactgtggggaagaatggggccgaaatgcagcccataccctgcttgccaagctgggtacaaaatcactcctgccaacaagaaaaggaggaaaaggaccttttaaaaaaatttgctgttgacttggatgctgagggctacgtggagggcctggacaatgaggagaggatgaggaggaggaggaggaggaaggagaagaggaggacatgagtgcagaagaggaggatgaagacgattataacaatggagaggtagatgatgaagaagatgaagaagaccttggtgaagaagaaaggagtcagaagtgaaagcagctcaaagatgagggagaagacgatgaccaagtggaataacgtattttcaaaaatgcctattgtgatttgtgtttttacccatatcccctctaccctcataatcctgcccccaaaacttttttttttgttgttgagacaggatcttgttctggcacccaggctggagtgcagtggcgtgatcacagctcactgcaacctccgtct

SEQ ID NO: 39214 - DNA, 1050 bp, Homo sapiens
gacgaggaatgatgttgcttattaaaaagttcaattagaggatgggcactaaaatatatatgaactaagttaagtatgtcaaatgacacactaaaggctaattaggtaaagggagaagtgtacatgacaggtttctgattttctagctttttaacagtaaaggtaactttatttccagcattcgaccaaaatgcagggatttgggccacatttacttggctccgggggagtttttcaatcctgttgaagcacagcaggcaaggcctgggtcatgagaattctatggtgctgactgcatttggagcttaattatttaaatgtttccagactcaaatgactgatgagctaacatatttttaattcagactttcacagagcaagctataaggtgtgtcttgagaaactgatgctcacttgaagttccatgccatgtattttatttcaatagccacattttagatgacaaatttaaaattgtatccaaatttcaagggaacagagtcctacattagttccagtacccagccctctttcgtgaagaggactagaggtggttttgttgttgtttttaaagagagaaaaaagtgctgttagaataaaaataaagaatgttaccagaatgttctacttaatttagctttccaaagataaacacactggtgaatcattacatgctgatggtgctatttaaacattaatcctttaaccttttccttctcccttcctgtctactgagttgggtgggttataggtagcgtcacttagggaaaagtttgttcctttttagtttttctatggttcaaactatttctcgtataagcactatctactggagactcttaaaatagtactttaaagaataaaagaacacttgagaatgattcagttggcggagattctataaatttagataatttactaatcattatgcttattaagtaatttaactatctcaaatgaattacagatattttatagcactatccacatgttaattgaatcttgatcctcaggcctgcaaaactggccatgaaaaatacttttgttgtc

SEQ ID NO: 39215 - DNA, 2050 bp, Homo sapiens
cacagcatttatacctttacaggtgtcaagttcaaatccttatatttattgttattagtaatgattatatttgacttattaacctgtatcttctgttattttccatgtatcctctacatctaccagtctgttccacgtctgttctgtatccacaaaagcatttgtaccttcattcttgctgttcttcccacctagaacgccttctcctccttgccattcagtcgttaattcatccatacatcctggtgatgtttcctggtcacccactctgtgccacgcaatgtcctagttagtgtggatatgagagaatgaaacggagcttctgtcagcatgctccttccttctagtagagaaagcaaaattagtaatgaatagacaaaatgcttggggttgtgatcagtgctgctaagttaatcaactggtatttggataaggaatgaggttggggtggaggctacgccagactcggtagtcagagaaagcttcctaaggaggtggcatgcaggctgaggcctaaggaatgaaaaggaatcagccacgtgagagccagggtaaaaatgtgtcaagctgagtggccggcaaacacacacgcccccagacaggacgttgactgggatgtctgagcaacaaggccagtgtgtctggggcctgatgagaggtaggggcctcagaccaatcagggagggccttgaggcttggcctctgtcctaccagctttcaggagcctttgaagggttttacgagactgggaagaatggactggaaagaagtaagagtggaagctcctaagaatgaaatccacttagaaggctcttgatggaggtggtggcagtggggaaggggagaggaaacttacttcaatcccagccctgtgtcaaggcccagcacatatcccatcttacaacgtcttcccaactggtctccaagccctgaattttctcatgacgctgatggaattcaacacccagttttgtacttactggaagttcatctgagattactctccagttgagtcttcccttcccaaccagatttaaaagtcttgagggcagatgccacatcatagacatcttttatgtcttccaaagagttagagtggtcattctcaactctagctactcattagaatcccctggaaatcttttaaatacccatctctgtgccccaccctagacaaattcagtccgggactttggagtggggtcaggacattggtgtttgtttaaaagctccccactatattctaatgagccatgagggtgacaaccactgttagagtcctctctctttctctcttttctttcccctttctctccctccttcctccctccagtctagcaggccagtctagctgagattttgtgcttgggaattatctgcttccaggtgagatgtgaggctgtgagattaatgagacctccaaggaaatggctgaaagaaaagagcagaggtgaaatactgcttccaggcaatgtatcaggataggaacaacggaaactgaagccagactttctataatccacccttgtggagtctgtagactggatcaaagaaggtggttacggagagacttagtcacctacttcctaatcaggaaggttggtttcttttccaacatcttagaagcaaattaaatactaaaagtgaagattcaccacagtggcaaaaactatttctaaagagactacatgtgaaatttaactaaaaagagatgttaaacatctcttgtcaaattctgtataatagaagaggtacattattagacccccaaatagcactgctatgatttaatcatcactaactgtatctgtaccaagaggctgggtcagagccacgattagacatcgatgctatatttgctgtatccatgtgacttaccacaggcgccctgctttttagtgatagagaaataggtcctgttccaccttgtacttcctgctccaaacacacacacacacacacacacacacacacgcacactccagaatgagtttcagatcattttaaattgatagtgaccttaaatattaaagcctagggatgctttgat

SEQ ID NO: 39216 - DNA, 1044 bp, Homo sapiens
aaagaagccagccttcacctaaagaaggctcagtctagtgacattgtttatccatttgctttgaacttttcagattaccttccctaacactgatgtcaaatatgccggtgaagagtttgaataaaatgttttcaggaaatgtgagagtggaaaaaagcaatttttaaaaatagcatatttttagacatgatttagtatatgtattttaaactaaattaataaattaaatattgttataagaaaaaagccaaattaccttccctagaaaaagaaattattttcaaactcctaaaatgtattagtatatttaaattgtcccttgctcttaatatatggagagagaaaaaaatgtcatcataatacccaaatgaaggcccaggtgagcagatcacttgaagtcaggagttcaagaccagcctggccaacatggtgaaaccctgtctctactaaatatacaaaaattagccgggcatggtggtgcatgcctgtagtcccagctacgtgggaggctgaggcaggagaatcacttgagctcggaaggagaaggttgcagtgagccaagatcatgccactgcactccagcatgggcaacagagtgagactctgactcgaaataataataatagtaataataataataataccaaatgagagagaaataattctgaactcttgttgaaaatcagttcatgggagtacagcatacaaagttggttttatttttataaaaacattttgtgtgtgcatagagcaatgctcaatccctgaagaataacagaaagaataaaaggggaatttttatattttactctagacttttctatttttggttttgtttgtacagtcattgtgtcctgctttaaaagccaataaattatgttttaatcagttaactggatagcagcacatattatattgtcttaccatgtatgatgcacaatattctgggtacactcagagcacccccataataagttgctaatgacatgggtccctaccccagagtaacttggggtgagtgatatgaagaccctgcctccccac

SEQ ID NO: 39217 - DNA, 1047 bp, Homo sapiens
ttgctgggaacaacctgtaaaatgtgccatctgcaacatgtggcatcatagccttcgtgagtgagcagatgatgtgatccaagctgccctctgaaaagcaatcaacagtattacagctcttctgttttcatcttcttgtggttcacagttctattaaggtaatctctgtgacaagaagaagatgaaaatcttggatacatgaccaaaataactttaatagtgggatttgagtcattcttaatattataagtcattatatttcataattataattcataatattaagataaatgtttataaatattatttgaatgaagatcaaaaaattaaaagactttatttactatcatttaaaatattttcttgttttgtatgaatgcaaacattgaggaaacaaagtatgtctagaaagctatagtaaggcatattccttctggctacctttagaggaaatttaagaaataatgttaatataccaaatgtttgacttgatgacatgtttaaattaaatacaattgtagaatctctataactacctaccagttttatccaaattgtattattaatctgaaacctccatgccttaattatagctcaaaaacaaattaaaagtgttgtgataactgttattgactcagtaaacaactatcattaatccttcatagggtcgttgcaggattaaatgagttaacctttcaaagccccattcctgacacattatttataaaatgaataaaaatcatggtaatgaattcactcatccaacacgcttggcaaggcaaagtaaattcctttgtttaattgaaactgaacagagcaggtctacatcatacgtaattcacatgttatggtacaatgccatttatactggaaaattgaaactaataagtgaaaataagtagtgatggaactaagccagaaatacactggtatggatcagcctttggagcagggaaagaactgagatggttcacattggagagaactcttgaactccaagtctttctcacaaaaagtcattcctaggtcttcttaataaccagtgct

SEQ ID NO: 39218 - DNA, 1054 bp, Homo sapiens
ggaacagaccaaacaaagcatggctgatagaaagggaagcctgcgatgggtgggttgagtcaggtaagacagagaagcttgctaaggtggagtggaaggaaatcctatcattactgtggctgccctctgaggtaggaaggaatgaagagcccgggaggtttaaagtgctctgaagcactgatactgtaaatgtggcatgctagcataggggaaagtgtaattcagacaggcagactactctgtctgcattcctacaactgcttctcctccccaggatgtgcacgtgtgtgtgtctctgtgtgtgtgtgggcatgtgtctctgtgtgtgtctgtgtatgtctatgtgtatatctgtgtgtatacaagtgtgtgtctgtgtatgtgtccatgtgtgtgtctatgcatatgtgtctatgtatgtttgtgtgtgtgtgtgtgtctgtctgggtctatgtgtatgtctatgtctatgtatgtttgtgtgtgtctgtgtgtctatgtgtatgactgtttctatgtatgtctctgtgtgtctctgtgtgtgtctgtgtgtctatgtgcatgactgtgtgtgtctgcatacactcaaaatgcttctgtggaataaagtcaattagattttgcctttccacatggcttctgtatgacctgtgcttgaccaaccatcaaccaaagcccacggcttttcctctgaaagggatgccacatttttgtgtgtgtctgtttgtaaacagtgacattcaagcacaagggttagggatggagtggataaggagggtgtgaaacagcacaaatcagagaaaatttaagaggtacaagaagaaggttttttgccttggctttaaaatgctggtaaacactaactaattctatgaggccagcatcatcctgataccaaaacctggcagagatacaacaaaaaaagaaaacttcatgccaatatccttaatgaaacaccaatgcaaaaatcctcaacaaaatactggcaaaccaaatccagcagcacatcaaaaagcttattcaccatgattcagtaggcttcatcctcaggatg

SEQ ID NO: 39219 - DNA, 1068 bp, Homo sapiens
tataatttttgtcattacactatataatatgtccctctatactatttgttattttaccttcagttttaatttatctattattaatattgagattataaattttcttttggtaagaattttcttagtaaatatttttcatacttttattttcagcttttgctgtttggggtgtgtcttctaaaaatgacagataaagaaagagatgtactatgtttctgctgctcacaattttttagtctttgtcattagataagaaagcttattcctttcatatttattgagattactaatttggacttacattgccatcttaatttgtgtcatctttttaagcatgctcttcttcaattttctttcattttctcattatttggattagtgaagctttctttaatccccttcttttgtttagtgatttggaagcttatagttatatctttcttactatttgaaacagttactttttctaacaaagtttaaaattatttagtacatatatctttccccgatcaaaatcaggactttaacatacatgttaaaacttcactacttcctcatttgcagagccgatagtttattaaattcaccatcatgtcctcactttctgtgctcactgttgtttcatgcataccacccttacctctaggttcattttctttctttatttttattttattttattattattattttgagacactgtcttgctctgtcacccaggctggagtgcagtggtgcaatctcggttcactgcaacctctgcctccctggttcaagtgattcccctgactcggcctcccaagtagctggcattacaggcacctgccaccacacccggctattttcttgtatttttagtagagatggggtttcaccatgttggccaagctggtctgaactcctgacctcaagtgatctgccagcctcggcctcccaaagtgctgggattacaggcatgagccaccgcacccagcctgggttcattttctttcttgctgaggaatatcctgtagatgttttcagtgattaattacttttagtgaatgattgatttagtgaatgagtgtt

SEQ ID NO: 39220 - DNA, 1029 bp, Homo sapiens
gttagcattatcctgttcaaaccagcatctctcagaattgttaaaatctaagatatagtagccatttagttgcaactttaccatagagtaacattttacaaagtaaacattagttacatatacagagttttcactgagtttatattatctagtaaagctcccatttgctttttatatttttctaagtaagctgactcttacaaaatgtagccaagttttgaagacatacaaagtttttaaaaaccagaagatcttctagtaaaaactacccaaatagttaaaacaacttttgcatatcgtttttagtatactattaggaaaactgctaagttttcattcatttccttcccattaagaaataatttttctattgctacaattcccattagccaaggaaatgtcactaattcacagggtgtctatggtcaaatctagaaataagggtgtaaattaatgtaatcttcatctgcttgtatatggccactatcaaccactgttgcctcccaggtcactgctgttctgatcaaccatctcatctcttgggactctgcctaacccttccctcccatcataattcctccacccctaacatctggtgtctcaaaatgaatcctcacacagctggcagcatctggacaaggcagagacctccaggattagtattcatggcatttgtgttctgaggaaggttccttcttcttcctgctccaggctagatttggctgcctagaaaaatctggcagtaacctaagttataggatttggtagtggtgactgtagtaattgtaaaccatcttctctaaaggcaccaagttgtatgtctgccatttggactttgacctagaaaagaactttctcacaaatggtccagattgccaatgtttaggcttttgtccgctttaactttaacctaatagatatagtggcttccatccaggaggagtgcaagtgtcactttgggtaccccaggtgggtgagtctaagacttcccacatcagacaagccagtgaagtctgtgttacagggtag

SEQ ID NO: 39221 - DNA, 1068 bp, Homo sapiens
cctttttgtatgttgctgggttaggtttacaaaagtattttactgagaattggatccattatttctaagtacaggctaaaacgatatgccctcaaataggatggtttcggtaccctctggcatcatgccctaggaggattgagacttctagtatttcattgtgaagtgtagagcatggtagattggatacaatacatttttgatgaatatatgaatgagtcaacaaatagtctcaataagcagcctgactgctttaaaccaatgattatatgaatgagaggtatgtattttttatattctttttttagtccaagaattacattactctggctctattgtctgaagggtggtatctgaatctagtaattatttcttctagttttttccaaccccaccccattttcacggtgccacagatcagcacttggctgcttctcctcaatccttgggttgaaagggcagacaatgccactgtccccatttttaagagacaagagaacaagtaaataaagtgtgcaggatcacacctatgttgtgatagaacctgtattcatctgtgtctctgggtttccaagttttgttcagggccctgtatttgtcttgtccagaatatttatccatttccttgtaaaccaggcacaggaagaggtcctaaaggcaaaagctgatggagtttgttttctttattccataatatatacatggtaggaagtcaaacattacaagatggtttgggataaaaatgaatttactccctcccagaatcctccagtcccacttttcatctataacccagcatgaacagtttttttcattccacacagttttcattcatagatatatctttatcagcagtcaaacaagacatactatacttactgctctatactttgaatttttcgtgtaatataacttgaaaatacttccaacttgttctctttaattctataaatgaacactattatagtatgtggatatatgaaaacttcctttaaaagaatcctgttgtattttaatattgttcctgggttctttgcatatgtatatgctcttatgaacaatactgaa

SEQ ID NO: 39222 - DNA, 1047 bp, Homo sapiens
tatcttaaagaaaaagaaggaaggagggaaagaaggaagggagggaagaaggaaggaaagaaggaaggaaggaaggaaggaaggcctgcgacagggagtggggagggaaggaaggagggagggagggaggaaaggaaggaggaagaagtagaaggaggaaggaaaaaaggaaggaagggagggaaaggaaaggaaggaagaaaaaaggaaataaataaagaaagaaatggaatatgtgacattatgtttctgccattgtgtaagaaatcaataccagtatcttgtgattggagcaccaaattgatcgagtaatgttcaggaaagaaacccccaaactacttatcaagatcctaatcccagtgtggtcagtaactaatgtggccacctgactggttttataatcttctttgagggccctgaatgtgaagccctgtatttggagaaatgttttgttctcaaatgtcactacatatatagtcttccttttctgtgtttggttttgctggctctgtatgctttcattgtcttagatgtgtttgaaatccgcagggtgacatgtctcttttcaaagagctgctaaaataagaaagaaaatgaataagcgtgttaaagaaagatggtgtttaaacacctgtcaaagtaaagtcagaacaagaatgttcttgccagaaaacgcagagccccattgagacaggttggtaattcgaagatgattcattacgactaactgcatttgtattctagcccatatgcattgtaaaccacctagcaggcttccaatgatgtcttcctatcaattcgtaaatctcacaggaaacttttaactggtgcagtcagttttggtggactgcttatcttgtcaacgtgaagataatgcttcaacagcacacccacctcctctaggttcaaaattccttattttattgaaaaaggtccctcaagctggttaagcacacaaataagaattgggtgcatcagaatctagtgaccctaggtccttttgtaaaatgattaaaactctccttaaacctcagaaattatttaatt

SEQ ID NO: 39223 - DNA, 1025 bp, Homo sapiens
ctccttccccccaaaaagacacttaggtccccaatatctactctgtgcgatatattattttgggcattatgggaatgacatgataaacacgacatccctcagaaggcttagactagaatcatgtgattatgcaatcgcatacacatgaatttagtaatgaacaacttagtaagtgctataacagaaataatagttaatagctaatatgtattgaatgctttctagatcctaggtactggtctcagtattttacttggtttaacctatttagtctccaaaagaaccaggaaagtagttgctatctctccattttgcagatgaggacgctgaggcacagagaagttggttgaaagtgcttttggaacacaaagttctagcccatcaggatagtgagatctccatgcagagctactgtgtgaagagaacttaacattttagggtagatttcacccgagagggatagggaaacagtctaaattctaggaagaaggaacaatacatgaaggaatggagctgaagaaccgcagatgtttaggaaatggcaagaagtaaagtttgactttaacaccaggcttgcaaaaaagagatggaaggaaagtgatgggaaaaatggttcgctgggacgggttgtaaagcttggctgccgttccaagtccagctggttccacagactgtagaattctttagtaggggagtggctggagcagataaacaaaaaaatcgccagacccctgagtgtttttaggtggggatgttggctttgtatctctgctgtacattcttgggatgttttggaaggtttttgcaaatgtcctgttgggtggcattgaagcggttgtttctttaaatgacttagctctgccttagtgaagatcttgttaaaagcagaccattttctgacattctgttttctgcaactgctattgaagaggggcaaagccgagccaggctcttgtagaacactttcaacacaagacaagtggttttgtgtgtttctgtcacagttttacagtgaggccattcag

SEQ ID NO: 39224 - DNA, 1045 bp, Homo sapiens
ctctactttatgaatgaattttatgttttccctgtttttctattattttgaagctatttatttcctgtttgagacttttaagagttaaaaatgcacatttctaactttttaaacttaaaggtaggcttgcaatatcaaaattaatcccctgtccaatgtctctgaaggcaatagagaaataatatacccattgaaagcttaacactgggccatcagctttatgggatgggccaatgcatttattagacatcgtttatttagaaatattttaaagaaagtacaaaatggaaaattttatgattgaaactgttaatgggtttaaatgtgaagattaaaagcccatctttttttcctaattaaaatttgtaggtagaaaaagaatttgctctgtctgaaaaccaagtagcaatagtcaatttaaagaaatgatttttattctgccgaatctgtgaaactatttgcctcatagattataatttcttgggccaacatatacttctcagaaatctgactctctgatctttttatttaacttttccagtggaaactaaaagttttaaaacataaaagaacaaaacaattttttaacctaagcataatataataataggcttaatgtttgagaagtcataaaatactagattttactttccagcttttccatggtccctatctagaaccgtagaaattatctaatggttgaaggttcctgaggatgtcagtagtaaatggagtccttccccttttcagctgagggctggagaaaatagttttctgtgattttcccaaaagcaattatctggagaatttcagtctgagagactagaagctgctgttcttggtaacaacctcctttctgctgccagtgaagattcattgtttgccttgatcttcttgaccttgcgtctgctcttgacagtgcctgtccatcaagccctttattcagtgagccagatagactttaaaaatccctctagctaccctgagtctgaccccatcccaccatatcccatactctcccggctattgttatttttccttttag

SEQ ID NO: 39225 - DNA, 1049 bp, Homo sapiens
acatggttaggcaccgaatccttagcgtctttgttgtgaaaagtaaatgtagactggacttagattgaaggagtgtgcttaatgagtttgacttctaggctagggaaggttgttttctataaagtaacaggtctagatttggggaagaagaattctagttatgtatatcttaaacgataaagaccccaaaaccatagggattccttttaagcctggaacctgtcactaaataagactggcttctttagtatcagtctaatcagaataaatgaagtcttacatctcattgtctattctttcatttattcttcatctcttcaccctcccaattgacttcaataaagtcataactggaggtaagttataataacatctgtatacagtgtggattggcttcacaatgctaacaagatgttttctaatcgttctgtgaaagatagttgaacccttcatgaagagaaggagcataacaacattataacagaagaagccattaggataaatttataggtcatgaaagaaaagagtattctcataggagtttattttatcatcatatatttactaagatgacataaagaaaaaagtagttaatctttttgttttgaaactgttttgattgagggtgccctatccggaagtaggcaaatataccatagctatccttcgatgaagaccttcttggaacttaagcattaaggaagatcacatttgcgaaggtggagtcagaagacctgagaatgatatcctttccattcacattatttagaaccagacacggtggctcacacctgtaattctttggagccaccaaagcctctcactttgggaggctgagatgggtgaatcccttgagcccaggagttcaagaccagcctgggcaacatgacaaaaccctgtctcaacaaaaatacattaaagttagccaggcatggtggtacacacctgtagtcccagctactcaggaggctaaggcaggaggatcacttgagcccaggaggcagaagttatagtgagccgatattgcaccactgcattccagcctgggc

SEQ ID NO: 39226 - DNA, 1049 bp, Homo sapiens
atttgatagcatgatataaagaacaaattacagtcaaaaggaatcaaattttaaaagtacatttttatggaagttctcattttatgaaaaataaatatttatactaaaagaggttctttctgttctgttgtactctatatgaagaagcacaataaaattggagtacagggagaagtaagggtcattttgtttttgtgggggtattttttgtttttttgtttgtttgtttgtttgtttttttagtagagatgaggtcttgctatgttgcccaggctggtcttgaagtcctgagctcaagcgatcctcccagctcagtctaccaaagtgttgtgattaaaggcatgagccactgcacctggcttcttttttatatatgtatttgtatgtacaaaaataatatattctaattaagcattcaagcaatacaaaattctattaagtataaatgaaaaaccttcactcctttcccaacctcatttctgttctcacaggtatccactagtaaaagcttgatgtagatccttttagatgtttttccatgcatttataaatgtgtgtatgtgtgtatatatatatatatattaaatatgtgtatgtacatgtatgcatttatatgtaccctctctcacacataaacacagcatctaagaaatctttctataataatatatatctcattcagctggatgcagtggctcaggcctgtaatcccggcacttggggaggccgaggtgggcagatcttttgagctcaggagttcgagaccagcctggacaacatagcaaaccctgtctctactaaaaatacaaaaattagctgagcgtagtggctcacagctgtagtcccagctacttggtaggctgaggtgggaggatcacttgatcccaggaggcagaggtggcagtgagcccagatcacaccactgcactccagcctaggcaacagaaagaaatcctgtctcgaaaaaaaaattatgtatatatttgtgtatatatatatttcatttgaatgactgacatttcatagataatatgccaaaaagttattga

SEQ ID NO: 39227 - DNA, 1089 bp, Homo sapiens
aaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgc

SEQ ID NO: 39228 - DNA, 1050 bp, Homo sapiens
agagatcatacatgaagaaagcttttttttttttttttttttttgccttacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacattacttggatgaactgtggctagcaaaatggaattaacttagccactataattttttaaaacattaaagtttctaaattgtttttggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagt

SEQ ID NO: 39229 - DNA, 1034 bp, Homo sapiens
tggctcacttgcttctataacctattgaaggagagaaggggttccttagtggctcaacttgtttatctaagggagaaaattcttagtaaagtcttgcctggcttgtattgaccagtacaagactaacttttgttgttgttgttattgttgttgagacggagttttgctcctgttgcccaggctggagtgcagtggcacgatctcggctcaccgcaacctccgcctcccgggttcaagcgattctcctgcctcagcctccctagaagctgggattgcaggcatgtggcactgtgcccggctaattttgtatttttagtagagccggggtttctccgtgttggtcaggctggtcttgaactcccgacttcaggtgatctgcctgcctcggcctcccaaagtgctgggattacaggcgtgagccaccgcgcccggtcgtataagactaacttttaatccttaattcattttgagtaaaagcaatcactaattggctttttaacaggataaggctcttaaatggacacttcagtgacctttgcagggacagctgaattgtatttaaaaacagaagtgtggttggttttctgaagagctatgaaaaaatatggattagtcccatatactttttttactttaatttgtaacacaccaccaaattcgagtagattagaaataatgaataacccctagaaacagtgtaagacagtgtaaaaaggcagtatagaaatgattgatgcttgagcaggccctgattttgacatgaaagaaagatggtggtgctgttgtggaaagtagctgggcaaatgtcatgtagttgagaactactgcaaccaatgaaaacacagcactcctctaaaaacagagtaatttctctttaaactcttaatcgtgtatgtgattgactacttttcaagatttgaaaaatatctcacaaaggtaaattcatttaacacaaactgaccttgtgtttaaccccaaacttctaaggataaatatcacaaaggtacctttttaaaaacctaaaagactatgta

SEQ ID NO: 39230 - DNA, 1065 bp, Homo sapiens
aacacatggcggttgtcctcacgttatgaactgtttggtcaaggagaggaaacaagcataagaaccagtcagagaatgtaggctagcaagcacatgtttgagtagattgcagcgtgtgaagaaggcgggaagttcacacaaagggaagttctaggacagtgatcagaaagggcttcatgtcggagggtaggaaccgagctggccaccaagtggtgggtactgttgacaggagaaggaacattttcagtcaggctgccgagacagtgagcactgtggttccgtgtcaggcacatgcgcgccaagtaaagtgttttgcattattacatgactgaggaatgaacttgatttgcatggtcatatagaataactgagaaatttggatacacagagtaggccttgattttataggtccttgagaaccagggccttaaatacagagtgaaaaattgagacctgtcagaaactcaagaaggtcacatgaaaaactattaaaggagcttaatctcgccatgggtatgaaggttgtagtagatatagactagctatatgagcggttgcagtcatttatgttttggttaactataaatgaggtgatgccccaaagaatagagtgaaatcactgtatgtaagagatttcaaggggacataggacagagcaaaatgatttataaccacccgaggatttaagattgccaattcatacaagggctgtgccattactagagattaggacattatctctagtttaagaggaaaatgtttaattttggtttgaaatttcaggcaagtggagttaagaaactctgggatttgaatcccagaatctcacttactgatcattctcaggcaggtgggccatttaaactttcctagtttttgttcttttggtaaaacatggtgatacctcatgggatctgagggataaatggaataatttgctagagaaggcattgtgatgtattatagagagttacttttgggtttatgatggaatatacatgtttaacatatatacaacctggagcacaggtgagagaacacagaatgtagttgtaatagtttcct

SEQ ID NO: 39231 - DNA, 1071 bp, Homo sapiens
gacccctgatgggaggtgtctcctaggcaggaggcacaggggtcagggacccacttgaggaggcagtctgtcccttagcagagcttgagcactgtgccgggagatccgctgctctcttcagagccggcaggcaggaacgtttgagtctgctgaagctgtgcccacagccgccccttcccccaggtgctctgtcccaggaagatgggagttttatttataaggtcctgactggggctgaggcagcattttgtttcctttttttgtcttggagtgttcattctttattcttcactagactgaacttagttcttaatcgttcttttatcctcaatatattaatagactcttgctatcataggtccttatattgtgagttaagtgaatgaattgttgctatcttgggaattactgcttaatttttgttttccttctaggacctcgactggattttgatcctgacattgttgcagctcttgatgatgattttgactttgatgatccagataatctgcttgaggatgactttattcttcaggccaataaggcaacaggagaggaagagggaatggatatacagtatgtgtggtttgtttcaaagcagagatgatgacctaagtgttactgcttcagtgggatggtaaccatagaacgttacagttggaagagaccttcaagagcatttaatctgagacttctgtattttagagcagaaaatgtgagattcattgcttttcctaccaaaccagattgatcaaacaccctcactcttcctgcctagacaagaacccttcctgaaataccttccaattttacttgtgtaaagtggttttgttctgttactttttaagttgttttggtaggtaatttatgacctttactttaggaaatctgagaatgaagatgacagcgagtgggaagatgtggatgatgagaagggagatagcaatgatgactatgactctgcaggcctattgtcagatgaagactgtatgtctgtgcccggaaaaactcacagagctatagcagatcacttgttctggagtgaggaaacaaagagtcgcttcacggagt

SEQ ID NO: 39232 - DNA, 1087 bp, Homo sapiens
gttctccaagctgagtggaataatgcctttcatttacatgttaaatggaagcctatttttaggctaaatgtaagtcttaaagtactgagcagaaatatcttccacatcctattgttgcattaaatccctactgatattttaatggtaattgtgatagtacctgaataactattgtgtaagaataaagttaatgtaaaaaaatttttaagtgtgtagtcttactgagtacatttgcttttcatggtatcttttctctgtttatattcaagttttatgagcaatatgatgatgatgaaattggagctctggataatgcagaattggaaggttctattcaagtggacagcaatcgcttacaggaagttttgaatgactactataaagagaaggcagagaagtatagtgacttttccttccttgtttagctgttcttttttttaaaaaagaaaaaattccaaagaaaggtctatagtataactgaattgaggaaaaaattaacctagtcaaaatacatattgagaaaatgaaaaaggaaaaaagaaaaggggaaaaaaaaagatagggcggaaaaaagaaagtggtacattttccataaacttgggtcatgtatagctcattgttttgcctacattttggtgttaaatgttctgaagtagaacgtaatgggaatatacgaggagccactttctccgtatctttgactggagaagagtcatggtagaatgtgtattcgtttattaaatttttttttttttttgagacggagtcttgctctgttgcccaggctggaatgcagtggtgcgatctcagctcacctgcaacctccgcctcccaggttcaggtgattctcctgcctcagcctcctgagcagatgtgattacaggtgcacaccaccatgcccagctaatttttgtatttttagtagagatggggttccaccatgttggccaggctggtctcaaactcttgacctcatgtaatatgcctgcctcggtctcccaaagtgctgggattataggtctgagccactgtgcctggccaatttttaatttttttttaacttttatttattttgcttaaaagtttt

SEQ ID NO: 39233 - DNA, 1034 bp, Homo sapiens
ggtgtggtggtgtgggcctgtgctcccagctactcaggaggctgaggtgggaggatcgcttgaatccaggaggcagaggttgcagtgtgccaagatcgcaccactgtactccagcctgggtgacagagcaagaccttgtctcaaaggcggaaggggaggggaaaggctgcctagaacattgctgaagtgctgtctagtgttcctaagctcaaggctgtgatttgccctaaggagaaaatatgtgcattaggtaaacattcagtcatgagttacagcactattggcatgagttcaacattactgaatcaacactataaagaaggtgtctttaaacagaaacatgcataaaacaaggttttgtattgatccattaacaaaaatgttgtgaccagagactcacaggaacctaaccctatatttcccctaggagccacagttcagtatttgctaattcagtgctcacagtgactttatagaacttaactaccaaaaataatgagaattgactgtatgtctgtatctatacctacctatctgtgtttgctgtatactcatgccttcagacatgccttatattgactaatgcacagactgcatattttttcctttccagaaagtagaatcacctagagacagggaagggcatttatccaaggagtaggagacttgcggtgtggggcaggggttgggggcagggcgcgatctaggaatcttaacttctttcaaacagctttccccttggtcctccatattttgacagtctcttcctcctcattcgcctgcctcagttttagaggtacatgctgtccaggagttgctgtgacttttaagagtctgtagtgtgaatctggatggttctcagttctcccttactgttagtttgggaagtagagtttggtgttgctttaagtcctccaagtcagttacaatgtctattagctttccaaattttaggtttcttgttttctttcctccctgtcctatgtttctatgtccctttgtcactttactatagctttattggggtttaggga

SEQ ID NO: 39234 - DNA, 1034 bp, Homo sapiens
aagggtccacagttttcattatattctcaaaggagacctatgacttaatgaaaagttaagtcttgttagaggaagagtgacatattatagggttatgtcttcataatgtttctttttttctgaaattagattggcagtccaatacgctggcacgaactgagggtctcacacttttgctgtaactcaaattctggtccttactttacttctactgccttaaagccactcaaacaaaagacctgattgctagaattaggttgagaagacacaaagtttgaagggcaaaatttctgataatgtttgacccagttttgcatataatgtatttttatttgttgatgaatatttcccttttgttgctaaaagtggcaaataatcagacatagattactaattaacagtctgcctcagttttttttttttttaattaatgaaacttgggcttcatcaagctcaggtggaatggatatcacagtgctttattttttctgacatcaaaagaaatttctttgtcaaagtgtagacatgtttgttgtgactgccttttgtgtgggttcttttctcccagccctctcctactacaggagagagagataatggccctttgctcctcattccgcattcagaccagattccccagctgcaatctcctgccatcggattgcatcaccaactcaacctaattggtgagatgtcactccctccctccaccgctcactctcatttctcagtgagtttagctctgtcactctctctaaaagttactcttgttttagtgatttgggtgtaaacattgatgatccttctaatactctgtcctcttaatttctctaagttctctttctagtgatcttgtctcccagtgtggtgggtatattctggctagaccaggtcattgtttatggtggcagcccctctgtcatctgaatttaagcgtcccattttttcggtactagcatggctcactgcaacctccgcctcctgggctccagcaatcctcccaccctcgggtagctggggctataggcatgtgc

SEQ ID NO: 39235 - DNA, 1061 bp, Homo sapiens
ttctctgagcctgttttctgctgaggcagcccctgggtgttgcccactggcctaactccctccaggctcggcctttcgcctctcatcaaagctcttttttccctggattttaatggttggctgattaaagtagttcatagtaaggtgttaattataactctttccggtggttatgtgcatatattcacagagttgttacagaagtaaggggactgggctgctcatggtggctcatgcctgtaatcccagcgctttgggaggccgagtgggtggatctcctgaggtcaggagttcgagaccagcctggccaacatggcaaaaccccgtctctactaaaaataacaaaaattagctgggcatggtggcgggtacctggaatcctagcaactcgtgaggctgaggcgggagaatcacttgaacccgggaggtggaggttgcagtgagccgagatcacaccattgcactccagcctgggcaacaagggcgaaactccgtctcaaaacacaaaacaaaacaaaacaaagcaaaacgaaacaaaaaacaacggaagttagatggggctgaatttccaactgctaggctagaactaggacaacactgtgagggaaatcggagtgtaatacattccgcaaccccacctgtctactatcgcaaccccacctgtctgctatcctccctttgcaagcccagggccttgatggttcaaggatgagtctttctagaaaaaagggagagaagtttctttccttttttttttttaaacaaaagaaaaacaaacatgtttattaagatatgcgtagtgcatacacatgggagtacccagacatgagtaattcaaagggttggttagaactgggcttatctagcatcttaacaaaggaacgataactttttagagaggtgatgaaacaaaggaaaatgactttaagcttccaggtgttaccagaagtttcatcaaatcaagaatattcttaggagtgtcaggggtgtctaatagttgagctgttaagtaactcttaaacttgttaatgtctcttgggaatttcttcttttagagttgt

SEQ ID NO: 39236 - DNA, 1043 bp, Homo sapiens
cttgttcacgattgtgtccatagtgccttgtacggtgcctgttctgtagggatgatagatccttgtgaatgaatgaatgagtgaatgaatgaatgaaaaggcggagtcacttaaaagaacaaaagcatttgtaatagacttgctattcctgtttattctttgaaatttgaggtaattcttaactagccacttaggatctccattaagaaccctagtcaagacctttgggtattacctcaaagtaaaacaaagtgggagtattttggatctttggaagttaacttgaaaaaatctaaggattctttaaattgaatatatagggaagagagaactcctactcagaatacttaagttacaaacacaagaaaaattcatagattaaaaaaattgaacaaagagtatcattaagtcaaaccgtttttaatagtaattttgtaaagttatttatgacactattttttatgtatattctcagttctctaaaacctgataattttggtgatttactcttatctgtgctttgaacactttattcttataattaatatcattatttttaacttactgaaacctttcaacttacgtaatcagtaatgttctcatgctgatattaaccttttatttatttatttatttatttatttatttatttatttatttatttgagatggagtctcattctgtcactcaggctggagtgcagtggtgcgatcttggctcactgcaacctccacttcccggattccagccaattctcctgccttagtctcccaagtagctgggattacaggctcccaccaccacacgtggctaattttcgtatttgtatttttagtagagatggggttttgtcatgttggccaggcctgtctcgaactcctgacctcaggtgatccacccacctcggcctcccaaagtgctgggattacaggtatgagccactgagctcagcctgatattaaccttttaattcaatacagtcttcccataacagaccttctcccattgatgggctcatttttattgctctttgttctctactg

SEQ ID NO: 39237 - DNA, 1075 bp, Homo sapiens
ctctgtcatctgtcgccgaaagactcataatccgggcagcctcaagagtttgaggcgtgggtttgtgcccgagtttggggttctaggggaggggtgaagtggaacaggctttcagcagctgctgccgccacctgatacctggaaccttactgctattgaggaacatgtatttcctcttggcttcatttgctgtttggctatgactgaggaagacaggaggtattgcatagtatcatttactttcataaacataactttgacatctctaggcttcatgttggttcaggcaatgctctcgaaagccagggagctgctttgcaagatgcatgctatggctgaaggaacggctcaatagctgggagctggccctgaggtttaaatccactcacagcacgaatttggtgttttactttgtgtcctgaaacctcaataacctcatttttcaagtgagagttgaaatattgacacaacttaacttttaagaattttgaaggcatcagtgaaaataaattgaacgaactttgaagttcagagatctctaaaagtgaatacagaccaaattatatcctgatgatcaagtaggaacatccgtagttccagtactatagttcattgacaacctccagaaagttacggtagtctaacattccttatttaaaaccaactttgccatgtttaatttatttatacttttatagatagacagatttactactggacattctctggcagagaaaaatttcatggaaagtgaagtttaatgtgaaatggcacataagtggtcctgacttgcaaactcaggaatggcttgttgaccactgtcctggaataagagagcccagctttgttcttgtcttatttctggatcgccctttctcctttgtaccttctgacattgtttctgagttccctcctcccatctgccacccgctcctttgcaactctgtagagcattttaataacaggttgtttgtgcctgtcttgcctctgcagcactcactcccacctgtttcctcagcctctgacttctcctttcccctttttggcatgctctgacctgcctccgtagttgaac

SEQ ID NO: 39238 - DNA, 1050 bp, Homo sapiens
atgctcatgaaactggatttggatctgtttcatgttttcacttgcgttctctgacccctacttagagggcaccaggtgcttcctattctaaccgtttgcaaattcaagacttggttggagggccattcaggggactggtgtggggttagataggatctggacacagcgactccctcgctcctgctccagtattttgaccttaatttgaacagttcaatgaactggcaactgaagtcgttttttcccactgaactagacctttcattgttttgcagaggaagatgactcatagccaggttctaccattgtgctaaagtgaaattttagtctaggactaaaggaacacaggccaaactttctgtctgagctgcagagtattgaaacttagattgtgagctgggcaggaattcctgtggccctctgtgtggagttgctctcaaggaaaaggagcatttaaatacgtttttgactccaaatttaatttttagtaatatagttcaaatgtcctttaaaatatcttaagtaatcagactgttttctaaaaaaaaaaaaaatgtaatgcaaaatgaaaattctacaaagtagaaaactgtcatttccttcctctctccaaaaccattgttaatagtttcgtttcttctgctacccttgttttctatgaatgtaaaaatgtatgcctctatgggtgagcatggcttttcttttttgaaccaaaattgaaaccatcctgatttagtggcatcccacttaaaacattattaaaaactacctgtgtacatgtatcttcgcttacttgggcaattgctggggcaaatatgcttttactgttaaatcgtcatctacaacagatgacatgtagagagatgaaatgtagtctatagttgtttgaacttgcatttctttttttgtggaactgaacttctctgcatatgtttattggctctttggacaaattcgtcagtgatttggcttttcatgcattgctcattttcttttgttgcttggatccctgacttttatactcttaatgattccaagggaaattcctac

SEQ ID NO: 39239 - DNA, 1028 bp, Homo sapiens
gaccataaaccttatactgtcattctagagggtgtaggaccagtatgaagagggaggaagtcacgaattcctgagtttttattggataactttaatttttgtttttagcatgctgacattttgattatgctgaaattttacttgcacaaaatgtagcagaaagtgctacgggtactagctggaaagtagggctctgatttgatccgataaacctggatttggtcactgatggcaggactccggggtttagggtgagacaacctggtcccttgggaaaggtgcccgagcctccctctgttgtaggcagtgttgggctccataagtgtaccgggcagtcatcacattctgcattagctccgcctcattgtgctcaaggagctcgactaataggactattttaaactctccaggatagagataaccttatttggtgctttactaaaggtacagactctcatactttttccttctctttctttttccattccacagatgaacacaatgacgtacagaagaaaacctttaccaaatggataaatgctcgattttcaaaggtaactgagactttcaaaaacttcgatggttcagatgccgcattctgattgaaggagtttggttggaagtgcagtgaattttccccaggaaatgtcacctagccgaagtcttctgagtatgcagatacatttgttgttcctttattctgtcctaaaatatgtttaaacggaaattctcatgcacatagtttatgggacgctattgacttttacctggccttctccagatatctaaggcagcagttagctgctttcgattctgtgaatcctgggtacatcttggaaaagaatatatcattgggaaaatttttgagttctcttggttaagaggatgatgatttcattttgcctggttaaaaccaaatgttataattcaggcagtctttctaccctgtcagaaatatttatggatttttattcttgtggatgtggctaataatatttatctgccttgtgggttgttttttcttgtgt

SEQ ID NO: 39240 - DNA, 1090 bp, Homo sapiens
taattatccactgtttcgactctgtgctgattggttcatttcttaactcatatattcagtttcctggattcttcaagccttcctccaaaatgtcttttgtgtgtgttttcattttattgcagccttcatactcatttttattttatttttttagtattatactttaagttttagggtacatgtgcacaacatgaaggtttgttacatatgtatacatgtgccacgggtggtgtgctgcacccattaactcgtcctttagcattaggtatatctcctaatgctatttaaagacttcattttctcctatagtttacaagctgtggcctacctctgctactctgccctgcagttagagtggacttttcccccaagactcttgttcatgcaggttcccctctgttaaatgcttctgcacccaccattatatggcagcctgcacatttttcctcagtttaaatggagccttttcagagaagtcttttctgattaatctatcaaaatacaactctctgtctctctctctctttctgtcactctatcttggtttcttactatcacagtatttttgtaaactgtgttaagaattttaaattgtatcttaagagcattgggaaagccagtgaaaggttttcagcaggtacgtcttatgatggcattacatttttgaaagatcattctggctgctgtgtgagaaatggactgtggattgtgaaggtgagagtgttgggtgggggaaaacaggaaagtaaagacacttgttagcaggtattccagttcagaagatggatgtgtgtggttgtggaaatggaaaggtctggatggatttgagataagtcttttttttttttaatatatattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtccttgagattagggagtggtgatgactcttaacgagcatgctgccttctagcatctgtttaacaaagcacatc

SEQ ID NO: 39241 - DNA, 1045 bp, Homo sapiens
gtttgcaaaatgtgatcttccctttctctgctttcccttggcaagggaaactcctcagtgtaatgctgttgttctcctttaggaagccatccatgccccaattggattagaagccactcctgtgaattcctggaattagcacctagcaaattcttttgttattgcctgttactttccattgcttactagactagaagctccttgggagctgagatttgtatctggttcactttcatatcaagagcccagcccagtgcctgacatttagtaaggctcaatcattacatattgaacaaaagaagatgttaactttagtaatgtctgtacttgttctttgctgattatctaaccaactctggtttttattatctataagcatttataaaaatacaagtgattccttataaaggtgaaaattgttttaatatgtaaagttttaaaaatttttatttaaggccaggcatggtgggtcatgactgtaatcacagcactttgggaggccaaggcgggccgatcatgaggtcagcctggccaacatggtgaaactctgtctctactaaaaatacaaaaattagctgggtgtggtggtgggcacctataatcctagctactcgggaggctgaggcaggagaatcctttgaatctggaggcggaggttgcagtgagccgagatcgtgccattgcactcaagcctgggtgacagggcgagactccatctcgaaacaacaacaacaacaacaaattatttaattattttcttcaattgtttattaaccctataatattattactcttttcatacttttagttgtaaatatatgatctcattttgcatggttaccctatttctgggttgctgtttttgggggagtgataaaaagacatattcctgatgagcatttgagttgctctttctggagtcaagtaaaacagtagaaggaaacatgacaaatggtcacctctgaatcttcaaacaggtttgatgctataagtgcagagctgttgaactggattttgaaatggaaaactgccattcagaccacag

SEQ ID NO: 39242 - DNA, 1554 bp, Homo sapiens
attcattttttaatttatatgacactgtgctttggtcaccaagacctgagctgcctcctagtttttctagccagctttctttttttcttaggacaaagggtcttctttctgaagtcgggcctagacagatcaaggtagttgatcttatttcactggttcaggtgataaactagcagagtagaagcatggcatggatggaaacatatattatctagaaaaggcagtggctgaagttctactgatgtgcctgaatcgttattttaaaatgtctttcttctttgttcaaggaattgaaataaacatcattatttttaagtgcatcattataaatttttgttgttgtattaaaagggacttaagaaagtgatcattatgtgtgacattgcctcactattctgagtgttagaatgttcagaataaattcaagacacattttgtaatatatagactgtttgcttgtttttcatgtctgcatagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcaggtaaggagccaacggtctggaaagtggaggaattctatgtgcagttccagagttaaggagggcttctcgtatcatgaactttaagttaatgctgccctgattaacttcctgtgaggatgttcatcttcagtgagttgtgtgaccgtattttctcttccttagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatggtaaacccaacaattttaaaatctcctgtctcagtttgccttaatgtaaacatgactcccaacatttagaacttgagtacacttgcttgctttgcaccaaccttctccattttcctttgtgcctgtattgttcaaagtcttaaagtcttctgtattcagattcttttccagattcacacctttttgtaaacatacaagcaagtttcacattctctaaaattgtgtcagtaggatataataataatttttttttttgtagctacaggatctcactctgtcacccaggctggagagcagtggtgcaatcatagctgcagtcttgacctcctgggtttcagtggtccttctgcctcagcctactgagtagctgggactacaggcatgcaccaccatgcctggctggttttttatttttagtagagccagggtctagctatgttgcccacgctggtctagaactcctgggctcaagtgatcttcccacctcagcct

SEQ ID NO: 39243 - DNA, 1086 bp, Homo sapiens
agtcattgagaagtggatggatggcgtgaaagacttcttaatgaaacagcaggctgcccaaggagacgacgcaggtctacagaggcagttagaccagtgctctgtgagttctgctgatctggggaacttgtcataaataacattttgttctttttctatgttatttgctgctattattaaaattgtgagaatatagcatagcattacatctagataaaatatctttcatcataaagcttttatgactttatagctaataaaagaatgacagattcttcaagtttttatttctggacgtggttatagaattttgagaggttatagaatagagaacaagaacaattttggttcattaggagtcattgtatattgcatttcttgtgccacatggtgaggatttaagaaaaacatatttaacaaatgaatttgagaagtgtctgttcatcaaattcatttaagtatgtttttcttaaatcctcaccatgtggcacaagaaaagcaatatacaatgactccatgttgtgcacgtgtaccctagaacttaaagtgttaaaaaaacaaaaaacaagaaatgaatttgctagtaatagtgcatgcagtttatatttggtgaaatcatcaggcttctctacattaattaaaaggctattcccttctgagagtcaagtatttccagtctaatttggcagatggctatatcaagcacccaggtgaaatgagtttcttaaggcacaatatttcttaagtagttagaagtactgactcttaagcagtctgcttgtgtaatatttgcagggagataagcagacaaactataattatggcatccacttatatagtaatgaactcaacatgcatcttttatgtgtttaggcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggaggtgagtttttcaactttactacctacggttttcaggagatgtagactgtagcttctc

SEQ ID NO: 39244 - DNA, 1037 bp, Homo sapiens
ggctggagtgcagtggcaggatcacggctcactgcagccccagcctccagggctcaagcgattctcccacctcagcctactgaccagctggaactacgagcacgcaccaccatactggctaattttttgtattttttacaaaatgaggtctttcattttgtagaaaatgaggtcatgtttcccaggctggtcttaaactcttggactcaaaagatttgcctgcctcggcctcccaaagtgctgggattatagacatgagccactgtgcccagcctcataccaatcttttgagggctatacctctgccagtatcacttaggaaattaatgatagagctaagatgaaaacccaggattgcctggcacttaaccactacagcatattgcctccttgcagaaatgcaagcttagaggattctaaggtgctaagacaaaggttatgtatgtcttgggggttatatatgaatcagtttggatctttagttaacattctgattcattctcatttatgttcattcccatctcagtctcagtctctccctgcctctctccgtctcaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaagtaagttgcagttcagatgaaacaccagcatgatgccagcgtaacatggcatttgttcgggcgacctggttggataccatgtccctccattttatattaaatctagccttttcttttttgcattgtttttccacttctctgtcctaagaaaaaatattttaaaaataatgattatattttattttctttataatttctacttttagattaaggggtacacatataggtttgttacatggatatattgtgtaatgctgaggtttggggtatgaatgatcccatcacccaggtagtgagcatagtaccca

SEQ ID NO: 39245 - DNA, 1608 bp, Homo sapiens
gaaaatgaaattgagcctttacatttagagtgatgatgaaggtaattggcattcatatgtaataaatggatttatatttaaataaatgaaataattgctttcccacagctgagtgtgttacactcactggtatttgttgaattacacattttgttttccatttggaacttaagaattctcactatgttaataagtttgggaattttgtaaactttgacattgtaaattatatagggagtcatggactactttgtatatgtggcagaaaagtttttaataatttaaggttgtatatacttttataatattctgaagcatcaagtaggtcttggtgtttttattttctagaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatggtatgtctcaggaaaaagtaaatgatgaaatcttctcctctcttctagttattttttaaatgaatacaactttgattaaatttcaaatcctgtttactgtgtgtcacagtgatgttttgcttgtgaattaatttcattagactaggttttattttttctttggaaaggtaataactagaaagaatttacagtgtttctaaatattcatgatctgcatggaatgaggtactttcatattttagtaaatgcaccttatttgtttcattttaatgatttcatattgtatttgattttcgtactatcagaagctatttttatataaaatcttcatagtgtttgaataatggcatactggttaagagcacaggctctagcatctgacggcctatgtaaaaattttcattactagcttggtaacactggtaaagttacttaaacattctctaaacctcagttgtttaatttgtaaaatggacattattatatctatctcatacagttttgcaatgattgattatgagccttaaacatgtagtgctcttaaataactatatgcaaaacaaccaattttagattttgctatgattataattattaaatattgtatatgtgttagtctttggttatgccactgctctgtaaatttgcatctcatggaaatagttaccatttaatttttatatggttttatgttcctatgatactaattgtgaatatatggccaccccaccctcccctgctgaggaaggcattgtcatttataattttttttaattctgaaatacctgagataggacttttatcaaatttatagaattactaggtaatggatagagacataaaaaatacattatcatgtgtttgaatatttatttaaattcctcaggatgtgtagggcagtgaagagcatgggctttgctcttgatctctaacagatttatatccacagtccatgacttattatctgtttaactttagctaagttacttaatgttactaagcttaaatttccatatatacagaatgagaacaaaagtatatacctaacagagttgttaaatattgaatataatagtgaat

SEQ ID NO: 39246 - DNA, 1690 bp, Homo sapiens
atactcccctcccacaatctatttacacattcacgtgtattttttgcctttaaaaatatttcttctcggttatacatccaataaaatttgagcaggaagcaaaaacgtaagtgctgcttacttggagatataattagcagcattgaaattgccctgatgacctaaaatcaccctacactggatgctaattttctcagatatggttttgtttgcttagtttctttaaaattttcatgcctataaaataatttttcttttagtagagcacagtagaaaaaaagctgatgtaaatgatttgaaaaataatattgaatttaatttgtttttattgttacgtgattactttggggtgttttatatcatgaagtctttagattagaactgggttatttgtgttaatgttaaatcagaagagatttttgtaagtcctccttatttttttcttagtgccaatttctgtaaaatatttagcaattgagggcatggtaaaaagcagtttcctgtaaagtagattgggatatgaacattatagaaaaatgagaaaaatttaaaaatatttagtgctgtaaattgactccttcgtgactcaagcattttagaaaatgttgatttaagtgatataacttctatttgcttgaatgtatatgtaaatcattttagtttaagtggttttagtcaccccccaaactattctgatcatatttcttcagcaaaaatcttttaaacatctagctgtatatagatgtgtattcatttaaaaattatacatatatgccatggtgaaatcatgtattaaatattagtagtgtataattttgttcttactttctactgttgcctttttgtaccacagttgattctttttctctatgtggtatacacaacacgattttggtgactagtcatttacatacagagtgaaactatggctattcttagcctggccttctagggggcttgagctttcagtgtggtgctgatctcaaagtcttccccggaatactgtgtcttctgtggtattaaagcaactacttctgaatattctgtgaaaaatagaagagaccagaagattccacctgggaagtcacgattgaccagtgatgtctacaaaaggcttgctttgtggctgtgtgtgtgtgttttcatgtgtggacgtggacaacacagaactatgtagttgcttgtagtgctaatgagtaaatagataatgaacatgaaggcacattaatctctcagcaggtttttatgttcactgatgaagtaaggtcacatattatttttcatctacatgtacagctccctgtatttagaggtagttaaggttgagtatgtggttttttagaagacactgaatggagtggtgtattttcgaccggttgaattttgtattttttactctcaaacatttccccacctttttttcacaggagaaccctgctctccttggacaattaaatcctgaagtgatccagggcaatggagatttactttaacatgatctgattgttgagatgtgtgtattttaaggtcaactcttggattccctcagtttctctcaataaccaactcatacatagattgtttgaaccatggagctcagagtcatgaccctctagtctgcaagttagaattcccacttgatcatatgagttgtctcttcttggcttcatgagaaagtcttggttagatt

SEQ ID NO: 39247 - DNA, 1026 bp, Homo sapiens
tgtgtgtgtgtgtgcactacgcggcagatggggggttagggggctggggaggagcatggcacagtgggaggatgaatgggataggagggtggggtggggtagggttgggggtagagttgtctccaagaggaagatgttgggtacagttgtgctttgcacaagggcattacatctaaatggtgtcattcccattgtaaaggccaaagcattgtcaaagggagtaatagctgttacattcatttatcggtttactttctgtttcttcatgtgattcagataagaggcgtttttaataatattgataacccttatctttctgtctttgaattcattgctctattttgtaactctgttaatatgatctttttaaaaactatggtgaaatatacaaaatatggcattttaaccattttaagtgtacaaatcagtggcattagaaacatttacagtggtgcaactatcaccattagccatctctggaatttttttattatctcaaacggaaactctgttcccattaaacagtaattccccacttcctccttccctccaatccctggtaatggccactctactttctgtacctgagaatttgactactcttaccttatacaagtggaattatacaatatttgtctttttgtgactggcttatttcattagcataatgtcctgaaggttcatccaggttgtagcacatttctgcatttccttctgtgtttttttttttttttttttttgaggtggagtctcgctctgtcacccaggctagagtgcagtggcatgatctcagcttactgcaacgtccgtctcccgggttcaagcgattctcctgcctcagcctcctgagtagctgggattatgggtgtacaacaccactcccggctaattttttgtagttttagtagagacggggtttcaccatgtcggtcaggctggtctcgaactcctgacctcgtgatccacccgcctcggcctcccaaagtgctgggattacaggcgtgagtcaccttgcctggccaattt

SEQ ID NO: 39248 - DNA, 1026 bp, Homo sapiens
tcttgtgaaagaacatgattggatttctgctttgagctatctttaagtttgattacaaactgtaacagagtagccttgaggttttttttattggtaactattttgtgatgaggtggttgaaatcgtgcttctttcttgatttttgtttgtttgtttgtttgttttttgagacggagtcttcattgacacccagcctgaagtgcagtgatgtgatcttggctcactgcaacctctgctgcctgggctcaggaaatcctcctgcctcattctcccaagtagctgggaccacaggtgcatgccaccacacccggctagttttttgtatttttggtagagacagggtcttgccatgtggcccaggctgctcccaaactcctgagctcaagcaatctaactgcctcgtccctccaaagtgctgggattacaggcgtgagccactgcgcccagccaagtgcttcttgatttctatcatattgtgatgttcagaatctaatgtagttatgtggcccttacgttactctgccctgtactatcttctttattattttacattcatttatattatacttctaaattataaaataaaattatagtttaatataaactatatataaatctaatatagatttttacactatgaaataatgcacgtttcttgaaagagcaactatagtagtagatacatgttataacgtgcaacgtctcctgccctgggattcttcctaagtaccacacccagaataaccactgtttcttatacagctttccagaaaattttatgtatttttatacaagcacttgtattcacatacacgttgtttaaaaaaaaaaaaagaaatggtgtttttctgtacgtggcatatgtttcaacatcttgccttttcccctccaccctaatggacattgggtaatgatgtaactaatttctgcttttctgttagctttggcagccagggagctccaggctcatttacacttgctgggagccctgtgctcaattataattgcctacgatagcctccactt

SEQ ID NO: 39249 - DNA, 1061 bp, Homo sapiens
gtattggataatactcagtttggtatttgttttctcctgtctagttcttagtacccttagaattgagataattcattatttgtcactcaggtaggtttcgagtgaactgatatatttaattagatccttaaagcccataggatttatactggtcatttctgtcaattgtgaatctgctcatacttgttcttcatgaaactatggaataatttttcatgtattttcatgtgtcaatctgaaaagaaacttaggttctccagaacagaggagtttatttgaaaatagcagaggattataacccagaaaatgtgtgctgagccagatcacaggcgcatcaaggagactgggaccaaagggagacttttaaagacaaagagaagtcttcataaactgtttgttaaaccagaaagatcattggttacaagagcttgctgtaagagttggcgacaaatcattgttaaagacgtcattactagacagatgtccttgtgcaagctgcttatctggagctttgcggtctaggggaatttccttgctaaaagtcctgttacaggcaaatgtgcagtaaatgcgggaatgtctcctataaggcctttacaggcatttgtgagtgagggctcccccttcgtggccttccaactccatttgctagggtttgacataattgattccattttggtatcaacaactttcacacatggatagttcaaaatggaagctcctgtaaaataatactttcatatgtattttttcatggtgtctagtacctgtgccacatagtgaatgcctgaataaaggaccacatgtattacagttgttagattttcttagggaccctattgtttaaatgacttataataagcacttactgtgtgatggtaaacactatgctatttatgtcacctatacttcttacttaacattaacacaactctacacagtttggaatattgttgaaataatcactttatagctgagagtagagcatgtatgggttaaactcttgcccaaggtcagacagtgagttgacttgtgtcttcccatgttgtcactgatgcgtc

SEQ ID NO: 39250 - DNA, 1037 bp, Homo sapiens
taatgtaatgtaatgtaatgactgtaaacattccttcttctctcctggttagtggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgtaagtttatattttttctcattaaaatacgatcactgaatgaaatatgttaatagaaaatgtctgatttttaagtgaattttttaataagtgctttcaaattactttcccagtggaaatatttatgtttgttgttgaaactgaatgattttacaaatcattgagcttcttaacaaacaatagaacagaaaagaatgtacatctttcattttaaaatgttgcttcaatttacaaagactgtcaaatttatagtattctttgccaaaatgctaggggaaacaatatagctaagtcctactttcttcttgtttcataatgtctcacagtatttcttttttcaaaataaaaaatcttctgtttattgttatgaattacagtaatttattagctcataataatctgctctacaatctttgtaatccaactgaagagtgatttgaatggccatgaacgaggtagtcttttaatatttgctttatttgcatagtggttatgtgtgtgtgtatatatatataatatatatatatatggtgttttaaataatttatgctacaggacactttaatatctgtcatttaattaggtactcactgttcataaagcacactctcaactcccagcataactcatttgccattaatttggcccttttgaatacgacagtacatttgtgaaatagtcagttctagaaagacctgctgtgggctgacatttctgaaacattaggaattactcattgttctggtgggaggttaaagtatgcaaagatgaaataagaaaact

SEQ ID NO: 39251 - DNA, 1023 bp, Homo sapiens
ctcaaactcctggctcaagtgatcctcctgccttagtctctccagtagatgagattacaggcatgcaccacagcacccaactacatctattcctttgacaagtcatgaaggaagctttgttttggctcattctttctcaataagaaggggagttcttatgaagatcataaaattaattcatatgcatttattgtatcattttaaaaaggaaatttgcatttattgatttatattatatatgcatgatttatgtttatatgtatacataacccattcttgcaggaacgggttaactacatgcttcttaaaataatctaatatcatatgtaatgcagaatattaagatcagaatattaaggtcattggaattcaggagacaacgaatcagattcatgtccttctgaaatttttttaatctgcatggttcagtccacattaccaaagatatattttaagtaaaagaacatggtagacagatgaaagttaacctcttgcctctctttgcagatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacaggtaagcatgaaggatcactggtgtgtaggatgtgttggcgaagggttttgaggatgttctgagacatggaatagggaactcgggctggagccaaatactggaagactttgggtaccatccaacaagtggtgtattttatttcctaaggctcatttgcttcaaaaaatagcaacccttgcaaagagacttgctgtttttctttgataaaatctacaatctttaacctgtgccattagattgctgtttgtcctgcccttttcctggcctcatctcctaccattcctctccttgctctccgctttccagctgcactgttttatttccttgattcctgcctcagcagtgcctttggacctgt

SEQ ID NO: 39252 - DNA, 1035 bp, Homo sapiens
tgcgcagaggctagggtaaaaaaggtgtgacatttctagaatgctcttgcctgctgtgagctctcagactggacccatcagggcttccttctagaaagaaggtctcatgctgagcaaaacttctgggaatagaatcaatatggagcatctcaaggcaacagaaatgaaaggagaaggcctagtccaaactgttcctacgtgctggtagagggtatgggggaacaggaccaggaagtctcaaactcaagtactgctatgaatggaatgtttatgtcccccaaaaattcatgggttgaaatctaatccctagtgtgatagtgttaggagatggggccttggaagtgattaggtcatgaggatggagctgtcataaatgaaattagtacattcataaaagtgaccccagagagctctctcttcccttccaccatgggaggacgcagtgagaagacggctgtgtatgacccaggaagcagactcactggaccacagatctaccaatcctttgatcttggacttgccagtctccagaactgtgagagataaatctctgctgttttatttaagccactcagtctatagtattctgttatagcagactgaatagattgagacacatgctgtaattgtaaataccacacaaaagcaaaagaagaggaatctctgtgaagttagaaaagctctcctcaacctcattttgttataaaagtttaggaaaattaattatacaaccaaaaaaatgagcaacaaaagtatcaagaccaaatctcatataaaggaattttaagaaaaagagataaggaacaaaattatatcactacaaataaagcatgccagtgtaactactttatgaatgggaggaaaatggaaaagtaaatctatattttaatgttttcactaatcatgtgggtggtagtattggtattagtgttctaagactattgtgtacgtaatatgataaaaagcaaatgaataattatgggattgtctaggtctatcatctcttgtgtccttgagaaccagatttttggtttt

SEQ ID NO: 39253 - DNA, 1557 bp, Homo sapiens
ctgaagagtcttagtttttcatcccaataagataatgttcaaaagtctttgctgtgcaggcatcaacctgcacttcactataggagatgaagagaaaagtaggcattatagatacctactttctttgtctaagtaggtatgtataatagaaataggagaatcaaggagttttggaataattttgtttcaaacactgttagcttttgcagacttttatttaattaaatagctaattttctttgtactgtaaatgttctacattcatttactctccttcctcctcaaaaagctagggttggaactagcttttaattaggatcagttgttttcaaaagtatttcatggagacttgggaattcttcctaggcagtatatgacatccccagcattaagagtgacactgaatgatctggctccagacacaagcccctgagtcaagcagaacaagtttttttgcatcgattcatagtttaaacttctaaaaaacttttttttgaagaaaatgtatcatgatctcaggaagttgccttcagtgttatttatgatgtgacatttttggtgggatctaggggtggtatctaggttgcatgtttgttcaatgtgtgtgtgaggttgaggtattttgggtacatctgggtttggatgtttacatttaaaattacatgaagaacagaaaagtctaattttattgcacctctgccatcaacatataatgtagtgtttcatttttaacttcatctttctaaccaagtttcttctctaggaaaaacaaaaatatgattgcatcccccttggtatattatagaatggtatctttacattattctataattttgagttatttttgagcattctggttttttccccagtatgactgtttaaagatgtgtttgctatccttgaacaaatatcctgtaatatctgtgaaaaggcccctgcagactcttgaatacacggcgacttctctagaatacactgtgacttctgttacttttgatttccccatggtggctctcagggcaaccacatatatgagcggaagataattgagaatctccccacacccccactgcttttgtcttaaattgctctaaagtgtttgttctgtgacttttgtctccctctcccctctttgcagtcctatcacactcatcagtatgtggccagagcactatgagtgagtattcatagcccacgtgcaggagaggtgttctgatcagtggtactagcatgggggtcttactaaactcttggtctaaaataatacttctgtgttccgggtaacaatcctagtggtctgtttgcatggcagattcattacttaagtaacctaacatttctaatagtaacacctatcaatatttgggcataaaattattgctttgtttttttcttttaaagcccctcacaatctcctcaactgtttcatgatgacacccattcaagaatagaacaatatgccacacggtaagaaactttgatcagagccctccactgcactgccacccagaatgtatctatgtctaattaatctaatatcattaatataccttgatt

SEQ ID NO: 39254 - DNA, 1033 bp, Homo sapiens
ggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaagatgactttgatattcttcagctggattcactgatagaatgtgagttttgaatgcacatttatgaaaacaagatatagagatagcctgtgtcctgatacatctacattttttcctgcagtttctctcatacacactaatacagtctcctgttgctctcattctctctctctccccatctcttacacatacatataattatatgattctcaatttattttccagatagaaggtttattgatagagaaaagtaatattggatgtaaaaatgtgtacataaaacctgttgagtgttttaataactagatgctgttgacattaagttcctttcaaatgtacttttagtttcatgctctcaaatactgtatgctttttatccgtacactggattttaaccactctagtaggtttaatcaatttctgaagccatt

SEQ ID NO: 39255 - DNA, 1033 bp, Homo sapiens
atgctgttctcagtatagtgaatatgtctcacaagatctaatggttttataaagggtagtttccctgcacatgctctcttgcctactgccacataagacgtgactttgtcctcctttgccttccacatgattgtgagtctagggctaggggagggagttccccaaccccttgtgattcccgggtgaggagacaccccaccctgcttcggcctgccctctatgggctacacccactatttaaccagtcccagtgaaatgagctgtgtacctcagttggaaatgcagaaatcacccaccttctgcactgatctcactgggagctgcagactggagctgttcctatttggccatcttgccagccacctcaagttaatttttttatactgtgaaaggtaggggcccagtttcattcttctgcataagggtagccagctatcccagcacaaatataaatttaataaagttaacatctttgataaaattgatggatttattgaaatacatgaaatactggacctgattcaaaacatagaattctaaacatctttttatatctacaaaataaattgattcccaattttacaaactcttcacataaaactctaagcccaattagtctctctggtaaattctatcaaacagattagaaataaataataccaacctacaaaaactctttttgaaaatatagaaggaagaaacactgcttttcaattctttttatgagggcagcataatctcagtactaaaacctgaaaaaaatttaataagaaaattatggaccaatatatttcataaactttgaaaaagtccttcataaattattagcaaattaaatcatgcagtacataacaatggcaatacaaaataatgaggtggactttatctcagaaattcagggttacatttggagatcaatcaatgtaattggctgcaacaaaagaaaagtagaaatattatgtaatcataatattttttgattgcagaaaagtcatttgataagattcagcatccgtttgtgataaaaacaaaa

SEQ ID NO: 39256 - DNA, 1031 bp, Homo sapiens
atggaccggggtcagccgcctttcctctgctccaggccgggcccgtcaaccccacggccgccagcgccagcgcctcggtcccggccgcggcctcaaactgcccggccgctgccttcgtccccgccgcagcgcggacggcgccggcctcccctgcgggcctcccgtcactcaccggccggcgcggccgaaccgcggcccaggccctagctgccctggacgccgtgcccagctgctccgctctgtcccggcgacgctccgtaccccacacagccgtccgaaccgcctcctccgcccctcttccccagccgggccgccgccttttctcttctcccggcctgctccagaggcagccaccctcctcgcgcgccccgccccgctgcgccccgcccacccggcccggcttctgccgacagctgggcggggacgcgcacgcagtcccggcggggacgcgcacgccgccctctgaccccgcagcgtcgtggctagagtagggtctggagagagctcccactgtggcgagtcctgtcgttggattcccgcggcgccccgtaaggctccgccccggcggtgctaccaaaccctgttcgattttagaatcgtacattcccagagggaatcctagacccctcattttacagttgaggaaacaggcccaagtagcatgacttgttcgcgccgctagtcgaaggagcagcagccccgatcccttgactctggggcactgctttccctttagctcatttttggaggaaatgggtgcgcccttgctcgacctttggtgattgccgccacaggccttcccgccggctaactcagcgtgcccaagtcccgtgacttagtgccaggacggtgctgtgacccgttatcccctgtcgggttttacctccccccgggagagctcagccctggatcccggcgggcggcggagcctctctggagcccggacgggacagcccaccagggtctgcttctgtgaggggccgaggcgtcattccgcgaaggtaattagctggggaggggacttgaagccg

SEQ ID NO: 39257 - DNA, 1020 bp, Homo sapiens
gctaaattagttctaatcttatcctaacaacagaaggggcttgtagctattatgttttctagagaaaactcagaggatgccatcataaggcaactttatttttcacaatggctgttatctttaaacttgcattaaagagtaattaataattttcttctaaccttaagtgacagaataagcttgacagcttagataatgaaaagtcctacattcacttcttatcacaagagtctgtgtttcgtaacatgtccagtccggtgtaatagtaagcaactttgtattttgagtaagatgaaagtttctgccttcccttggagagagcctggtaaaatcgagagtcctcagtctgacttggggaggcctttaggcagtttttttccttagacagtaacatctcttcaaccaacaactaacaactactgtttgaaatggaaggaagcagggagaaaagtcaagaaaacataaaaggtcttctttgacagacactggtcagttagtatcaatcctctgtaaagctactaggactcaaagctgacttttctcttggggcactttcatggattctgtggagaccttctccccaccccaaatacaggagatgcatccccttcaaatggttgtttatgtcctccatcatccctgagcatctggatactcttccaatttttctctgctaaattctccttagccctctaggtagcacttgtgggaagacttaagaaaatttctcagccttgtttttcgttttgtatgaccgatatctggtccacgggaatcacagtggctttgagtcatcatgtgtgggagtgcgatcctcttgtttcagctccttcacagacagctccagctttttacctatgagatgtctcagatatggtagctaaaaagattaaggaacgtatcttgagtaatcctgctgttctcttgaagatctctcactagtttaggagaaagaccaggaagataggggaggtaccacagtataataatctccagggaagtcctccctttgatattcag

SEQ ID NO: 39258 - DNA, 1078 bp, Homo sapiens
gaatgctggttaactcaaccaatagggtgacgagaatttccctaaaggagagggagccgacctcacaaagaagagggcgggtgcttctgacaggtttggaacttaaaaaaaccctttgtggcggttccgtggcttttccgcagaccagagcgcgcgaggagtcattcgctaggaacctgtccccctctccccgaattaggattagtcttcctgcacttccttccttccttacgtctttcctatttccacatccttcctaatcaagtacctgtgcttccgtccacctgtcctgttgaacgcactctccggggggtttccccggcacaatctcttgtctgtcttttccaacttgagccaggcatttgtctccaagcattcacgcgagatgggcagtgcggcctcggaaagatctgagcaaaaacttcatcctatccccctttccccgttctagagtgaagctcccagggcattactgagtggctcatcagcgtcagggcagattgaaggttctgaaaaatagtggcagcgcggcgtttcctgccacccgcgctcctccccggcgaggggctgggtgcggggtagtgtcatcggcccgggctgacaccggccctggaaccgttccccgctggcagcctcttccatcccagcagctaactgctaagaccagacacgttccaccaacagtaacagctgtaggaaagaacccgttttttcccgtctaggtttctctccttttcctagtacctaagtccatcatcctcctgccactgacatatcgttgtctagacgctctttttcaaaactcaaatccaatcaaacaaaaacaacgcccgtcaataaagcaagaaaaataatactgcagccagcggccaggagcgtgcaccccattaacggcgagaaagcatcaacccctgctgtaatgactgaattggaaagaaaggtttcctgctgcttgttagtcgtcaacatttttactatgccagctgcaagagaagcagctgcatactctggcaactcgactggggtgggagaaatttagccagcgtctgggattttcgcagaagataatttaagcccc

SEQ ID NO: 39259 - DNA, 1032 bp, Homo sapiens
gatgcctttaaagataaaagtgaatgtaagcattttattaaaatattgtgacttctttgatgttacagatgtttgtcaaaaataaccgggaaaaaactacctgaaaaatgaataatgtattttttaaaaattcatggctgggcacggttgctcacgcctgtaatcccagcgctttgggaggctgaggcaggcggatcacttgaggtcaggagtttgagaccagcctgaccaacatggtgaaaccccgtctctactaaaaatataaaaatttgccgagcgtggtggcaggtgcctgtaatcccagctacttgggaggctgtggcaggagaatcacttgaacttgggaggcggaggttgccgtgagctgagactgcgccactgcactccagcctgagcgatagagtgagactccatgtcaaaaacaaaaaacaaaacaaaaaaattcataaggctcccagaataaaattcagattcttggccactttctttagaatcagatatattacatgcctcttgttggaaagaacatatatggtaatttcattggaaactgaaattttatctactttttgaaaatattttatagttgcccactgaccactctttgcattatccagtagcagtaaatatagatataattttatttagtaaatgaggctaatttttacttgattccatttctccaactagtattcttttggaagtatatgtaaaaatatatatatgacaaataaatgaaatgataacatgctgagcatatttctttatatttattggagctatgattttaacgtgagcattcacccagaaaggtttttaaataaaaaatagctgataatttttgttttatattaatcttcatttgaaaaataaggtttgctttatacagcttgttatttgtaagatatatgacgagtcctagaactcacatggtagctattgttaaacagcaagttttaaacaattggaggtgttttaataatagtgtttggtcttgttttttattttcaaataagtgcagtctggaacttt

SEQ ID NO: 39260 - DNA, 1174 bp, Homo sapiens
catgttgaacaaggaaaaaattaatcacagtattgaaacaaagacacagaattatagtttctctgctaatcgcataacattatcaaaattcgtttctttgaaaacagcttaatgaaaagtgtacaggcattagaaatgagagtgatgtgatgggatgaaattaaggactagaacataggcatgaaatgatgcccaatcctgttgggaagatgggggatctgctactctggacctaattctgatctacaaagacaactggttggtgatatggaaatgatgagtcatcttggaaattgtaggtatagagtatcacatattcaagcacaattttaaaataaaagaaaaattctcttaatattcagaggaaagacagttatgatttgataaacttgaaactgttaaagaaaggatgttcaggcagtattggatcacctcctagaataaaattatccatagtaaggagtctctttgaatacctctacccttttccttgtcagaatttctcctacaattctgcatcttttgtttcaatattgtgattaattttgtccttgtttaacgtgtgcagttagttaatttaaaatctttgttacacttatatagatttttaggggctggtactcagcaaaacactcttttacaacttcctgacaggaatttcttctgtcaaggaataggggaaatatatttaaagagactgttctagttccaaaagggccttacaatgtgttaaaggtataaaaagattatataaaaagacattaaaagattatatggaaggaggaggtatataaccaaaggcgaatataagaagagtacttagctcagctgggtgcggtggggtggcttaagcctgtaatcccagcaatttgggaggccaaggtgggcagatcacctgaggtcaggagttcaagacgagcctggccaacatggcgaaaccctgtctctactaaaaatacaaaaattagccaggcgtggaagtgggcacctgtattcccagctactcgggagcctgaggcagggagaattgcttgaacccaggaagcagaggttgcagtgaggtgagatcacaccactgcgctccaaactgggcggcaaagtgagactccatctcaaaaaaaaaaaaaaaaaactacttagctctgccaatgaactgataaacagaatgagcttt

SEQ ID NO: 39261 - DNA, 1046 bp, Homo sapiens
gccaacaaattgagtaatctaaaaaaaaaaagtgtatgaagttctgggcacatacagcctaccaagattgacttaggaagaaatggaaaatttcaacagaccaataacaagcgagggaattgaatcagtaataaaagtagtgtcccagtaaagaaaagcccagacctggacatattcagtgctgagttttagtaaacatacaaagaagaatatcagtctacctcaaactgtttcaaaaaattgaagagaagggaattcttccagactcattatacgaaaccagcattattctcttaccaatactaattcctgaaactattctaaaaaattgaagagaatcctccctaactcattctatgaggccagcatcaccctgataccaaaacccagtaacacacaacaaaaaaagaaaactatcaacagtacctctctgatgaacatagatgcaaaattttttaacaaagtactagcaaactgaattaaacagtacattaaaaagatcatgtaccacaatcaagtgggattcatcctagggaatttcttgtgcactttcaccagttctgtccaacatagtactggaagtcttagccagagcaattaagcaagacaaagccatccagattggaaaggagagagtcaaattatccctgtttgcaaacagaatgacgttttatttatatagaaaatcctaaagactcaactgaaaaactgttaagactaataagtgaaattaataaagttgcaggatagaaaatgtatggtagtcagtaacatttctatatgctaatagtgaactaactgaaaaagaagtcaagaagacaatctcatttacaatagctactgaaaaaagatagctaggattaaatttaacaaaggagataaaagatctctacactgataactataaaacattgaggaaagaaattgaagagcacaaatggaagtgtatctttttcatggattggaagaattaatattgttaaaatgtccacactaaccaaaatgagccacagattccatgtatttcctatcaaaaaccaatgaca

SEQ ID NO: 39262 - DNA, 1053 bp, Homo sapiens
ttatagaccttgcacaaaatgggtaagaaataaaatttggtgagtgattctatcagtatgtggttgaaaaaagatgccttttatcatagcattagctatttcatttctttgaaaactctacatttatatccataaccttgacctcttttgagagctccagactcacatatctacttactcaaatttctctattatgttgaatctcataaaattttcatttttaggtaaaaatttgttgtagttctgaaatttcacatgattcaacctgacacttagatatcctggggccacacaaaatcagcacgtcaaaaattaatcccatcagtatttacctccaaaataagctattttaggctttctacgtctactcactctcagttgcaatgtttatacgtgcttttgccagattcgttttacacacagttccaatcttgtactatcctcttcaaaccatggttcagtattgttttttgatttaaaaacatctgctactccaaacagtaggaattcaggatttctttccaacctgatctctgtcttctcactagtgtctattccttaggaaaacagaactatgtattcaacagacatcacatttctatgtcttctcctatgtaattcccaatacctgaaacactagttgtttcactgccataaaactctatataactttcaaagtcaaccttcttatctttttcgggcttttcctatcctctgtttaccagatgtattatatctgatctgtaacttcacaccatagcttctttgtaacttttcatggtatttgccatattctgctttttggatcatagatgataatgtttacttacaaattatttgaatggaagcacattgtattatttatctttggagaaagaatcattaagtatggtttttaattgagtttactcattcagtattgcagtgtttctcaatcaagggtgatttttgcattccctgcccccagccccgcccttctcccacccagagaatatatggcgatctctgtggaaaccttttcagtgggtttgagggtgttgcgactggcatcta

SEQ ID NO: 39263 - DNA, 1050 bp, Homo sapiens
ttctgtgtgtcctggtcacttaaatcttaaatgtgcccatatatgtacttctaaaattatccctggaatgcctggttctgctcttgagaatttgtcgtgcacatttaatatgccagagggagggaggacacttccttgaccctaaccttctatacctaattcatagaagtagaagatagaccactcagacccttcagtctactcctgtgtcaaggctgactctgggaagaaatgaaatgcctcagttgttactctgtcgcttgagatggagagctgtagctgattagtgggtatttccctaagaataattcagaaattttgcatcagccagtgtagagttctgaatgcattgccttgcaaaccttgaccagccagaagtgaactgtagttcaattcgtataagcagtgccctcagtgattcacatttaccctgaagtctgaacaactttcgctgtttcctagcatgtatgtcatcaaaacacgaggtgccatggtcttccacattagaaataccaactgaataattcagaagggttcttacctctgagtttggtggcaggaaattcaacatcgagtagtcttcctgctgttctctcacacactgtcatttcaaggcagaagccttaagaattgcggaagtaaccaggctttgcatatgttttgctacagcaattactaggcaaagagttgtgcaatcaaaaatgtttttaacttaaagtcatagtagagttttttacaataaaagcagtcacacactaaaattgttcacattttttaaaaaaatgtgcctttcaagtacacttgaagttttctggtacaagtatagcaggtattgtttcagaaggtctcacactcttttaaacccctctttatctcttcctttctaaaatcctaatgacaagtttagttcagcatggatttaactattcatgaggtttgggaataggtagtcatacctgctgactagtttcacttgtagttctctaccatcatctcaaacttaaccccatggtctcctaaaactacctctttatccctccctccctccct

SEQ ID NO: 39264 - DNA, 1024 bp, Homo sapiens
tttttcttgttttaaatagaatatgtaacatgtaatacttgagcttgactatttgaaagactacattagaaaatttatcagtgttgataatgttattggaaggatagttctttgatgacattcttgctttatttttatcttattggtgagttttactttttgtcactccagtttctgtagttatatattttggggaaagcatgttatgttaacttcattcagcttttcaaaattttggtagtacagttatgcataattatttttaaacctcaggaagcattgttatatcctttggctttgtttgaacctttcagtgtgtttttttaaatcacaagatttgggtatacagaaggaaagttagtgtcacgttttttttcttctttcaaagggagactgccccattttagactgtaaagtttttttgcatttgaaaaactaacacattagtttatctccctacattagtatttagttttgttataagaattagcataaaatatgctattgaaaaacataaaatgtcaatgaaacattggaaaaaaactcatagatcttctgaggacctccctgtcaagactggtattttgtgcatgaagctgtggtgtcaaaagtattaggacttcttgagcattctgaactcaccgtatcatccgatctggtacctgctatgaagtatcctgaacctcatgaacttaccacctcttcttcctcaatatacaagcatttatagcttcaacttataggtagttatacagtggctgggaaaacataagaattagtacctccagggttgcactagtaaaagagccaccttgtgtggaaggtgagtaaatagcttggccctgaaagtttgcccctgagttttacctgttcttcgagagtaactgctgctggtgtcagtttgtgtgtgtgggtgtgtgtgggtgtgttgtgggtgggtggtacaggatggcagtcacaatttaatggttaacccaagcatgggaaatcaaccaccctaccttttttttttaactgcctgaca

SEQ ID NO: 39265 - DNA, 1050 bp, Homo sapiens
gtgttggatctctgcctgtggtgacaaaagtaatattgtcattttattctaattgttgaaactctcggtataaacaaaaatcaacttgcttttatgacagcttcatcagtcatagttctttttaccttttacctttacgttattttttactataaatttcagattctaaaaagtgaagttatagttctgtttttctttcaagaatgcttgtttagaaaaaagatgtggacacagtgggtagaaaaactaaagggaaattacaaaacatctgtttaatttgcttctcttggacatcatacatcttttgttggtattgaaatttgcattgcagacataattattgtgatcaggtataacttcgttattcctactaaacaaatgcagctctttactgtttatacaaccagacagtttgatgtccttattcaggtttataagaagagagcaatgacccaccttaacaacctgcctacactctctgagactagttttcctcagactgaagaaaccttctgtcagaggcaagggttgaagaatacacagtggaagaagaaaacagaaacaatgtgtctttcaataactcatccagattgcatgctttcagtttgaaggtcacaatagaagatgagtaacttcaagacatgaacagaagtttcttgataagtacagtgaaacgagctagctgggtaaatgagtttcgtaagtgattctgggactcctgagaattagaaatatgaacatcataaaattgttggacaaagtctacaaccccatcatcacaaagttataccagtgtacagagtacaagccaggaggaccgactgactagaggttctccagagatgggtctacttcttgtagtggtcttgccatcaaggaggttggctaaacagacctgaagcgagtatattccccagaagtcataaaaattgaaagatacacggccaggcgcagtggctcatgcctgtaatcctagcactttgggaggccgaggtgggtggatcacttgaggtcaagagttcgagaccagcctggccaacatggtaaacc

SEQ ID NO: 39266 - DNA, 1034 bp, Homo sapiens
gttctagaagtctctggacattcaaactaggtcctgagaactgtatattttaaatgcttgcattggaactgttttaaaccaatgatctcaagtctttgtcttaagttagaaaaagaagggcaaattaaacgccaagttaatagaaggaataaaatagcacaaagtagatatcaatgaaataatacataaataatagaggtaaagagttttcaaggatgaaggtgaacagttttcaagtatgaagacaataggcagacatttctaaccatgaaagaagccaaggaatacagcagtcatttttaagaactacctcatgatgaaagttccacaattaagtactacagcaaaataacccaagagatggaaagccatggtaggaagactgatgttgatctttaaatccatttaaacttaaaagctacactaaacctttgtgcaaattgtgattataatataccagttgtaaaacttataaatgtgaaaataatataactaatacaaatcaagaagaaggaatgtttgatcataaaaggaaaagagggctactttcctgatctttcgtagctgagagccaatatttactgtctaatagttacagaaatatttcaacctctgaatgttttacacagtgtattttcctgtccttggagcttttaagaaaagatacatcttgtaataaaaaaaagtttgaaatatagtagttcctttagcttcactttagttagatgtaaggaaaagcaaatgtttattgtatttaagcatatagtatcacaagtgtctgcaaatatttattagtggctatctctatacaaaggatgatatcagatggatgttcaattaatttaatgattatttctggttagcaggatgttgggtgattgtttttaatgtatacttttctgtattatttgaattctttataataagaatgaattatttttacaaaaacagtttaaaattttagtttaaatgttagtaatgacattatatctggttaacaattgctctctgaagttttcccagctttacactaa

SEQ ID NO: 39267 - DNA, 1033 bp, Homo sapiens
cctctgaatctgttaattaagaggatacatatttacattcattctgtgcattgaaaaaaaaatacaagctttaaaatattttcaggaggaagctaaaaaacatcctgagtttaagacaccttacacaagagttgatactgtgatttcatcagtatattgttgtagaacaggcaaaactgatctgtacttaaaaagcattagagccttggttattcccggaaatgggacagggattgattaggaagaagcatgcatgtcctttttggggtgagtggtaatgttctttatcttgctcgttctaacagtttgagttacagaggtgtatatattgtcaaaactcagtgaatatactttaaaatttctgcatgtgtatgtaagttttacatcaaaagaaaatatactgttaaccaaaaaagaaatgtttggggaacatcttgtttcgtgaaaatgtacaaagtctctcgctggttttgtctccacatcccatggtcttagataagtgttccagactgagatagggtataaatcccatgtactccagttgacaccttgtgcctacctttgtgagtagtacatactacattttggagttgtttcatctaatgtgagctcctgggaggccagaagtatatccctgccctctggcacattacagacatatgcccagtagatatttaataaatgaatattcacacctccacatgtaacaggtttttctgtactcatggaaggccttaactctgtatttttaaatattacttgatagctagaattaacacaagtaacaaaagttaatcttctaatgttgtcatttcaagttctgcattcaaggagattgcttaaaattttatccaaatataatagcaatatggctgaagtatctgtcaaagttggtgtccaggttgcggatatccacttgcaaactgttttgggagaaaataataaattgactatattaaaatttatatgacatttatagtaaaattactgtattcaacaatctttccagtcattttgtgtgtgattttaacct

SEQ ID NO: 39268 - DNA, 1169 bp, Homo sapiens
aaagcaaattaaacccaaagtaaacacaagaaaaaaaataataaacatccaagtggaaaacaaagaaacaatagaaaaacatcaatgaaatcaaaactaataaaattaatctcaagccatatgaagaaagaagttataaactattaatatcagtaataagagaagtctcattactatatattctatagatatgaaatggataaaaagtgaatattatgaacaagtttatgccaaaaatattcaaaaccttagatgaaatggacaaatttctttaaagacaaattaccaagcctcactgaaaaaaaaatagataaccgaaatagtcctgtgtctattaaagaaattgaaatagaggttaggaaccttggaccaagaaacttccaggcctagatggcttcagtgatgagctctatcaacatttcaggaagaaataacaccggttcacaaacttttccaaaaactgaattaggattgcttcccagcttattctatgaaggaagcattaacctgataacaaaattagaccaagttattataagaaaagaaaactacctataaaccaatatctctcataaatataaaagcaaaatttgttaaaaaaaaaaaatttttgcaaattgaattcagcaatatatcaaagggataatacattatgaccaagtgagacctaatcccaggaaagtaggattgacctaacgtttgaaaatcagtcaatgtgatccatcttattaaaaagcttaaaaaagagcagttgacaaaatctaacaaatattcctgatttttaaaaatctctacaaacaaggaacagaagaaaacttaaaggacatgtaagaaaaacccacatctcaaataatatttagtgatgaaatacttaattctttctccctgaaatcagcaattacagaagaatgttcactctcaccacttacattcagtgttgtagttaaggttctaaccagtgcactcaggcaaggaaaagaaaaggaaagcggctgtctttattcacaatgacatgatcatcagtataggaaatctaataaaatctaccataaaggatactagaattaatcagtgtgtttggcaaagatgtagattatgagataaatatacaaaaataattttatttctatatattagcaatgaacatttggaaattgatattttaaaaa

SEQ ID NO: 39269 - DNA, 1049 bp, Homo sapiens
ggtattaatgaaatagtaaaatacaattgaaaaattaacagagctgtcttagttcaggctgctatatcaaaataccataaactgggtggcttttaaacaacagaagcttatttcttacagctctggaggttggaagtttgagatcaaggtgccagcaggattgagttgtttgggggccctattcctggcttacagacagccttctggctgcattctcacctgggggaaagagagcaagctacctctctggcctctttttaagggctgtaatcccactgatgaggacaataccctttttacctcccaaaggcccccacttctgacattacattagggaaggattagatttcaacatatgacttgaggggagagggtgggggacataactgttgagtgtataacaaaagccaaagttgattctctaagagtctaataaaaatgataaacctcttttgaaacgaagcacgaaaaaagaaatgcacaagtagatgctattaggaatggaaaaaaaaggaataacactgaagttaaaaataagagaatgtaatctataactttatttttgacggaatttaattgttttaccaattataacaatgaaagtcgacaaaaagctaaaaattctaatagtactgtaactatcagacattgaagccatcattttaaacttttctacaagtaaacttctggtacaaattgggcttcactaatatttcttccaaatatttagggaaaaaataattcaactctcacacaaactcttccaaaagataggaaacaataggtacactcatcaactcattttgtgtggctaacacaaccttgataccaaaaaccaaaatagtattagaaaggaaaaatcaagacaaatatcatttatagatagaaaatctgaagtgaaatattaaggtagcaaataatatgtaataaagataatataccaagaccaagtttggtttgtaccaggaattcaaagttgatttatcattaaaaaaaaaaaaaaaaaaattcttatccgttcctgatagagactcctagaaactaaattg

SEQ ID NO: 39270 - DNA, 1068 bp, Homo sapiens
ctgcaataggacccatcctttttcaaatttgttcccatgcagtgggactgtcacgaatatgtttataaatgttatgccataatatatacatgaaagtatagactacttaaatgctagtttggaattttagagcagtttgcattaattcctcttacaaatttatattcactttcttatttaagctgtttttgaactagagtgaattagagagccaagacttatctttataaatttgtgcctgaaacacactaatcaatatatggtatgcttctcctaacaaaaactcatcttgacaaacagagcaatgaattcattctaggaagattatatagattcttacagattataaacatctattatataacattagtattggaaactttcactttttctgataaccaaaactcaatctgtgattattggttaattattaaacaagtccatttgcctagtatttaagtgcattaaaagtgggcatttatatagagctcatttcaaatgccaagcacgtctgtctgagtgtgaagaccagaattctgtccctaagtttaccagcaataccaatgaccttttccaagttaacctctatttgcctgagttttgttatttataaaaccgtgatctaaatactagccttccctacctcagccactgtagggaatgtaataacgtctgaaaatcattagaaaaacaattagcatacacaaagatttatgatcttaaaaatcttagtcgtttagaagctctgtgaatcagatatatttgaataaggaagaacaaatagcaagtcttatatcaggatcagcaaatcagtattattactgctataatcaggataaaaattgatacattatctttaataaaagaatgaagatcaaaatgtctttgaatttcataagcacctttcgtttcaactgaattttttctttgttgtgtgtttactccagggagccagctcaggatgcgtttattgccagctatcatcaggatacaagatcttactgaaattactctggttacctttcaaaacagaactgtaaccaaatcccagtacctggaaatttgttt

SEQ ID NO: 39271 - DNA, 1026 bp, Homo sapiens
gttaaggaagttaaagggaaagctttgttaagagtagataacaatacctaaggtagatgggaataaggggtttaatattatctactaccttgcacgtaccataggcaattcagatcacctgcttgaccatgttaattggttttttaaggaggatacaaagaaggcaggttgggaggacagagtgcttcaaattaaacacgtgttccagttacccactctgtgccactgatgtgtgctcaaagcaggaaaggagagaacacttttcccaggcagttgcctgtatgtaggagttccatgtatgtctggtgtggatagagagatctggtcatcagtataaaggcttggtcctggacacagcaggtcaaaggagatcaaagccagttagatgtttgttattagcatcccgggaagtaaggtgggcttagtctgagagaatgtgagtacctgggcacttgataagggcacagttcaagtcctggcaagaaaggaatgcagagagcaaagtgtgtcactagagcttacttattcttcaggaaaagtgctgtgtaatggggcggggagagcagggacaccgtgggctggaggtgagaagcgtaagcttgaagtgacacattttagttctgattcttaaaaagcaaaaggcagacctacatatcaaacatagaggctggaaaggatgttaaggggatgaaacgtcatcagaaatgtcagcacataggctttgaactctggtctcctgcctagatcagtgggtgctatggtagtgcatttgcataagtgcagtttacataagaaaatgccaagttgcactgcaatactatttactttccatgtaaataattacttcagtcaactttgctttaaaataaatcccatagcaataatgcttgataacaaagatatgctcctattcactttctatacatatttaattctcctcaaactgatggaagaataaaatagaaacagaagtgttttcattatctccctcattgatccttgagttggggaccaaaaaaaaaaaaa

SEQ ID NO: 39272 - DNA, 1056 bp, Homo sapiens
acagcacactgcagctgtgactacagatgagcagtagagggaggagccctggggaacagcaggatttcagaggcggccagaggaagaggaagctctaagggaggctgtaagtatgttttattttctagcagacttgtcaaagcaaaaggtaagctctagggtcaatagtgtggagagattgacaagggtaagcagagggtaggtggtaagcaaaaggaaggggtgttctggaagccactggaagcagtgatgtttcaaggaggagggacaggtcaggaagtcagataatggccaggtaggacaagaacagaatcacttcatgggaagtggtaaccatgccgtcgaggacctttgccacagcagatttggatgatgggaccagtgagagtgcagacagggatcacccacaactttgaaaccaagtttgatgagatgacagaactaaggttacagccggaggaggaagggagactttgttgtcaagggaagggttttgtggatttgtttgtgtttaggatgagagaatctggagtatatctgagtgtgaatggtaagtagccagagaaaaggagatgttgggggacaacccaggagaccagggtcctggaggaggtgcgagggaattgtgcccagagcgcataagtgaagggagcattcgcttctgcttctggcgggtgggtagcttctcctccaggtcaaggggagggaagaagaaggggtccggagactgggacctttagaggtgttacaccaaagagctctcatttctctttctgactgagtggaaccagtgagggaggagatggaaggattagaggtttaaggagaacattgtattaatatagaaatgttagatgttgtgatctagtgggatcctatacattccatcatgtaatgtttagacatggtcataaacattacatgatggaatgtataggattctaagtatgcacattaagaaggtacgctcaccattcacatattcgtgctgtaggttacaggttgtgctgacgttttgttgaatctcatcatgtctagcagtgcttatagggttgt

SEQ ID NO: 39273 - DNA, 1005 bp, Homo sapiens
ctcagacaaggctagtccctttcacctgtgagcctgtaaaatcaaaaactagttagttacttccaagaactaatttataaagaaaataggtgtttttaataaagaaaggttttttttataaagaggtaatttataaagaaaagaggtttaattggctcacagttctgcaggctatgcaagaagcatagcaccatctgcttctagagaggcctgagggagattttactcatggtggaaggcaaagcaggagcaggcatcttacatggcaggaacaggagcaagagagcgcgtacggggaggtgccatacacttttaaacaaccagatcttgtgagaactcactcactgtacaaggggggatgctgctacaccattcatgatgactccaaccccatgacccaatcatctcccaccgggctccacctccaacactggggattacaatttgacatgagattcactggggacacagatccaaaccgtatcactcaggaaccggataaaccagcaagggttaagcatggatttaactcctgactgtattagtttgctatgcctgccctaataaaataccacagactgagtggcttcaacaacagaattttattttctcacagttctgaaggcttgaagtccaagatcaagttgtggacttctgaggccacgtgccccagcttgcaaatggccaccttcttactgtgtcctcacgtggtcacccctctgtctgtatcttgcctgtgtcctaatctcctcttcttataaggacaccagtcatattgtattgggacccatcctgtgaccttattttactgtaatcacctctttaaaggccctgtctccaaatacagtcacattctgagggtcaggacttcaacatattaactttagggggatgcagttcaccccataagactgacctgaggagttaatccaggctgtaccacctgacttagaaagttatgttgtcagtggttaagttaatcccagtcacatgtggtaggaattg

SEQ ID NO: 39274 - DNA, 1039 bp, Homo sapiens
atgttatatatatatatatatatatatatgtatatatgtattttaacattttaatttatatatatgtaatatttttaaacctgaaaaaccagtgtttgggtttgtattctatgtcacacagaggaagctcctatcagcagaagagaggttctaaaatccttgttatcggagtttaaattttctgaaaaatatcccacccgttgagcttctatgttcttgctctgggatgtttccatgggtctgtattagttccaggaaatttgggtcctttctattttatctctggaattgaggttcctgcagaaactacaagggattatctgtgttctttgctgtttaatgtctttgctgcagtgagacagattcctgaaggagtaaacaatgaaatgttttaaggctaactgtgggagattatgtggagaggaaatacagctattctgagagaagacatataaaatgttggcctgttgcttcttgaagtaatactgtaaagacctcttgcctgttgtacattaaccaatgcaagcatgttatagttgaagttgggattctggggttcacctttttctcagttaatgaatttttattttaatgtaattgaattttctttaagaatccaatttccacttcagaagataccattcccctgggaaagtggctcccaatccaaagaacatagacccttgaggaattaatacaagactcttggaacctatttgggcatcaaccattgtcagtgaacatctgcataaatagtgttttatataaacacatttgaaggtgttcttacatttttggtcacttttaaagcagtactttttctcaatcaaagggtagcaggaaaataagaaaagcctaacagtaaggtgactctgtgtgtgtgtttgtgcacatgcatacatatgcctgtgtggggcggggttgcggaggcgcagtctgtgtttttaaaaacaattaaagaggtctttatgctttaacaagctgagaactactatggtagttatgttctgtagggcatgcttcacaaagctaaatgaaa

SEQ ID NO: 39275 - DNA, 1041 bp, Homo sapiens
aaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtagaactacggctgaaaaagaaagtagattgaggtggggggaggaaattaacaggaatctagagtttttctaattcttatcgtcttatcgttcttgtgtttggatgctggtagtttttttttttttagacagagtctcgctctgtcacccaggctggagtgtagtggcacaatcttggctcacagtgactttcgcctcccaggttcaaggaattctcctgcctcggcctcttggtagctgggattacaggcacgcatcaccacacccagctaatttttttgtatttttagtagagatggggttttaccatgttggccaggctgttcttgaactcctggcctcaaatgatccactcgccgtggcctccagtagcgctgggattacaggcgtgagccatcacacccggcctggatgctggtagttttattttctgcttagaaaacgcaaccatgttgatgggaccaaaaact

SEQ ID NO: 39276 - DNA, 1031 bp, Homo sapiens
ttatgatttatcagttgaacatacataacaatgaaagcaaagctaagtaaatgtaaggtaattctataggacttttgtaggcagtttcttctgaatcttttcaattcatgtccatctatggccctgttgtcctcacaggttctctggcccagggaggcattgctaaagtagcacttcagagagcccctctgtcatatctggatttcatccaaacctttctatgcatttatatgctggaactttcttgatctccccagaagctgtctgcagaaagttttcagacagtaactcattcttttctcaaatggccattaaatggtttcttggctcaaatgtgggttgcagctctgcatttgtgccaccacgaatggcagccatatttgtgtgtttgcacattgtggcaactgtatcaatagctgccagtcaaaattgactataattctccatctcctgttttcaactctggtttcatacgtgttaaatttgaaaatatgtgcattcaaatcaatgaaattacaaggaaattcggaccatccatttcattttaccaactgtcccttgactttgataatgatatattagtcattttgcgtgtaactgcctgagactcagaataagaatatcttttgatatattttgtagttgactctctgctaatattattctccagtgggtctctgacatgatttaccctgtggatacacaatacataccggttgtgtttggcttactgccattattctgtatttcatggagctccctggctcatggaaagtctttaaatcattatttagacatattttatagaatttagcaccttccctcatggaacaatatcaattttttattttattattttaatttttaataataatgcctgattatagcgttaccccttgcattaccaatacacacacccactactggaagcagagcaggagtttgttctcactgctggttcagggcaagaaatactatgttttcattagaattctaagtggcagctcaaaatttactatttggcctttaaa

SEQ ID NO: 39277 - DNA, 1069 bp, Homo sapiens
gagtttaagtaccttagaaaattaacttctgttatctgtgatgtccttagatttataaaacaaagacttgctatattagctgtaacatgcataaagcacactgcacatatttggtgactgaaatggaatctaattttattacactggtttttaattgcttttatcctccattccccaaggagtattaaattgccctttgaaatagccttacagattctaagaggaaaatacactttttagaattttaaaactggaataaaaataactttctattacacaatttgattctacctgttttgtcttatgtgattgataatcctcattttttaaaattaagaaaaccagtaggcagcttcataccaatgcccaggatttcctactgcctgcaaatcttctccttcatgcctaaattgaaggaatttgtacttcacagtgatgaaagtcttttttcagtggatctttgggtgaggcaagctaacatcgtctatacttttgtgaatcaataaccgtcttgctgaatgcataacttctagtagttcttatctttataaaacttccatgtccacattagaaatattccttttagaaaacgtttgtcattgcccctaccaatacaaagaagagtaatatttatacacatgtttaaaagagaagttaattcaataatttgataggtgtaattaattaaggcatagttttggagaaacattacaataattgcctcaaatttttgagcctgtctgtcctcctttcttctttccctcattcctttctttctttctttttttctctctttcctttttggaacctacaactaaatgaattgaatatatctcttttagcctacaaatcctattcatctgcttttatttttctatgctttaatatccttccaagtacatttgaagaataagtaaatatattttctaaaaatcttggcacatttcctggttttgaaggcatgaggagagagttggcaaaaaagtgatttttgaatgaaaataaatctatccttacacttaaaatccccagaggcatcattgatataaaccaaaatagccattttcat

SEQ ID NO: 39278 - DNA, 1060 bp, Homo sapiens
gtatagatgggttattggccgatgactgtctttgcttcagtgccttcgatactgtaaactttcttataaaatattctcaagcattaaacttagtatgatttttaaacattgatttaaaagtaattttcagttgcatatttattagacctattagtctgtggttatggccataattgctactctggccaaattttggtttgtgtgtatatatgaattataatggagactaatgttcattctctacaaatatatttttcagagaaaatgggattatcatttgctgtaagattgtcatgttaataattcaatttgaataatgagttattagcactccagtagttctctttccccaattattaatgagctgttaccaaaaactctataaaactatgagaatgataaacatcacttagatttactctagccacacttcataaacaatatttcttttacagttatttttttaaaatttacttaacaaacctgcccattcactaacatttgtacacatctgcttcattggttagatgggtgttgtggaagaagggtctatgtctggtttgattctatttggaaaaatgccatgtggaccagttgcaccagctgatggtgatgtttctttacatttattcagaaccttcccatttcagaggaaatgggttacttttgggggccatgtgctttaagtttcagataaatgtcatttgaggacttttctcttgtgccttaagtccttatggttctgggttatggtgggaatgtggggagcggacacccagctgaggaatcacctggattcattatagcatgggatgccatggtctagttagccagcgaatattttagaaggatatttatcatacagacggatcttcagaaaaatcaccattttctcaactgtaaggttgatgatttttaggattaattagtagggttattaatccaaacaattaaattctctcctaagagtacagctgtctgattaattaatctattaattaatcagtggcttctccagatgtctgttgagatactgtcccttgagcactgctgagatgtg

SEQ ID NO: 39279 - DNA, 1032 bp, Homo sapiens
aattgtacacgtcagtttaatattgttttagagagtaggaactttggtatgtcctgagcgcacactttgatcagaccttcccaacggaacacacgtccatgtacacgtcgtttgaagataaacataccgtagattataatgctcagtcctggtcatgaattgaaacacttgttagaaagacaaaaaataagaaacaaaattaaattattaagtgaaagcattatttttgtctcatgttactgttcttcatgtctcatatggtactaaaggatgaatcatggtatgttgccggtcgacccatagatttaaaacagcttacttcaccgtgaatgcaattatgcattttggggttttcatgaagaagcagctgccagaaggaatgggtgctagggagtgttcatatttcgtgaaagctatcttggtgcattgcctccttcacttgaattagcactcgattgtcctaaaagaaggggctgaagactcagcagagttggaagagacctccgatctcgttagtataacagcagctgcctgaatttgctcacatcaaattgcagcaacttgtttcattctggttttgctgtcttactttgtaagagacacaaatgcatttcacattttaaaaatatcctcacacagattgagaactacataacaacttgagaactggtcaaacctctcacttcttagatatctttcattcccatttgggttggacaggctaaagaatgaaagtgtgtcatttttgacataacattttcaattctaaaccaaacaactggactggaaggggtaacagtgctgagttaatgccattaattctgcattaaaaattatactaatgtatttttttccaaattacctatagggatagtatatagggataggtcatatttcagaagtgttcctttgcgatgtttgaagtgatccttgtggaaacaaacattgtcacaaaaattctcacccaataggccaggcgtggtggctcaggcctgtaatcccagcactttgggaggccaaggtgggtggatc

SEQ ID NO: 39280 - DNA, 1051 bp, Homo sapiens
ctgataggccgggcatggtggctcacacctgtaatcccaacatttgggaggcagaggcgggcagatcacctgagctcaggagttcgagaccagcctaatcaacatggtgaaaccctgtctctactcaaaatacaaaaaatgagctgggtgtggcggtgggcacctgtagtcccagctaccagggaggctgaggcaggagaatcagttgaacctgggaggcggaggttgcagtgagctgagattgtgccgttgcactccagcctgggcgacagagctagactctgtctccaaaaaaaaaaagataagctgataaaaaccagcaaatgattgatacatgcaacaacgtggaagaatctcagaactacagtgttgagtaaaagaagccagacacaaaagagaaactcatatgatcccatgtctatgaagatgaaactcagtctaaactaatctgtggtgtaggaagctggaaagtggttaccggagatttggggtggggaagggttggggatagtattgcctgggaagggacccaagagaactttctggaatgttgtcagtttgctatgaatagtgagtacatgagtacatacatactttaaaattcatcaagctgcatacttacttcactcaaggtttttgcattttaccatagagttggccctctgtattcgaagtttctgtgtccgtggattcaaccaaccatagactgaaaatatttgggaaaaaaatgtatctatactgaacatctacaacatctttcttgtcattattatgttataaacacatttatatctatgtttagattattaaaaaaatccaaacaatatcatatgacaactatttacataccatttgcattgtattaggtattataagtaatctagagatgatttgaagtatataggaggatgtatggaggttatatgcaaatatataccactttatataagggacttgagcatcttggaaccaatcccccacagatatcgaaggatgactgtatataaattatactgcaattttttaaaaagctaagcagaataaaagtata

SEQ ID NO: 39281 - DNA, 1035 bp, Homo sapiens
cacagactgatttcaaatacttttcagttcagaccacacaatagacttaaggaatttttttttttaaagacatcgtattgggtgaagaggggtgtcttacaatcactcatccagggcaataacgatctagccaagtgagaacaatgaagagggagaagtgacaagtctgcaggagtggcagcaggccccagcaggctgaggtctgggtgctggaagcccgtggagctcacatgggttcacacggcacagaatagcccaagtgttagatggccgccattctctaggaccagccagatcactccaggtagcagggttccctctgccaagccctccccatatgaacaaagaagagatcccaggccacaactgagggagtcctggttgggtgagcagagtgcctcatcatattcagctcagtgtgacataccaggctctccataaacctcacacttaatggaataagctcatttcagctccagatccctagtgaacttgtggacaagtatgactttatctctctgaacctcagctttcttaaataaaagtggagctgataatacctattcatcaccctcagggttaaggatggaatgaaataccttctataaacagacttctctaatgtgcttatttgatgggagggatgaagggctataaggctattgccattttgtgactccccagatgtgccaaggtatttacatctcagcagggctaggcagacctgcagtctaagtggtaagacataggcgagggattatacaccttttcattttgagaaaggaaaaagaaaccgttcacctcaggaacacattttagcttttctaaattgaccctcatacagtaaaatggtattcaccatgatggggacatgaggacttacaggttcattctcactcttgtgcacagcagctgtttcaggaaaacgaatggtaggctgtcatcagagtgcttttctgagtatgatttaagcatcttccttttcaaaagcaagttcggttttttttttttttcattttaaaccaatttaatacc

SEQ ID NO: 39282 - DNA, 1068 bp, Homo sapiens
ataattgagaagcacatgccactgaggtgtgcctaattctgcgaaaataactgttacttccccagatccaagaaatttagcaaactcatcacactgtaataacaattttattcattattaatcctggtgaggaatacttcagctgctttacatctatttcataccctccactttgacccctctctttgatactgcaaatcctcacgttgaagggcatgtgaaattattggtgaatcagaaaggtgatgtttcattccgtatattaatgcttcttttgtaaattaagaatttatttttgtttgtagttaactcaaatatgcttttttttatgggcttcagtgttccattaatttttaaaggaattaaatatttgcttagatgtgccttccacagttctttcaatcatgtgggtagattttttccccttaattgtctatgttaaaaaggggaaaaaaacaactaaaacacacagtaaagaaggtaattttttccagctgtgtagtagttctattccttcatttgactttgatgtagtcaaaaagtggccgcctggtctgacttaaactttacttcttttaccccgtggcaacatttagagggaagagaaatacaatctctaactggaaaatctcccaaattcattagacttaccacttatttaccaatcagaagttattttaagttgcggttttctgctccagtaaagtgtatagtctgaagtattttgttactcagaatttggtgtattttatggaagactttactaaaaggaaagagacagaaaagagggaaagagaaagagggaaggaaagaaggaaggaaggaaggaaggaaggaaggaaggaaggaaggaaggaaggaaagagagagagagagaaagaaagaaagaatgtcctaaggtaaagaagagtctttactaaaaaggatggaaggaagggaggcaggaaagaaagaaatgataagttcctaatacatgagcaagggtttgtctgggatctcaacttgcctggggttaactagtgttgtaggtccaaagtaactggatttaaatgtcatacataatgacaa

SEQ ID NO: 39283 - DNA, 1058 bp, Homo sapiens
gaacagtctcttaaattttaaggcaagggttttctctaaaagttctcattaatatctttgaagtgtaggagcatcatatgatctctgaagaaattgccagcccccaaattattagtcactctcaaatgaatacccatcgtttaggaaactgactttttggaaggagcaatgcttaacattaaccatagcattctattagttaggaggaccttgatcattaaaaccactctttgtgtttgtttgtttatttatttatttatttgagatggagtctctcactgttgcctgggctggagtgcagtggtgctgtctctgttcactgcaacctctgcctcccgggtttaagcgattctcctgcctcagcctcctgagtagctgagattacaggcgcctgccaccatgcccggctaattttttgtatttttcgtagaaacggggtttcactatgttggccaggctggtctcgaactcttgacctcatgatttgcccacctcggcctcccaaattgctgggattacaggcgtgagccaccacgcccggcgcgactaaaaccgttcttttaaataagatgcttgccacttaatttaagttcacggttgcccattctgtagcccttgaagttcttccttgactcatttcgtcctctccttatgtttcacatcttcacaaaaataggaagaacagcagcaaagccccgatgacccacatgctatttgatggggaagagactaggactagcagggcttcccatgcttactggtgagcatgtttctttggtgtaatgatctgaattaagcagaagatgaaaggagtatagtattttttggccttatacttctcaatgacacagctgaagtccatcccattttttatttatcagactttgggaacagacaacaaatgagattataagtatctcctttcagagatggatgctccaagcagaactctgcgactctgtagtgctcttggcaattaacagcttcattctaaatttgtaaactcactctggtttgttttaaaaatggaaatgaatgaggaagccaaatcttagaaa

SEQ ID NO: 39284 - DNA, 1056 bp, Homo sapiens
agtgagagtaagaaatgacagaagctggggccagatggtgaggggccagataaaaataaaattagcatataaatggactggctttgctcaatcaaaggaggattttctttcttaaagaaagacagtggctcttttcctgatttttatgacttgagctcataaatcaaatcttcagagctaccgacaatgtcagcctgctgatgtttaggagtggagggtgactgaggaatgcggtgtgctgcggatagtcatgtcatcagcaaggatgtctcagagtctgcaaacccggacctctctgtattggacaaggctagggaatgactttgagaagaactgaatattaaaggaattatcaacttgagtagtaagagagtttctaagaatgatggcagagccactctgaagttcctgaatgaggtggaggagggggagaaagtggtgtggtaaggaacttcagtggagaaacagcccagagaactgggaaagcaatgacttggaagcagcaatgagttggtgttggaaaaggagtggctgccattgggaaggtttagagggtaaactttgagcttgaggaaaattaagttacatttaatgtgagaaaatggaggaaaaatgtgatctgtatctaacagagagaatgggattgagttgagtatctaacacagataatgggattaaaaaaccccaagaggatgaagcctcagagtagcataaaggggctgggcagcagaagagctctgggccaagctcaccactatggaggaagcaggaagggtgcccagggatggcgggcgggggcttgggagcaaggccatgggacatcggcactgtaaagggatggggaggttagagggtgtatggtggttgcatcgtagttagtagggagccttgtgaattgtcaccttagaggcccaaccaaaaagtgagcaagccagccccttccatgctcaggcacttttgaataattgaaacactcctggcaatatcccaagtgtcatcttatattaccctgaaaatagctgctccatttagggttgcatttaacagagcttatgt

SEQ ID NO: 39285 - DNA, 1091 bp, Homo sapiens
cctggatgctggaaatcatgtgcctgatttctgacaactcccagtggaatcttgtttagcggaccttcccccaccagcaccccaattctttgaccataggctccttgacttggtatccttcagcacctagactgacgcctggctcaaagcagaggctcagtaaatcttccctgcatttgcatatgaatgaattgaatactggacacatatgggaaaatgaattactgctttaagaagacactgccttcttgcagaaatgatgctttctatctaaaaagaaccctgaggtttcccttgccccacctacttgtactgtagtattagagaggttttacaagttgtttaagaattcttgaatataatttaacattgaataaaatgagttttttcccctcccactaattataatcatacaagcagtgaactaaacagctgggggtgagagaaattctgatgatgttaaaaatgcaaatagttttcacaccagattaattcatttaactaagagtcctgatctttaaatattaaatgtttgagtgtgaaacgttttattcacagaggagatagtccacatgaatgaatctgaagcccattcctctatcaagggtgattttaaaataaacaggatgcatattgttagctagttattaaccagcgagttgtaaattcttcaaaacagttcagggtgtaatttacatgactcaagatgagcaagactcagggtactatgaagctgctgtttgaggttaggagaagcgagtcatgcaaggacctgaacgaatgtttgtgttatctgtgtttgactaatatttgaattaaatgttttatatttaatcaaagcaagattgaaattcattattactgctgatacgcagtactaattacaggaaataaccagcccttccaagttcagtgccaaatgctgatagtgtggtaatctatgctctgggaggaaatcgaaggcctcagatctgaaagagaatttagtccagttttttatgttttaaacccatgcttcctttcgattaaaaaagatcccttgcctttattttcttcaacctctctttagtttgtattattaaactcgtaag

SEQ ID NO: 39286 - DNA, 1068 bp, Homo sapiens
aactctgctatccttggtcttttagagaactcacaagctttcctgacatacaactttgacatttaaaaattgttctgctatgtttgaagaaaacaaaggatgcaaaggttctctaacagttgcatgagttcactgagacaacactcaaactacagctctgggaccctgaatgtatatacccttgatttatataccctgggttccacttggtttgccgagtcgagtgctgtaaaacatctacatcttgttctaagaagaatgaggacataacctgggttgttctggatacctcctcattatcttaggatgttgcattcttggtaaattctgcctgagaattgcaagcaagcggcagcagagctgggtcagccaacatcatctggaaagggaatgaccctgtatcatgaaatctcatgcataagctgtaggagcaggaaaaagttaaatggtagaagagatcatagtgtctatccaagagtgtttgggggaaactagggcccaagggtgatataatatttggtggcttgtacacagagtatggggtagaagctgaacagaactgtcacccaaattcagtgctatttctttatctttccaagcaaaagtagtatgtatgacaaagaaaagggtgagacaagggtaagctgtagtcagttttcccctcttctctcctcccttactcttcccttgcctcccctttcatctccttcctcttctgttctttcctctcctcttgtcccttcctcatccctcccttcctataaattatgaagaaatatgtattgagatgtgtttttagaacttcttctcaaaacaggtctgtatttttacttctgtgcatttgtggaattaactgactccacttaacagtaaaataaaacagccctaaaagaacataaagtttatattaaatggttatgaaaataatgggcaccttcgcccactgagattgtgttgagtgaagttcagtgacgatactaaataggccccctcccacctcactaggagccaattgacagatatggaagtcagacagaggtaggtattttggtctgcttttttattact

SEQ ID NO: 39287 - DNA, 1029 bp, Homo sapiens
tgacttccactgcacttagctaaaatccaaatttttcatctgaaggttttgcatgatccaccttgctaaatgtctctgtctcactcacctctatgtcctcatagcctatacagtacctaggctaaagtagatgctcaacaactgttggtgaattaaagaatgaatgagtgaatgaatatccctttcagagcttgaaatgtatgtgttgtttaatttctttccaaaatggacaactggtcttttctactggtgttcatgagactccagggggcatattcatttcccagattgtatcctctcctagttggacagttctgatttttcatggatccgtaaaatccagctaagctcttctctgacactaaggtgaagtggctattaggcagtgcagtgaggaatggacggactctgcccaagtctcaggttatctgcctttctaactggctcaatggttttccagatatttttgctcaggaatcactctgtcagaacaagggaaggaccccgcgtgtccattctccttcaccttccatctgtgctggtttgtacatgaaaaataaaattatctacaatgaattttaaaactgtcttccgcaagaccagcttggccaacatggcgaaaccctgtttctactaaaaaatacaaaaactacaggtggtgggcacctgtagtcccagctacttgggaggctgaggcaggaagaattacttgaacctgggaggtggaggttgcagtgatgcagtgagccgagattgcaccactgcactccagcctgggtgacagagcaaaactctgtctcaaaaacacaaaacaaaacaaaacaaaacaaaacaaaaaaactgccttctgatatgccaccaacaagatattcacattgtttcctttttgtagaatgttggaagatatgaaattaaaactgggattttctaagtagtatctggagtaaaagcaataaatgttcttgcttcaagatttccatttgtggtatcattcacaagagaaatttcccctttttgaaaagtattggc

SEQ ID NO: 39288 - DNA, 1051 bp, Homo sapiens
gagccgtgaggctgctcacggggctttgcatattgtcctgctggtgtttctggctcatgatggagatgggggaagggaacagcctatttgcagtgttgaaaaaaaatcaattttcatcttcaaaagatgaaactaccaagcaagatattgaattagaaataaagtgtttcttaaagacttctcatatcctataaatgtcatacccaaacctaagagtttggtgatttaaagtttactgctaatttcagacaaacatgcaggtagctctgcctcaaaaaaacaaaaaaaaactagctaatgtatgagtttattgcagattttgttgcatctacaactagtgtcagaaccttcaaaaccagtcatattttttgttgataggcataaacttgatccctatttattttccatcccgaggttttattcttctttgtctcatacgtaaatgatttccaagtttttatgacaaatttcatataactaggtttgatatactttcaaatgcagcttttgcaatatataatatccgtatcatctgaactttaataaggagtacgtttttaatcagttgggggagatctttagttcttgtctggccttgaaggcccaatgcagactagctgattgatggttgttatcccaacacacaaagtagacatggaccaagcaggcagcggaggaggagtgaattcatccacaaatcttgtggggggtggactagcctcagcagggcctggactgacctggctttttttttttttttttttgagaccgagtctagctctgtcacccaggttatagtacagtggctcaatctcagctcgctgcaacctctgcttcctgggttcaagcaattcttctgcctcagcctcccaagtagctgggattacaggtgcccaccaccatgcccagctaatttttgtatttttagtagaaacaggatttcaccgtgttggccaggctggtctcgaactcctgacctcaggtgatccacccgccttggcctcccaaagttctgggattacaggcatgagccactgtacccagccttacc

SEQ ID NO: 39289 - DNA, 1096 bp, Homo sapiens
tcatgccattgtactccagcctgggtgactctgtctcaaaaaaaaaaaaaaaaaagaaaagaaaaaaagaaaaggaaatgggtagggctacagcagagtgaaagagagggagagaaagatgatgatttcgggaaagagccttgggggcatgcctttggctttcactcttgttgaaattggaagacatcagaagattttgagcaaagatatgaaattccctgacttacattaatgggatcactttgactgatgtgttgagggactaaacacagactaaagagggacaaggataaaagtggggagaacagtatgggggtgcctacaataacctcaacaacaaacagaagaggcttggtccagtaagataagctgtaagtacttggattctggatatttttgaaggttgagccaaataagagaaatcaagataccccaaggtttttgtcctaaaactgcaaggacaaaggatgccatttccagaggagcaggtttggggaagattatcaggagttcagtttggggtagcttgcatttgggatgtctaactttggacttcagaagaacaatctaggagatgtgggcatgttgatgatatttaaagccatgagatgagattacctaggataagcatatatagacaatagacaaggtccgagaactgagccctaagacattccaatgttagatgggagagaaccaaaaagaggggacagagaaaggagaaagcagagacaaccaggagttttaaggaaggggagtgactacagtgttctgtgttttggcacataaatgagaactctgagttgaccattggtgctggcagtgtgtggaccactggtgactgataagagcagttttaatggaggtggtgttggaagcctggtcagagtagactcaagagaatatgagaggagcaaaaattgtctgtttagaggaatagtaaccatgacaataataggtaaatattgagcctgtactaagtagcaggcgtggctcttctaagcacttaagtaactcagtcttcaccaccaccttatgagggagatgttattattattcccattttatagatgaagaaactgagacacaagaaagg

SEQ ID NO: 39290 - DNA, 1031 bp, Homo sapiens
ttaaaacacttggcctgtccctgcagctggaaaagcgccattccctcggacagtgttaactatgagttgagtcaatttccagttcctcaaaattggaactaatcctgtcctgttttctctgtccaaaatggacaggatccgaaataaggaaaaattaggcctttccattttatcttaactcatattcacaactaaaacttttgttatttttccctataagataagtttttccttatgacataaaatgtttatgttgggataattggagaactctattaagcatcatgatagcttatttatgtaagagtggatttggtcataattccatcccttaagtggttttagtttttatgtgttgcatttctttgtaaaatcattatgaaggttctggaagaaatgattagtgaggaaggatcatattttaaggtctgtgtttcattcagattcctgtaaagtctgttgttttttctttagattgaaaactgactttacattgactcagggatctaagacaaagcagatagtgtgtttttgcctctttctgtgaagatgtctgctttatgtatccttgcattcactattaagatttagagacccagaccgggcgtggtggctcacgcctgtaatcccagcattctgggagaccgaggcgggcggatcacgaggtcagaagattgagaccatcctgactaacactgtgaaaccccgtctctactaaaaatacaaaaaataatccgggcgtgttgggtgtctgtagtcccagctactcgggaggctgaggcaggagaatggcgtgaacccgggaggtggagcttgcagtcagccgagatcgtgccactgcactccagcctgggcggcagagcgagactccatctaaaaaaaaaaaaaaaaaaaaaaaaaaaaaaagatttagaacacaaatcaaatatctggataattaaatccgtatttaaaaggcacacatagatactcagtaaatgttttttaaatggatgagaactgcaagtgaactaatggtattttaaggtaag

SEQ ID NO: 39291 - DNA, 1032 bp, Homo sapiens
ttattttcatcactgtacaaattgttgtcattcagacttttgataaattatttccttttctctttcttattccttatctgctgaatgcatatcacacccctcatgagccagaaactggtttattatatgatataaaatatatcaaggttattggcacatatgggagctttcctgtaggagacatagaattatgtgttttatagaacttctagaaaacacagcctctacctgcttagaatttacatttgaacatattgagagataggtattgtcttaagcaaaaccatcgcttgactctaagtgtcaacatgcataaatagcatatgaaatctgctttaaatcacagatgaggtcattgaaaatgtgcatctttttagatgaatgcaaatacaggacagaatttcctgaaaataatgtatttcacttagttggctccatattcccaatctgggttattatgttatcaatttatcctagtaactctctttttcaattaattatttaatgtgtgtttttgtgtctatatgtattcatctatttttgttccagtgccacatgtctcctgacttttcttcctcagagtaaaaatgcaaggatccgttgcttctctctcttcctctcctgtgacctcccttgcacacattgctttagaccaggcttctcacagtttgatgaggctcaggataatgggagaaggaaggcagctgttcaaacacagatgactgggcccggcacagtggctaacgcctgtaatcccagcactttgggaggccaaggcggtggatcactagaggccaggagtttgagactaccctggccaacctggtgaaaccccatctactaaacatacaaaatttagccaggtgtggtggcacatgcatgtagtcccagctacttgggaggctgaggcaagagaatagcttgaacccgggaggcaaatgttgcagtgagctgagatcgggccactgcactccagcctggtgacattgcaagactccatctcaaaatgaacaaacaaacaaacaaaacact

SEQ ID NO: 39292 - DNA, 1041 bp, Homo sapiens
tggaaagaatcaaaaaccatttgtaggcatgtctgatgagtgagatctacaatcagaaagctgaacgtcaagtttgaaaaaaacaaaaaccatgtttgcagtcaaagagttgctgtaataaagaagaccaccattagtcttagtcagcatatttgtgtcatataagattccttgagtatttgacatatactaaaactgatttgggctattaatacaatacgcagcatacacagaaatcaagatttgctacttcaacaaaaccagatagcaaaaaaagaaatcttggtgttcaaatcaaattataatttgatttggatcctggggatgttggagttttctagtaaatacattaagcattttgcatctagattatgttacaggaaattttaaaaacgtttaaaaagtggtttttaaggtactttttttggaagactaaagaaaatgacccatctgaatgttttcttttgttacctaaaatgcacagcataatttttgtagaaatttttcttgcaacatagttactttcagaacaaatcaaattagttttaattttaccatttaggagtcatttgattttgagcttagattccttatctgtaaatagagaaggcgagactgaattgacattaatgtccttatcaaccctgcgctcgcgcagttatttgttccttcctttagtgtaagtctgtagccaccatttgtgtcttaattaaatgatctaaatctttaatgttttcaccatttttatgaatgaatctcagagactgatctgatagtcgtgtcgtgtagcaacataaacatcttccacaacctttaaaaagtttgttggcattaaaattgtggctttcaacatcctttcattcccagaggcttattttagcatgtcaagtggatgtgttgaagatttatcacatagaactccacattaattttttactttaagtgatcacccatttttgttccgacataaagcaatattcactgcagctgttagcatatgacagttgactggctgaacttggaaatactgctgctgctcgt

SEQ ID NO: 39293 - DNA, 1047 bp, Homo sapiens
aaaggttatatttcaaaacttatatgctaactttagaactttatttctctccatagaataatttttacaaatgtgctggattctaaaagattatttatatcagatcaataatgggttaaaaagtaagcttttgtagaatgcctggtaataaaacaactttttttattttttatttttttgagacggagtctcactctgtagcccaggctggagtgcagtggcaagttctcggctcactgcaatctctgcctccaggttcaagtgattctcctgtctcagcctcccgtgtagctgggattacaggcactcaccaccatgcctagttaatttttgtattttttgtagagatggggtttcaccatattggtcaggctggtcttgaactcctgacctcagttgatccaccagcctcagccttccaaagtcctggaattacatatgtgagccaccacgcctggcctttttttacatttttaataggaaattccttttacagtatgaattttggatgccagaagtatatttgtccatcttaactgtagctacaatacaatattcagcttttatcccactaagaactcatgggttctatgataatgtacttttagtcccatttttgattatgtcaaatgaataacagtggcaaaagcaattattttatttattttttggagacacggtctcactctgtcacccaagctggagtacagtggcgcaacctcagctccctgcaacctctgtcttcaagtgattctcatgcctcagcctcctgagcagctgggattaaaggtgtgtgccaccacatccagctaatttttgtatttttagtagagacggggtgtcaccatgttggccaggctggtctcgaacccctgacctcaggtgatccacctgcctcagcctcccaaagtgctgggattacaggcatgagccaccgtgcctggcccaaaaccaattactgtactcttttatgttgtcatgtcttctttaatatgatttccttaattaattgctgctagtaaaaagtaaatttaaaaaacttacaaa

SEQ ID NO: 39294 - DNA, 1029 bp, Homo sapiens
catttgaaagtcatcatatacttgtagaaagggaagaatgtcctttctaaaattctacaactatttataagtagcagctcttttttgggaggacatcttgctaactttttttcatgaccttttatcaggtaaatgccttgaggataaatcagggcttctgaataatgcttgctcacctacaacaagatgaaaaatggtaggttccaagcttcaacctattatttgtggcaactccataagaaacacatgtctctgaacatgtcagcagtagcactcaaagatgctctgtgttacctaattgctcttgtacctttttctgactttgggataagcagtgggtatgcctgtgatggcacatccctactgactgctaaagcgtgaaatggttgcagttgtggttcctgctctctatcctttccctcacacgcatcccctttccggaagcggtagcactccaccctggttataaaaaggaatgaaggccctggtaatcataactcataaagcatgtcacattcttcctctgtctcttcttttctcctattttaattaaaattgaattcatgcctctcaaatgagtggattcacaggatgacagtatctttcaattctaagggccataatgggaagtcagtattatgcattgtcttatctccagtataacatggtggctgttttgacaggcttcagtcaaaatgtgaaggtcctcatcaccaaacattctagaaattggtcccacacccctcaactccactctctccctgggtcactggtgtctttctcttcatcctgtgttcatcaaaaaggaaagataagggatggagtgtctactgcaaacattgttggagtttttaaatacaacattttatttctaacttaaatgactccaagataaaatcaaatttgcctaatcccaaaccctccattgccgtgacagctacattaaaatattatatgcttgcccctagcacctactaagtgctcaataaacatttactgaaagaaaataaattggatttagacacttga

SEQ ID NO: 39295 - DNA, 1050 bp, Homo sapiens
attcatctggaaagtcaaaacttcattttgtgaggcgaatataagctcatatactcccttgtggtaaagttagatgaatattctcattgcttcagaatatattgtgcatacctagttaagagaccttgaagcaaacttgtcatttctgaatttcatcagtcaaagtatgtatttgccttggctttatacttacttaaaggacaggggctgatgtggaaaattttctcaggtgcagagaacagcagactattaacatatggttgacatggtttcatttgattgtcctaaattacaggagttgggctcattttgatgctatccatattgctgccaggttttctaatttattttaaaatcattcactctttcttaagcttttccaaagcaagaggtgtgggtgagggagtatttccttgagcatcagctgtactggaatattctagtatgtttgacttgatagtttaactacaaggcatgaccagccacactctgcagtcacattgacttcttagaattttgagatttgcaaggatatttgtctttcaccttggttaaatactttgcatacagaattaagtaatttcattaaagtgcattggaggagaaaaataatttatgacaggaagtctataagtataaggagtttagccagaagttgtgatgtaatgttaaacaaataaccttcaaaaattatcctgaaaaatctatttgtatgtccataaaaaggacctacaatttgtggggtgggctccaatcataaagagttttgttacagaaatctctcaatgaaatggctaattttttctttccaattgcccatggaaatggaattaagcctcgttaacttgaaatagaatggctgtcctccatgatggagcaggacagtgcctctagatagcacagatgcaaagtcctcaaagtgtatttctctcacctgcggtagtcacggagagttttaaaaaattactttataaatcttactttttgataatttctgaaattgaaataatttgagctgaagcctttattgcattgagtttccatgtaagt

SEQ ID NO: 39296 - DNA, 1041 bp, Homo sapiens
aaaaatttttccccagaattatatttttgagattttgatctttccagatttcaatatttgggattaagattatgtctttccacattatgatcggttgctctcaaatgcatattactagctgaggaagccagtccgagaaggctgcatattttatgccaattatatgacttacgagaaaaggcagaactatagacagtaaacagagtggtggttatcaaggacttaaggaggagatagaattgcataggtgaagcacagggaattactagagcagtgaaactattgtgtaaatactgtatatgacatgcatttgtgaaagcccatagaaccttatagtacaaagagtgcctcttactatagcaaattaaaaattcttaaggagattgggggaatctcagggtggaatgcagaatgagaaaggaatttattataaatttatgaaacaacgttactgaagggggtggggagacaagttgcaaacataaataactttggaaatgagtagagactgtatcgctaaatgcaaaagtaactgtacataagcataatattctggttgataaaaggttgccaattctgaaacaagtataataatgtactaaaattgaacagttaagcaaatgaatagtgagtggtggaagtcagatgttttctttgctggagtaagaggttacaaataagtaaagggagaaagctagaatgctccgtttggtaacagattagaaatgcagacattgtttgtgaactaatgtttagctaatatagacgcatatggatgtatatatagaaatatttatgcatatgtgtgcatatacagattcatatactatttccttgctttgtcagctgagagaatctagaagcaacaacacctcactagtaacaagcacacctagtgcccagatcttagtttctaatttcatcctctaataaaaggaatcaaggatccctgaagaaatggatgattctgtgactggggcaggaaatatacaagatgagcctgtagcattttgtaggactagaaagtaaggaagtactcaa

SEQ ID NO: 39297 - DNA, 1104 bp, Homo sapiens
attggagaacacaggctgggctgatggtgctgatggccacgagagtgccagagaagagggggagggggttatattgatgatggaattgactgatccagtgaaggtggagaagagagttgtttcaagacaaaaaaataccaacaatgaactttagatactgagaatgagtcactggaaggattgtgtagcagtaatgaacatccagaaaactcaaatataagctgcagggtggctgatgagttcacttttgacatcttaagttagagatgccatctgtttggggcatgcaacaaacatctcctttccagaacagaaatctgagctagagacagaaatccaaaaggtgtttaggttgatatggtggaaggaactggagaaaggataaaggacgtcacttttggggagagaggggagtagatcaacgagcagccctgcctaaagaggcagaggagggcaggagggaggtagccaagaaccaaggagagtctcagaagcctaggacagagtgactccaggaagcagcactgatgaatggactcagctatttcagagaggctgaggaggaccagttaggttagtcatgggacttgacaatcagagtatttttttgttaagagaagatgttttgttctgtgatggagtaggaaatattgtggtaaggaatgaatgttggaggaaaagtctgcagtgtttatatggaagaggctcggcaaattcacatgcccaccttggaaatttccattctcaggggtcagtttttgaaaaaaagagtgtgcttgtgtgtgggtgaatgggtgtgtctctccgtgtgtagtatgtgcatagaggaagggtttggggagcggaagggctcaggcactgtttcagccctgattaattgttgccatatggaaatgcgagcccagtcataccagcagttttgatttttcaaatgaagtaggcaatctagttttttttttaaaaagtgggatctgtatatttaaaaatcttgccccaaatttttaaaacccctgtccaagccaaataaagcctgtctgcaggtgagacacagcctgtgaggttgcagctcgcttctctggaacacataatgggtttaagagagac

SEQ ID NO: 39298 - DNA, 1071 bp, Homo sapiens
tacaggtatacaacttcctaagattctatatttttttaggcaaaaaatatgttcctctgcaaccataccacacagacttaacatctgttgtaaagtgtgttaaaatccggcaactcaatgtcagttggatctggctttatggtatgcttccttcattatggctctcactgggggaggagagctttctgataccatccaaacctccagagcaccattcaaagcagctggtattctatatattacataattatgaagcacaccgtgtagtttagaatacttaagaggcactaggggcccacttctcaaaatatttacagccttttattcttctaaaaacaataatttgcatgcctaaaatgatttgtgtacctttgccatgcaaatttcctttagcctctttttttctgttaaaccttgatctgaaaatatcagtgtttagtagtaaataggccagagggaaatgtaattggcaggaatggaggttttaaacatttcccccaaattttgggtattcaaggggaaatgggagaaatcatggagaaaggaaggtctgaggtaaggacccctgctaaggacaggtaccagatctaaggagaggctctaggacaggggccaggctttgcattgaaagggacaatgaggggctgagtgccatccaataggccaactgtctggggacagttactgatttagaagaatattaagaaaatggtttgggagttcctagatcccaaagtaaggcagtaaagcaagacctcatgccaagggttgttaaagagatcattcttggagctcagtgactctgatcacacagagggtctccccttaccagcctcgttcactgccctctttccaaatcttgtccactctttagaacttggctcaatcagccattcattcgacaaacatgaattgcacattctatgtgccaggcgatgtgctggacaatgggaataggaaaatacacgtgatagtataaccctttaaagactctgttgtcgaagagcagaaaggcataaaaccccatcagtgtgcccaggtatctgtggcatggtagtaaaagcaagtata

SEQ ID NO: 39299 - DNA, 1033 bp, Homo sapiens
tcttcattcccaaggcaagtcaggggaaaactggtggatgtttcagagtgtttgttttcaactaactacatgtgggagatccagaaaggatgtgatcacttaggacagccaattattgaatgtgcacactgaatttctcagctgaattttttttttaatttaatggaccaagtcatttaaggcctcatgcattatgtagctcagtgacattttggctgtcagagcaagactcttttgatttggtagaatatctggctgtgtcttcctttatttcaaagaactatgattttaatctctttttattaaaatctaaaagaaatgatcttacaccacatttttcaagaagttattttttttttgttttagaggaatctcaactgccaaatcagtaggctaatattaaaatattttaaattgtgtgatatggaagagaaaggaaggaagagaaaataattcagtcacgaaaaagggaagaaaaacctaatacataggatgaaagcaatcgttgctattaaatgcctgtgggacttattaaaaaattaggtatagagagtacgttcaattataagaatttttgccctgtcttaagagtgtgtgtatttatttatttaatgctacccaagttatcttttaagattattaggggcaggcatgagtgttcatatttaatttttctcatactgttatctaaactgatatttgtttccttttattgacagagctataaaaaataaaaacgatgtgaatttccctgtctttttatgtgtacttaactccaattgattttactgacaagagtgcatttaggagaattcccccaatattctaccaataaaactgtccctgcaatctgtctagtctcctgatggtccaccccattcattagcttcattctttctagactaccatcgcctgcgcatccccactctgcttaaatgtcccctccttcctcctctctacagaagtcacaccccgttccagacctagatcactaggctatctgatgattctaattacttttgtatttcatcta

SEQ ID NO: 39300 - DNA, 1049 bp, Homo sapiens
caggataggtgacatttgagagagaaccaaagagaaagtaggaatttcccagaggttgaagaatggagaagaaacaaagaggcttgacacaatcttggtgggactggaccaactgttcttgggcaggtaagaaaggaagtgaccagaggaaacgagaaggtttggtcaggaccacactgaaaagagccttcagagccatgctgacaagttgaattttattcagctggtcacagggacccactatatcttcacatttttaagaagcaaatatggcctgagctgatctctgtttaagaggaaaaacctgcgaagtggaggatgaattagagtgtgagaactttgaaattagcagaggtttgcatcattcaggtgagagatgatgacagattatgattgtcccaaactgacttgctctattgtaccttggatcaccaaataaacatcatcgcttcctgtactcgatttttaaatgttatcaacaatgctgtaaatatcatgttaattctgtgcccagaagataaaaatatttggtaaaaccacaattacttttgaaccaacctaataatattcttgatccacaaggatttcaacaactaattccttggtactaaagaagcagaaaagaattaaaacataacaaagatagcatttaataccaagtgtccttttaaaaaaatctagtatttactcaacagatttgaataaatgaactaatcagtagttgtacctactcacttattactcctatagtagacactatagagaatgtacagggagtgtactactgggttggaggaacaaaattagcctaactgaaataacagtgcacagttttgtactaatgctgtgatgcagatcacaagtataggtggcattcagaagaaaatataaaaagttttggaggcttcagggagaataaggatacattttattttactcctagtggatgctcaataagtatttagttactactgcattatacggtataaatgtttatttattgctgaatgactaagtgaaatcagtcttaaaatttgctctaaagatgg

SEQ ID NO: 39301 - DNA, 1026 bp, Homo sapiens
tcaatttctgtagtttattagcttggttcagtgtctttgagcattagtcaacatttaaaatgtaggtttttatgattctggaagaagcaattgcttccgagggagaaaacattctgtaaattacatgtaaatgtttttacttggatgagttcttttgcatctgtgcagaggatcattttaatttacacaagaatgaaggttttccgtgattgaatgtagtaggcacgcttgtgtatctaatttccacttcatttataccagagtctagcagacacaaggggcattttgttctaatgtaagtgctacttaaaaataaagtaaaattataataaaaagctaaggattagtgtgccatttctaattttatttcagagttgccccttggagtgggttggagcagatctgagtcatgtaatttggcattatgatgctctaaagatacagacgataaagacttcatccttggaacaaagcagatgagaaactcagagatgtgattgactaaaaacatcaaaccgtctcccctttccctcacagctatacatttcagagtttagtgtatttttcctacatagaaaactgttctgtaaatcctttctatttctttttccttaatctctgagattatgtagcctttacaaaattgggtgtttgaaaatccaaaggattataaaggcttcagctaattcagcttcttctctttgcaccattaaaatctttcagagaaataaccagcttctagtcactgtttattgacagtgaaaaggatgtgacattttgacattaatcagttgctgggctggagacaaaggtataggttttgatgttctaatatcactgcaaatgtaataataaaggccactgaaatgtggaaatgagtgtgaatatttgcctcttcctaactgagaaccacaagacttctttttatcttattaaatctgcgttattaaatgccctaaattaatgaaaggttattgctcaagaattcaaatttatataaaccagccagttctaagcttttagtct

SEQ ID NO: 39302 - DNA, 1721 bp, Homo sapiens
tgccttagtatagttttcttcatatatttcttatgcttctaatttgttgacctttttggacctgtagtctacaactacaaatcaaatttggaaaggttttggccactttttcttcaaatactttttgtttcctcatcctcttctcacctttgtatattccaattacgtgtgtgtatttggtcattcgaagttgtccttagctcatggatgttgtgttcattgttttcagttattttcactctttgtttctttttgaacagtttctgttgctgtgtcttcaagttcactattttttcttctgtcatgtctaatcttccattaaacccatccactgtatttttaaactcacatatttatttttaatcattagaagttttatttgggtctttttaatatcctcccatgcctctatttaatgtattcaatctttcatctagcttcctgaacacacaaaagacagttggaacaactgcctcaatttccttgttcactaattctataatctgtgttatttctgggtctgttttaactgattgattttgcagtttcctgcttctttatatgctgtataatttgttattagatgctagacaatttgaattttaccttattggttgctggatattttttattcctataaatattcttgagctttgttctgtcacaaaatttgcgtcaaaggattctttcccattacggaggtaagacaattcctagtatcctaaatatgctccccaacaatgacgggattatgagccacaggtaacctagctgttgagaacacacactactcctgggctctgtgtggactccaggcatttgtttagtctgatctttggggtgaacattctttcatggacctcagatagtttcctcagacatatgcgttgatcaggactccactgcgttcctacaggaaactctctgcagatctctggagttttctgtctgtgcagctccttcctctctgatatgctccctttggcattggtgtccctaaactccaaactctgtcatcctaactcaggagggctgccaggctctgcctaggaacccactctctgcaccatggcttaaaaactctctcgagacagtaggctggggctatcatcatgtgcttacttttaataatatgaaaaattttaaatgttttgaaccaggaagaaacacaacactataagcaaatataaagacaaacgtgagattgaggaaaaatattgttgacatgtgtagcagaaaaaaatactactattaaaaataaacaaaacataaatcattaagaaaaaaagataacccaagataataacagtcaaattcacagaagaagaaatatacatagctaaaatgcatataaacttacacttgacctaattaatcaacaagataaggtaaatgaggtataattttttcaattatctttttttttttttttgagatggcatcttgctctgttgcccagcttggagtgcagtggcatgatctcggctcattgcaacctccgctgcctggattcaagcaattctcctgtctcagcttcccaagtagctgggactacaggcacacaccaccacgccccgctaatttttgtatttttagtagaaacagggtttcaccatattggtcaggctggtctcaagctcctgacctcaggtgatccacccaacttggcctctcaaagtgctgggattacaggcttgagccactgtgccaggcctcaatta

SEQ ID NO: 39303 - DNA, 1040 bp, Homo sapiens
gaagatgtaaaagcattaaaaaatattggaaggctatgaattcagtatcagccatggttacctcttggggaggaagggaaaaggggagccagttagagggagaattgcatagtctacataacttctgtatcactcgaattcttagaatagtctatgtattatttgtgtcattataaaattaaaacatggggaaaactcatgccaaaatgaaagagaaaaagttcaaagggaaaatgaaaagaaggaaaaaaatgcaatcttgagatttatggcagactagtggatatcatgtggcatacttaagttgctttattcattcatggtctgtgttgaggggggccataggacatagaggaacataatagaattttagggggtggtaagtactcattattcattggtaaaatgtggatttggggccctatgatgagattaaatgtgtaagagaagcaattccatttgaggataagggaaggcagaggctttcacatttccagctgattgttaaggacagacaggtaatattataaaaaatcgaatgtaagaaaatgtagtttaaaaaatgagaaatccatttctgaactcatttaagctttctccccagatctaagatgaaagctcatcagctgtaaatactcagtgctttccaccgtgacagagtttaaattaaaacaaaaaaaaaacctagagcttggcaggaaagcagaggtccatggtatgaacctgtggccagacgtgcctggaaaagaaagagcagaggctgagtttccgtaaggtcctgtttctgctggctgtagccctcctgcagattctgggtttctgtgggatggtttgcttaagcaagaatttgtcagtgggtcaacagccctctccagtgaggagggtgcgtcgggctcctgatgccgagtccagtcacattgcacggctagccttaggccgacaatgctggatcagtcaggctctcctgggttgcaaatactagttcctgaaaccgtccttcctctctccctctcttcctgtctcccttcttgcctccttgt

SEQ ID NO: 39304 - DNA, 1050 bp, Homo sapiens
caacttgattggattgaaggatggaaagtattgttcctgtgtgtgtctgtgagggtgttgccaaaggagattaacatttgagtcagtggactggaaaaggcagacccaccttcagtctgggtgggcaccatctcatcagctgccagcactgctagaataaagcaggcagaagagcgtggaaggacttgacttgctgagtcttctggacttcatctttttcccgtgctggatgcttcctgttctcaaacatcagactcaaagttctatagcttttggactcttggacttacaccagtggtttgccaggggttcttggacctttagccacagactgaaggctgcactgtcagcttccctacttttgaggttttgggacttggactggcttccttgctcctcagcttgcagatggcctattgtaggacttcactttgtgatcgtgtgagtcagtactccttaataaactccccttcaaatatacatctatcctattctgtctctctacagaacactgactaatacactatttaacaccaaataattgtagactgtaaacctcaagctattttcttcaatttttaaaaaataatcatctggagccatccatccaaggagttgatgctggtaataataaggatgataagcaaagaacacttggttcagaagcctagttagcttcatggcattactgttcaggcaatggtgttcagtttgagtttctgaatggaattatttttcaggaacaatacgaaaacactgtaggtggtgagtaacatgttagataatgacataaaataggacaaaattctctagaactaaaatgcttctttgattacccatagctatgatatccactgtgttttcacctctgttacaattattttacaaatagaggaaaacacaaaacattcttaaaaatctcaaacctaacttgcctgaattcaggcccttagacatttcaatatttctttaattcattccttaatcacattattattgaagcaactattctgaaccagacattggtccagaataagatactgctgaata

SEQ ID NO: 39305 - DNA, 1057 bp, Homo sapiens
cacacacacacacacacacacacacacacacacacacttcaaaaccagaagaagaagaaacaggtaagtcttaccaaaggagagccaaggaaacatgttcgtattagaatagttgttgtgtaggagtctatgagagattagtgccgccaccacagccctcacagctagtgcagcagttttcacttcttgaaagggttaaatagtctcatgactacactagtgtcaactcatggagttaaggtttaaaactggaaggtactaatagaggtctatctagttaagtccatcattttccattgaatggactcaggggacttttccaagaccacacaataattgtgtgtaagctgcagatgttaatcctgctttatcccaaacctccgtgcattgggaggtggtagtgttggatcgaggtgattctgttttggagggcaaccacccagctgacatttcttaagccagagcccagcaccccctggcctgttgcccatggtgctgtcatattttgacctaaagtgaactgagacctcagatgtattcatctcagaacagagaatagtatttccatataaccatttactgttcaagggagaatcattttgaaaaatacttcattatgggaaaaacaatacaaagttaaacaacacaagcaaaggatagaagtattttatataatggtcagaaattatcctgaaatgatactggaacacacgatggaaaacacaatttaaaaactcagttgcatttgatcttacaagcatcataacaactcaattcttttttgctttagatacagaatcactttctcctaggtcacttccccagtatacccattctcctgacttgattgaggtcccgctctgagtccccagggcccgtgtgtgtctctgtcatggcactcgggacactgtgccaacattgtctcttcatcttgctgcttccctcactacacttaaccctctccatgccgtgagcaaaccgatttccactgcttattagcagatctgacaatatctggtacattctagtactcactagaactttgaagggaacttaa

SEQ ID NO: 39306 - DNA, 1090 bp, Homo sapiens
ggctgtcagggacagttcatgctgggaagttcacagccagcacaaccttctcctccttcctaatgggcacagtggaaacctgggccatctccccaaagcagcagggtaagctcaggtgttggggaccttaagtttcctcactgaatccaaacgtttggacctcccacattcttccaggcactcttggaaacagtctgttcccgaaaacccaaacaggaagcaggctgaaatcctcctcaccctcaatattgctctcagccaaatttcacaatcctgcctgccaagattttgaaatagagaggggaggtcaagttttctttctctgtttccctcgcctccacatctttctcttcccaccgtcgttctggaagggtgttctgctttctttacctcatattctagacctttctactcaggccatgtaataaattctaagatctagtagccaggcttggctctccatgtgctaagtgagagcaaataggacttaaaaaaatttttctccctcaattctgacctttatgactgttaacccaactccaggattctatttggtcatcaaagaccaaactgaccctttcttttcacctttccttgtttcttgtttcttttctttctttctttctttctttttttttttatgacggagtctcgctctgtcgccaggctggagtgcagtggcgcgatctcggctcactgcaagctccgccttccgggttcacgccattctcctgcctcagcctcccacgtagctgggactacaggagcccaccaacacgcccggctaatttttgtatttttagtagagactgggtttcaccgtgttagccaggatggtttcgatatcctggcctcgtgatccacccgccttggcctcccaaagtgtcttttctttcatttctaccatcacagccctaatgccctttctataccagacaggtcagtgcattgggctcacaaatgagcaactcaagtacacagaaatgcaaacgagagaagcacatcaaaatgtgtctaccgcactgcgtgtccttcaaggagattggtgtgggttccaggggattgtgtgtttgatcagcaaaaaaataaa

SEQ ID NO: 39307 - DNA, 1053 bp, Homo sapiens
ttttaaaagaaatttcaaaaacagctaggtgacattaaaatgtgtgagctttcctctacccctaggacaaaaactcatgtgcagtcatgcgaaaactatccagcattcatatcaactttcttattgaagaatttggtgctaaaccatgttctttagggaaaaagtccgtaacataccagataagttaaccattcaattagaaattaaataagagtggctgcagttgtaacttgcaaagttatggaatctatattaaatgtgaaaaagtttatctaaatccaattagttgattgaattatatgaaaatgccaatattcaactgtttctgatctgtaaaaaaatgcagattttatacagtttaacctaataaccagtagtaatattgagccatactcttccagttgaattttaatttactgtggtaactactgtttaaatcttgaaaagtaacgattgccacgctgtgatttgattaatagtgactaaatatatcctttatattttcttcttgggaaaaaaatggcatcagaacatggctttcaatgctgggcttccttctaattatgcctcagccccatttttccagatcccagagttttagttggctattttggaaaaatctaagagaaaactaaaggccttctgaagtttaggtattttaatggccctatcatcaagtttgctgattatttctttggccacctgaaatctgctgctgagcccttctagagaatgtgatgcattctctaggatgtatacatatagatatttcttcgaatataatgtaacataaaaatgtgaccccaaaatttaaaactgaaatagttgcctatgttgaaggataaggatgaggtccccctaattgtgaagtcattgaatttctcctcagtgccttaggtagaagcagctgtggtttttgagcaggtgaaactcctgttttactgtcagaatgcagtgctgcagtgaagactcactagcttttaaatctgtaattagaaccagagcatgtgaatgctccaaaatggttttggagtatagcaagtagcttacttt

SEQ ID NO: 39308 - DNA, 1034 bp, Homo sapiens
tcacacgtcccttttttgtagggaaaagacagtctgttttgaaggaacaccaccttggaggaaagcttattcctgtagtatttggactttcatcctcatatcgagatatgagaaaattgttttgttcatttatacaatccctgctggaaagtgttgccagaaataaacaagctctcaggagcaaatgattcatttctcatctactcagatgacatctggtttaagtgtgatgaatacatgcttgtttaaatcatgtggtgacggtgatgctatctgacagaaatgtgtgcaaatatttggggaatcccttaagtgcctgctaccaaagggtgagcttatttaacagggggaaaagcacaaacttcagtctatcaaatcaatgcttgcatccatttcctaaggctataagatttggagctacagcggtcgctctatttgaagagtaggtggctattttgacattaaatgtagatgccactagcagcatgaggatgtgaaacaaatgctcaatggtcactgggacatttaggaaatagcctttgaataaaagaaatgtcaagtgaccctacatgtttgaatggacttcagtacatttaatggtttggttattgtttttattaccttcacagttattcatttaatagtgtttagtggattgtgctaagccaaacacagaacaccgaggaggaaatggaagatgtgtgtctgccaggggacttcacatggccacaggggaaataatcagtcttaacataatgcttgattattcagatccacacgggacagatgtggcacatcctgaaaaatgcatgggcattatcagctattttgaattgttcttgccaagcccactcttcctatcctgaataacctgagaattagcagtatttaactgaaatgtattgagagtcatttgtctgaagggaatttaaattatatatagaaattctaagttatctgaatattgaaagttgaaggcttatgcataatgcacaacaattgctcgctgagttaggaataaacatttacatgga

SEQ ID NO: 39309 - DNA, 1033 bp, Homo sapiens
agggcagaagctgagagcaaagaatggtgtttgaggcttttggcaataagggattgaatgatgagaactttttgccctgtccccgacccatagatgagaggaggatgcttatttctatgtgacgccaacctgtagcaagtgggaatatgtagaccgatttcatctacaaccagggaagtggctgattgactacaaattagacatcttgatgtcagtagaggttatttaagtgatacagactaagaaaagcacattgacacagtcagcacaggataacatagattctctgtgaggctgacttcgcccagtatccagcagtggctgtgtaagaaatcctggtctctgtctgctggctgcactgctctctggagaagcacgcacaagaaagaagcgtttgatttggagatgatggggcggagaggtagccggaagaatgtcttcacctgagtttgctttggtcgcttgttgaacatgctggctccacaggaagattagacctttcttgtttgttcggagcaagcattcagaacacccagggccctcagcctcctacagccgctgggcaggtaaaggggaagcctgatgccttgccctgaactaaggggcttcgttaaaatttctctttttctctctcctgtagtctaccttgaactagactgatggttgtgtttattctttggtctctgtgtgcttttgtttttgggggtttctttttggtctgtgatctctagttttgttcagcagtgatttgtaggaggcatgctgactgtactgaataccaccccaggtactgctcagaaggcgtccctgaacttcagcagctgttagatcctagcataaaccgacacagagagacaggcttgtggtgaaacactggcctttctgcatgctgtttccaatcaaacacagattgtcctttccgcctgggagaatcatttccaaagccaagtgcctttcactaaagaaatgtcagcactctcatcaaaggctttgggcttctttgtaaatgtccaactgcatgggctagagtgct

SEQ ID NO: 39310 - DNA, 1047 bp, Homo sapiens
ttatgaggcaatgtttcctagtggtttgatccatgtgtctagggtcttgatctaggcccaccactcatggctctgtgatacagacaagttgcttgggaccacttctccagctatcaatggggatatgaaagtttgcccaagtcatgcagaggaggccatgctcgcctcattcatcccggtcattaaagaaggcctcgagagctcagtgccagctcccactgtgttccctttggttgctattgaaatattaataagattattgaatactgttctcccatgaactgtgtcacccttaactttgaatgtatccagatgacttttataagaaagcaacatgtgtgtcatgaagagggaaaaaaatgacttcttcagccctttttggaaacagttaagatagaagtcataaattatgaagaagttattgagaaaaaagtgaaaatttttgctgatgttataaaagaatatcttatcctcccctcataactctaaaatataaaaatattttttaaattgcttatcaagccagatatgaaaattaggactagtgaatatgtgaactgatatgagctccaagagtttgccaaacaacaagtttgtaggcctccctgagtttatttgatctatttttcacacttatgattataaaactgcttaggatgtgttttattttaaacgaaaccagcacctaacacctagaggtgctcaagtattgattctccttcttccatacttcatttacaaagttaacttttaatggcaaaaactgcaattacttttgcaccaacctgatagaaattgtgagtttggaagactccaaatgtacacttctgaatggctgattatccagcaaagactccaaacaggctgcctggcgaagaggctaagttgtatcaggctctcctctgctctagcagaaaagtgaatttgcacagttgcctgagcttcttggataatgtttgatgtttttccctctctactgagagagagagagagagagagagagaaagagggagaagaatcaggctcattactaggttttttttttct

SEQ ID NO: 39311 - DNA, 1091 bp, Homo sapiens
aggcttaattgaatcacagttctgcagacttaacagaaagcatgactgggagacatcaggaaatttacaatcatggcagaaggcaaagggaaagccagggccttcttctcatggttgcaggagagagagtgtgagcgagcggggaactgccactcacttttaaatcatcagatccaatgagaacttacgaacacaagaacagcatgggggaatggcccccataatccagtcacctcacacaagatccctcccccgacatggggattacagtttgagatgagatttgggtggggtcacagagccaaaccatatcacttgatttgcctgggataaccttgtcttagatgcctattgtcctggcatcattatcaatagctccttcccttcattatcaaaagtgctcagatttaggtgttaaagtatgtggtcacctgctttttggagatatttctgtgagttgaagaaagccaggaggtggtgccactttgtagaatgtgtcaccatgtagctcccagggtagaactgaggaacccttccttgctgaggtgcctgaaacagatgcagagtgctgagtggagaactcagactgttcagactggggacgcagagcagaattgtgggctggtagcaccggaaacatcatcacaacccacagagtggagcccaggagattggccatgcgagggatgactgaaaggcctgtgcatgggagaacatgtataagacaccccacaaacccctgaatgtaaggggaaactgagtggaggcagagatccgtggttttgctattggaaagtggcggggttgttgaccacatctttcccagcctaggggactgtcaagctcatcccttcatgccccccaggtgcatgtggaggtgtgtgcagtgtaggaatagcataggagcagcggcacaggcttcacatcactcttggactttcaagtgatgctcccagtggaggtctttcatcaggcccagcccccaacctcattctaggcaatgtgtcctttctggcggtcagttcctaaggaccttctggtggtccctttacttctccctcccagtctcctgcccacaacgccagtgagag

SEQ ID NO: 39312 - DNA, 1026 bp, Homo sapiens
attttgaacatattttttgcccgatgtgaagtatctccttttttttggttacttgctggaacagaattctaaactgttaccctttcaatgtctcccaatgtttcttcagaggttttttatgtattgaacaaaaagttttcaatccaggtcagaaggatcatttcttatgtcatctcctaagagttttataattttgcattttactctaagtctttaatacacctgaaattgattcttatttatggtataaggtaaacatctaattccattttttaaatgacccatttaaaagttagtcccagattatttattgaaaatttgcagacccagaaataaagccacacatctaccagcatctgatctttgatgaagttaacaaaaataagcaatgaggaaaggacacccacccaataagtgggcgctgggattactggctagccatatgcagaagaatgaaactagatgcctatctatcaccatatgcaaaaattaactcaagatagattaaagacttaagcttcagacctaaaattataaaaatcctagaagaaaacctaggaaatacccttcaggacattggccttaacaaagaatgtatgactaagtccccaaaagcaattgcaacgcaaatgaactttgaggccgtgtgcggtggctcacacctgtaatcccagcattttgggaggccaaggtgggtggatcacctgaggtcaggagctcaagaccatcctggccaacatggtgaaaccctgtctctactaaaaatacaaaaatcagccgggagtggtagtgcatgcctgtaatcccagctactcgggaagctgaggtgggagaatcgcttgaacctgggaggcagaggttgcagtgagccgagatcacaccattgcactttagcctgggtgacagagtgagactccacctcaaaaaaaaaaaaaggaaaattgacaattggggcctaattaaactaaagagcttctgcacagaaaaagaaactatcaacagagtaaacagacaacctacagaatt

SEQ ID NO: 39313 - DNA, 1021 bp, Homo sapiens
caggagtttgagactaaccccagcaacatagtgaaaactcatctctactaaaaatacaaaacctagccaggcgtggtgatgtgcacctgtagtgccagtaacttatggggctgagacaggaggattgcttgaacccaggaggtcaaggctgcagtgagccaagatcacaccgctgcactccagcctgcatgacagagtgagaccctgtctcaaaaaaagaaagaaccctgtgggatggattggaatgtagcaatcagtgtaaattcataatttctacaataagcatacttgtgtaggtaatgcatgtaatatgagcgtatgcatacatgtctgtgtccacataggtatatatttgcctgtgtgtatatatacgcagatattttctagctctattcaataaaaaggcctagaaacaaaggcatcccagtaactatgaacacacctagcactctaatcttagattctaatgctgtgcctcactaaaagaaaccatggctctgttgaacaaggactcactacattactttaagaagtaaactctgggaaaagaaaaacttttgacaaattaaacttaacagaatttatttgagcaaaaaatgattcatgaaccaggcagcactcagaatcagaagaggttcaaagagctccacccaggagcatgagaagtgagcttccataggctgaacatggaagccaagtagagaacacatctgatttgttacagcaaggtgtttgccttatttggatatggtctgatgagttggctgtctgtgattggctaaagcactgctgcttatgattggctgagacctgtttttttttttttacataagttagactcctaagttagattccagtttgtttcagtactaccttaggttgcagtttctctttattcttttttttttttttttttttttttttgagaccaagtctagctctgtcacccaggctggagtgcagtggcgcaatctcggctcactgcaacctctgcctcctggttcacatggttctcctgcct

SEQ ID NO: 39314 - DNA, 1079 bp, Homo sapiens
agataagccatcttgtcttttgtatgatcctacctgctaactcatatgtagccctttccctcatttccaatagaaaacatcaaacttattttatagatgggatagttttttttcaaatctagtgaaatgaagaaggaatcaactgaaatttaagcagaagagaataacatttaaaataaacttctaacttagaagaaatttgaatcttcttctctgatattttgctcctagaatgatgtagttgtggttatttctagaacacaagtgtccatattatattatatctcatggtctgacccaagcagtcatgtggaatataatgattccagtgaagtgatgccatgaaatacataaggcaactgttctttaacactttcattgatataaatactatgctcctccatttgggcattctgtctaagacaccataagaggatagaatcaagttataagaagaagaatatatagtttttcttctatagtgatatagaagatatagtttagatagtgatatagaagatatagtgatatagtttggctctgtgtccccacccaaatctcatctcaaattggaatccccacatatcaagggagggacctggcaggaggtgatgggatcatgggggcagtttccctcatgctgttcttatgatattgagggaggtctcatgaaatctgatgatttaaacatggcagtttcccctgctctctctctctctctcctgctgccatgtataacataccttgcttccctttcaccctctgtcatgattgtaagtttcctgaggcctccccagccatgaaaaactgtgagtcaattaaacctctttcctttgtaaatttcccagcctcaggtccttctttatggcagtgtgaaaatggacaagtacataaaaattggcaatgggaggagggcactgctataaagataacctgcagatgtggatgcaactttggaattgggtaatgggcagaggttggaacagtttggtgggctcagaagaagataagaagatgtgggaaagtttggaacttcctagagactttttcaatggttttgatcaaaatgctgatagtga

SEQ ID NO: 39315 - DNA, 1035 bp, Homo sapiens
atgaagaacctctactaggacaatgcagaggggaaatgtggggttggagcccccacacagagtccccactggggcattgcctagtgaatctgtgagaagagggccaccatactccagaaaccagaatggtagatccaccaacagcttgcactgtgtgcctggaaatgctgcaggcacttaataccaccctatgaaagtagccacagggtctgtaccctgcagagccataggggcagagcttcccaaggccttgggagcccaccccttgcatcagcatgccctggatgtgagacatggagtcaaaggagattattttggagctttaaggttttttttaaattttttaatttttcttttaagtcagaagtgggacttgaagaagctttaagatttaatgagtgccctgccaagttttgaacttgcacagggcctgtggaccctttgttttggccaatttctcccatttggaatgggaacatttacccaatgcctatagccccattgtatcttggacgtaactaacttgttttttattttaccaggctcataggcagaagggatttgccctgtcttagatgagactttggacttgcacttttgagttaatgctggaatgagtggagactttgggggactgttgggaaggaacgattggttttgaaatgtaaaaagacatgagatttgagaggggtcatgggtggaatggtatggtatggctctgtgtccccaaccaagtctcatctcaaattgtaatccccatgtgttgagggaggcacctcgtaggaagtgattggatcatgggggcagttccccgcactgctgttcttgtgatagtgagggaagtctcatgagatctgatggtttaaaagtggcagtttcccctgtactcactctctctcctgccaccatgtaagacgtgccttgccttccccttcaccttccaccatgattataagtttcctgaggcctccctggccatgtggaactgagtctactaaacctcttcctttgtaaattacccagtctcaggtcatt

SEQ ID NO: 39316 - DNA, 1058 bp, Homo sapiens
taaattctataacaacgtcaggtatcaaaccaaattcacactcaaaaatttcaagttgagaatgccctttatgtaaacccaggttaaagattttatcagtaaattcacagaggcaaatgcaaatcctctgcagaaactcacctgctgtccaggcctcaaagaaatgtcatggatacaagtgtaatgacatacactgaaataatgagcttctagtggaaaacactaaacacataagcaaacaaagttctatacacaagattttgataccgggatcatcagaaacaatgtaaaatgagtatgtttcaagaaataaaaatatgaacttaaaaatatgtcagaaaaaaagagactttgtttaaatgaccaaggagacttgaaagcaagaaaattgaacttctagatataaaaaaaaaaataaaacctaaatcaacaaaggattagatacagctgaagagagaactgaaaagctgaaaaatagattaaaagaaaattttcagattacagagaggtgagaatatagaaaatacaaagaaaaagttgagagacgtgtaggatagtataagaaggactaacattcatataatcagagtgcaagggagagaaaatgtaaagaatggagaagatattaatccttagaatcagtaagttctgcaaatccacatcaaaataaatacaaggaaatccacactaagaagggtcacagtgaagctgaaaaacaccaaagataaagagatttacagacagggagaaaaacaactattatgacaaaggaatggcagttatactgatagctgatctctgaatagaaacaagggaacccagacaaagcagaataatatctaccatgtgctgaaagagaataagccaatcaacagttgtctactccatgaaaatacttccagctagaagtgaaaatgaagatatttttggacaaacaagagctgagagagattttcacctatttattatcactaaagaaattagaaggatgcatttcagaaagaggaagttgattacaaatggaaggcctgggatgcaagaaggaataatgagcaagg

SEQ ID NO: 39317 - DNA, 1060 bp, Homo sapiens
cagggctgggaagcagaaataatgcattattttgttgagcttattaacatttgggcagaaaggatagattccttttacatagttaggcatcattttaacatgtacattataggtggtggcttttttgtaacagaaataagtgtagctatcccttaacaggagcaatttcccttcatatttcttgcagctcttgtcccatgaggcgacagatgagtatgtgatagcaatactgattccagtgctgagatgccatctgatccactgggagagctggtggattcaaatcaatgtcagctcatgccttctgggcagcagtctttcagtgcaggatttactctatggatcagaaaaacagctggtgacttgcaatatattatacaaaagacctttaaaatgttttgttgtttccagctatgatgtagtgtgagtcacttcaattttttttatttgtgtgcctttctgatggaacaaaattccgttaagcaactggtaaaaacataatagtaatttaaactggtgtctgtagaatattgagactgaagagtgattagaaataaggttttactttaatgtgcatttttagtgtaaaaattttacccatggaaagcatttattggaaatcctctcctgagattccctgtaaaatataagcatatgccaaagccaataatccttgtgggttacttggaattattggaaaagaataatttttaccgagttattttgctaagttgtgggttacagttatttgtttccagggtatattgtttgtacatgacagaattttggactttcttctttcctttaggtcaagttttttccccataaaagatgtataataattcatattaacattaaaacatttattttgggaggaaatactcaatgcttttagtcccagaactagtcttctttccctcactgagtcatttttggtttttatactttggtttttcatgggtttttttaaatgaggtttctttctcactttaaaaaaaaaagtattttctgtctctgtagtccaagtttctggtaacaattaggatcactagtacagaaa

SEQ ID NO: 39318 - DNA, 1055 bp, Homo sapiens
ggctataaaagagtgtcattttgtgattcagaaatactcactctttaaaatgttagtttcatttttagcgtcctcacattcttttggttccttttattggaatcccatcttataacctaatcctattaatatttatagggtccacatgaatatgaaattaactagtaggttccatttatgaaaagggatcaactattaagtcctatattttgttctttaactttggaatttgattcatgatatcttgtaaagctttgaagtcaactgacagtatgacagatttacaaacatctgtttgaatttggaggcctttccatctcttctgattgaaagtaattatactcctcttctgcacctgttgcattgttttatgttgtcatatactcgttgagtgcatgtacacgtatctgtcacgtcacttagattgaaagcttcttccagccagaaatttgtgtcatttgtctttggatcctcagtggtaatcagagtctggcatatagtttatgttcagtgtatttctaaggagggtagatttaaggagggtagagatgacatcatcatagtaataaataagagtaacttttcttaaagactggatttctatacttgggaaatggatattactttgaaggggagaagagagtgagagcaagagtgagaaaagaagaaaatgaatggagttcatgagtacctaggagttgtttggctagaataaaacaagtgtttcattacaggaaatgaagataatataaagagcagcttaaacttttttttagtggactaagttgagaatcctgtggagtgtagagttttcatgtctgggtagtcatgcctttcttatagttatggagggttaggtatgaacggggaacatttaaccatctgaattgaccatattaaccgaaaatggcagtaaagtaaccataaatgccagggaagtaaccatgcctacctaggacacatcagtgataagaaaatgcttctttcaactttttaacagatttattgaactgtaatctacataccataaagttcacctttttaaagtgtacaat

SEQ ID NO: 39319 - DNA, 1031 bp, Homo sapiens
caacagtattattttgattcttcaatttttataatatgatatcctttgatggtgggaactatgtcttacccatcactgctcctagcttactgaactacagtgaatgttaattgaatcagtaaatatattaataatcaggattgactggatttaaataagattattgcaactcaaagaatcctcgggagggcatcatccatcttcaccatttgttatgaactcttcatgtgtattaattcatttaatgcaataacactataaggtgggaactatcatcattcccccattttacaaatgaagaagctggggtctggaggacccatctcgccccatcacacagttagcaagtggcagaacaggaatgggaagccagatattagatacagaatttatgcatttgcaaccacacacactgccagccaaaaacatgcttttcctctccaagagcacaaccgctagctttccttattggcttatgaaaactggaaacccagtttttaaaagactgtgaaaaaaaattaagccaatatgcttatcattttaaaaggtactctatttaattgaggatatatgttttcatacttttattcccaaatggttatcacttccttaattaaataatacatcaattatatttgtctataaatatgtatgtgtatatatacatgtgtgtgtgtgtgtgtgtgtgtaccaggccctcaataagtatttgctgaatgtttcttttctgcaaaatctatgtatactaatgtttgctaaattagtatacacagtctttctactgctgtttagagggaaggtgcgatgatttcccatgtttttaaaatcagatggttcaatatattcatgccacatttagagaagaaagcaattcacggtagagtatgaactctcaaagactttaagtctcaatgtaatttatcaactttatatatcaacaaacttttatttagtcctctctgtatataaaaagcttattagcgatcacatgctaaagcagatttttaaattgctagagccttaaaatgccc

SEQ ID NO: 39320 - DNA, 1047 bp, Homo sapiens
ttctatttagtggtgggggcggggagttgctggccatttgtcatctctcttcttcaagtgggatcatagtcagtttgagtgggatcatagtaagtttagtgctaggtttgcattttaggagattctgtaaacttttgtcatatattctcagttcagcattgcatatgatttctattattgacaacaaaaggaaaaatatcccttattgtctggtggcaggtttgttttgttatatctacaattgaatatagacgtaagaaaaatattatttaagatttcttctatggttgttgaaaatttgattgccacctgcattggaaaacaacaacaaatacaacaacaaatcttgtgcaaaactgtgcaccgatttcagaaagtgaaagtatcacatcccctttgaagagggagaaaaactgttattggaagttaatctaaaatcaataccttggttataatgaaagccatctgctctaactcagagtgaggcagactttattgtcttttcaatcacctactaatcaacaggaccaagatttcctggaaatttaactgtaatttttaaaaattgtatatctcaatctctatttttttccagtttgtattcataacaaaacatgagtaactcaagtcaaaaaacaatggcccctggataacaaaatcacacctgagaatgaaactagattattgaaaacatataagttttaaacactctaaattatagatctcacattaagaaattattgaaaggaaaagaaagaagctctataatgacatctctcaaagataatcactattcacagtttaatttttattatatttattttttatgtttttttatagatacaattaaatatatatgcttagctacatatttttaacttaacactaaaacttaagtttttctgtgttgcaatataatgttcataaccatttgtttactggccaccctgggtggattaatacattaaaataatcatttctttgttgttgaacttataggtaaacaggaccaaacctcttaatacacatatttaaatgagactcgat

SEQ ID NO: 39321 - DNA, 1039 bp, Homo sapiens
aggcaacatggtgaaatcccatctctaccaaaaaaaaaattaaaaaattaactgggcaaagtggcacacacctatggtcccagctacttgggaggctgaggtgggaggattgcttgagcctcggaggtgaggatgcagtgagatccagccactgcactccagcctgggcaacagagtgagactctgtctcaaaagcaaaagagggtagagaggaggaggggaggaaggacagtgacaactatgagatgaattcacatgttttctgagatgacagttagacatacagcaatgacaattcactgagctcagagaaaatgcaccaaaaacaatttttaagctcaatagacatttattaaatgaatgaatgaatgactaaagagattggaggtctctatttgatgacagctattgagaaagagtgttttttttctctcctcattcctctcactttttaaaactgaggtaaattcatataattcgctttaagccattttaaaatgaaccattcagtggcattcacagcgttgggtaaccaccacctctatttaactccaaaatattttgatcacactaaaatatatctcctgcatcataaatgacacaagaagtttaaaataattaattgattgaaacttacataaaacagattttaagagaaattaggcattttaatttttttaaaaaaggtttcagaggaggacatgtccaactggcttaagggagctgctgacaagttctgactgccctagggctcctcctgaggtccagccacaacccctcttcaccactgaggcccctttcctcctgtggggtccccaaactgtggcttcataaaaaaacaaaaacaaaaacaaaaccttttcccctgagcttaatggctagggtcgcgagtggtgtaaagggtctatttgagtccctcgacttggctgtgtcccatgagcacacacacacacaagctgcacatccctcggttcacagctggctcattttaccattccctcagcaaaggattattgagagtctcatccctcaggtcttt

SEQ ID NO: 39322 - DNA, 1081 bp, Homo sapiens
agtatggtctgattggagggttttggcatggggaatctggaggcagattctatacctagaagcaggacatcctgtgtggctggtcaaggctttctctagttagtcctaagttgtaggcagtgaccaaaattaaggaagctgtcagttactaatgaaatcctggccatttggggcagattgttagaggagttattgtttgggttgctgaattgttactagagatagtggtctgatttcccatgagtctgacctgcagagagcaggctggctttctggcctcgctgctctagacaatagattggtttcctgggctggttgctgcagactgtggccattgtccatttgcatatacagtctctcaccatcaaactgagctccatgtgctcatctccccttctgaaggtcactttcatccaggattcttatgtatttccacccttgccagcagctgtgagcagattctacaggggccaataacactgcaggcatctctgctggtgttgagtggggttaccaagcaggggctccatcacggagcagaactgctgcccagctgctcggcctggtacagtgcactacacaccatgctccataaagaagcatcttagatataagaggcccagactttttacagaattgcaacaagtaggaggtaatgaattcttactgcatgccagccatcgtaagaagtatttacagatattttctcacttattcctcacaataaaactatgaaatagatactactatttccaatttataaatggtgaaactgaggctgggagagattaaataatttgtcaatgatcacgcagctaagaagtggtgagtctggtatttgaacccaagtggttttaatccatgttgcatcattatgctactgtgggagaaagagagggaaaaataaacctctttctgtactaagcacctaagaaggaaagctcatcagagtgctttgcttcaataagtaaaggaagtggaagccttctgaagtctccaggaagagctggtgataaagatagctcaggagtcagggctctcagagcttcctgtggggccggtcctctgaagatacaaagag

SEQ ID NO: 39323 - DNA, 1062 bp, Homo sapiens
ggataggattcttgtcaaggatatggtagaggaacttcaccataagaccagggttaccttagattaccccaagatttcttttgacattctgtaattttagtaccttacatttaatagatactcaacatacataggaaggaaggacagaaggggagggacagaagaaaggaagaagggacaatgtgaatcatccaaaaagtattgctatcatgattatttggttttcattggtattcattatgtaacatcaagctcaccttcctactatatgttgagtttatacagtgttactttttataaatatgcatctgtgagcacatataaactatgattgggagaagcaaaggggtgatttattgatttatgcaacatatgcagagacacctctggagccaggcattggcaaagtagatgctagggatgcaaaaaagagcaagacactgaggcttgggcctgtctgagacacgtccacgtagacagctcactaaagagggaggccccaagtagatgagaattaagaaaagggctgagttcagaaagatgtgatggctaatctaaaagcaaaaaataaaattcactaattctagattcattttcctcttctgacttttccaaaattacttttcatattagttcattctcacattgctaataaagacatactcaagactgggtggtttataaaggagaaaggtttaattgactcacggttcagcatgactggggaggcctcaggaaacttacaattgtggcagaaggggaagcaaacatgtctttttttaatttttttatttttattttttattattattatactttaagttttagggtacatgtgcacaatgtgcaggtttgttacatatgtacatgcgctgcacccattaactcgtcatttagcattaggtatatctcctagtgctatccctcccccctcccccaaccccacaacagtccccagagtgtgatgttccccttcctgtgtccatgtgttctcattgttcaatccccatctatgagtgagaacatgcggtgtttggttttttgtccttgcgatagtttact

SEQ ID NO: 39324 - DNA, 1044 bp, Homo sapiens
gtgactcttgcaactgatcatgttttcctcttcatattttatgccagaaagccaactacaagcaaaactcttttttgatactaatctcacttctggcactatctgattttcatgcacattttttccttgccttactttttgtttttattttaaatccatatgagatagctatattatgtgcaaccatgtaagctgctctaaatcactttttggataaaggatatccttgataaaaaataaataatggatagccatatttttccctttgggttctagtttggaataatccattatttatctcagaactcagcaagtcagaatcttgctccaagccagcaaaatcatctaagagaatgccccagaattactgcagaggtcacctttaggcatgaatggacaatgcgtttcaaatggcccattcattctgtccttggcacagatgctgttgtggataattattttgatgctaatatatgtgtatatcttttttaatgtggatactagactgaaaaattggactgagaccaataatcaacagatggcaatcactcggggtcatgactattctgggccacattttcactggtgactttcaattatattgagacttatagtcccaatctggcctagcagtatctcccccattgtctgcatacccactcagcaccatcccactgtgacagtctgtgaatactctccttacaagaaaaaagactttcctgtatgtgactgcacaagagtcccaaagtaaagattgtagaaatatttcaccatcagtgaacttgaaatatcctgtatttttatttcttagtgttattacacttagtgtaagtgatgcttcaaaacctattctttttaaaaagcatctgtctcaaggagtatcatttggaaatagcatgaaaaaagtgtcgtaggtcactgcaaaagtagatttgacctgtgtcagtcatatttgaatgattcggtttaatctcacactttgctattgaacacatactcttttcaagccactctgtgtgtgctacaggatgacagctctgaagg

SEQ ID NO: 39325 - DNA, 1032 bp, Homo sapiens
tcttaggcccatcttgttcctggatgcttattttatatgcatccaaatatgcacaagacatatattcagtatcaccaaatagtagttttattgtatgtaataaatccttggcttggcgcactcttatatagattagaaacagtattctttatgtcaatgaatgtcaccacttctgtcaagtacttctagtttctacaggctcaagaataccttttcttgacaatggttcaggatataggctggtattctgccagccttctcactgttagttcatttctttaatagcatcttggtgagagtcttttcagaacccagggactccagcctccaccccttctattaactaaaaatccctgaataaccctccatatggtgccggcatggcatttgataaataccttgctgattatttatctgactttacatttattttgacagattgagcacgttagtctgtattgaaactaagctcttgttgtaaatatcttcctacggctctctggcgctgtgttgagtgatctactgaacttctgccacagcaaacttgggggaaatgaggaaaaggaaggcacactctgaaacaaaagcagacaaaagcaattctgaaaagcaagaaaagggacagaactccattggaggtcctggtgaatatatttgtaccttctgtcagcacgtctcgtgactgtaaactgctgtaactaccaggatcaataaagggcaaggccttgagatagtaattatgctaattggtagtgactagaaaacacgcaggctgcaggataagcagacagtgtcttgggagaaacagacacatttgttaagaagggcaaggtctggtaggcttcgtgagacttttcctataatcagttttctaagaaacaccacgtgcatcagccaacatagtttgagttcttccctcggtagaagattgtaccaggcactgcagaagaatatccaagaaagaaagactcagcacctgccttctggaagcttacagcttagctcattctccaggcatgcccaagcacgtgc

SEQ ID NO: 39326 - DNA, 1056 bp, Homo sapiens
aaaatccaacttgcattatagcagaatactaaattctgtcttctaattaatttttaaagctcagatttgatagcaggattaatcttagccttattttcaagacaatttaaaaattactagagaacatttgtttcatttaataaaaacgtattaccctacagtaaattgcaattcagattatacgttgagcttccatttggctgaagtatgtactcttgaacggctttgtctaaaattagagaccattttcctataaaacaagagtgcttgagggcttgaacatccaaaaatgttaccttaagagtaacgggctgtggtatagaaactgccatcatcagataattacaaccacttaaatgaaagcacctctatccaccctttcttttccttccatcttctttttctatgggtgctgttcacatgctgtcataattccagggagagttgcataatggaaaaaaacaaaaacaaccctgtgctttgagctagggatccagggtttaacaccctactctgcactttacagtttgtttgaccttgaactggccacacaagtattctgagcttatttttgccatctccaacataggagaaataataagacctatctcaccaggcttttgtgagaactgactgagaaaacaaagagctcctgtcaaccactggatgatggtagctgggggacttctcttaagataggaagtcagcaagatggctgtcgcggattcctcttctccatatgcgcatgtcaagagacagaggctaattctcctcttctgaatctgggctggcctgagtgactagtttgactgatagaaccaatggcagtgacattctgggacttctaaggctgggccatagaagtcttacagcttccacctgtgtctcttaaatgcctgctcttataatgttataatctttcacaacccagccaccaggctgtggaaagcccaaagcacatggagaggctatgtgtagatataccagttggcaaccgagctgagctcccagtcagcagctagtgtcaacacaggccacacgagtgagccatcttgg

SEQ ID NO: 39327 - DNA, 1031 bp, Homo sapiens
atttctcttcagcacaaacgagtctgtagaaggtcaaacaggaatcagagtagagctccaaggaaaggaggcatttgtcagaatgtagaaacctgactgggcacagtggctcatgcctttaatcccagcactttgggaggctgaggcaggcggatcacttgaggccatgagtttgagaccagcctgaccaacacagagaaatcccgtctctactaaaaacacaaaaattagccagacatggtggcacatgcctgtaatcccagctactcaggagatgaggcagcagaattgcttgaacccaggaggcggaggttgcagtgagcgtagatcctgcaactgcactccagcctgggcgacagagagagtaaaaaaaaaaggaactcagaattctgattttattgtagacctaaccagagggataaacgatgtctttgtggctcaaaaacattgaaacttcatgtaatagcctaagaaaatacactgggaattgagacgaaactgatggaacattcttctgccttaaatgtcctgtgagaggtttccatgaaagatgatatatacattgcaaagagctacaatgagaattgaggattccatatcctggcacccccatctttgtccatcagaagcagagttagaatgtaatgcaaaagcaagaagattgcatcagtacaaaatgggaccaaactgtaccctttaggattctctatcattgctaacagtgggtcacaaatctggtttcaatcaacttatcagctattgccaagaaatttagaccctgtccctatagcacattttagactacattttgcttgactttctgtatgggtagatttgattccaaaaatatattttaagatcatcagaaacaaagaagctgtttaaataataggtgacttgttttaatgattaacttcgctttcttcgaggaaaggaatgagcagagcgaacaaaacagcagagagatattgccaaataactgtgccctgacatgtccacacctggcaggaggggcacaggaggcaagttca

SEQ ID NO: 39328 - DNA, 1033 bp, Homo sapiens
aacctctgcctcccaggttcaagtgactctcctgcctcagcctcctaggtgcccaccaccatgcctggctaatttttgtatttttagtagaaatgaggttttgccatgttgcccaggctggtctcgaactcctgacctcaggccatccacccgccttggcctcccaaagtgctgggattacaggcatgagccaccacatatggactaaatgcatctttttttctgccataggattttatttggtaaggatgtgctgtctgtcatttacagttcaaaagccaaaatcaaaattaacgtgataatctcttctaattcagaaatttcacaatctgttgtttcatcctctgcctcttaactcttcagggtcaggaaacaacagcagtaaactccacaccttggatcccagtggtagagtcaaggtactccgcaaagacttctggatgaccttgagtctgggggtaaagttacacacagcactgtctggtaggacactctggttctctagttataatgctagggacatgactctgcctgcctactcctcaaaaaactgagcaaaaaattggcctcaccccagtgtttggcaccagaatgagtacccggtatgaatctttgtccgcaaacatttatatttgttttaaagccactgtgagcccctagctgttcttcatttttgtcattgctgagctctcctttccttcccagagctgcaccagatttaaggaagcttatacaatacccagtaaggcaaaccaccttgactatggtctcaccagcacaccccactgtcccagaccacagtggcccctttgatgcccagcagctctctgcttcctccatgacctctgcaagtaggagaatctttgtggaggctgtgaatcccagtcccatcacttctcttcctgtgacatcccttaagtcttccttcctagggtcttctgcctcccagaagaaagccggggagccatgcttctctacgacctttgcacctcgccctcctcctagaccaggggaagtgttttcctacatgaaa

SEQ ID NO: 39329 - DNA, 1087 bp, Homo sapiens
tcatctccatacataatgtatgattgtgggagagctctctggggaaacaaacaggcaattgattgcaatgactattctctatttattccagtgataaaaatgaaagactggactccacatcagattttttttattaaagaacttaaagaaaaatggtttatttgatgtcttattacatcataaacacttaacaaatttctaagcattcattttattttagcataataccactacttaatggattgattttttaattgtaggaaattcaggtatttgttttcaatcctgattttttaaattctatagttgcttttccctgaagtaaaaataaatgtgacaatcataaatggagtggggaggtaatgcatgcctacatacacatttaatcgttcagtcaggatgctcattatatatgtgcatttgtatctacttttatctgtcaaaatgctttaggctgctggtaatagaaaactcagctcaaagtggtttaaacagcaaggaaaatgcattatctcccacaacgcgaagtggggcacctccggggttggacaattctgtagctcaactgtgtcatcaagaatatagttttctctcttctttcttctgtgccttcgaggacacgtagcctgtgtattcccactggcttctttatggttgcaaaatggctgttgtaagtacacttatgtcactcaggacaccatctgatttccagtggtagaagagtccatctcttttccggtatctttctctttttaggagccaggcaacctctccggaagctggggtcctacctcaagtctcattagcaaggattgggttatatgtctctgcctacaacactcacgatcaaagacagtaggaatgccctgattggtttagagagttcaggttaacccttaagctccattgggggtggggaagtagtatattcaacaaaattttggattgatgagcagggaaacttggagtcaggaggtggtctgaggtggctgttggggaggcaacaataccaaacatttattagcctaagtatagctctacgaagtatgaatgttactaattctgaaatgttccttgtggttttagg

SEQ ID NO: 39330 - DNA, 1050 bp, Homo sapiens
ctaacatcattcccccccatcattcccccccgacataacaaaagaaaaaaaagattgtgtattttcaacacggcaaggattgttcttgtgcttggttgatggtggtgaacagaacagccaaggtctcagccccatggaacttacaccctcccatgaagcacttcacatgcaagtcctgccatcacctagcactagaacctgcctctgggtggttgccctggaaagagcagttaccttcgaagtcagactgatgctcactgcaggccaacctccaccacttggcagctattcacctgtcagagttcagtgtcctgggaaaagcttctgagccgcagtcctggtccacaaatggatataataacactcaccttgcagggattctgtgaaggtgaaatgagacatactgagtagaaagtacaatatgtggcacatactaggtgttcaatccatggtagcccttcattaccttgatgaacaaatagatcaaaagaggatctaaggaccctcacaggggtgagccactgtacccatccctaggatcgcttgagctcaagagtttgagatcagcctgggaaatagagagaccccgtccctacaaaaagaaaaaaaattagctgagtgtggttgcacatgcctatagtcccagctactcgggaggctgcagcaggagattcgcttgagcctgggtggtcaaggccatggtgagccatgatggcaccactgcactccagcctaggtgacagcgtaagaccttgtctcacaacaacaacaacaaaagagacagagagagagaaagagagaaaaagacctagtgccggcatagagaatatggcatgtcattgtgaaatttcagaagagtagggttaaatggaagagtgttgttttgttttgttttgttttgttgttttgttttgagacagagtcttgctctgtcacccaggctggaatgcagtgtcatgatcttggctcactgaacctccacctcccgggttcaagcaattctcctgcctcagcctcccaagtagctggaatcacaggcatgcaccacca

SEQ ID NO: 39331 - DNA, 1050 bp, Homo sapiens
ctcttttcctttgttgttttaggcccagtgtggggcggggagatgttagtgagatcctgagggggcttttaaaatgctaactcctttgaaagcagttaatttacatgttctcttgggaggtgtctagagttgtgcctatcagctaatgacttaattaattttacgtcttggaatttgagagtcaagcacatttcaaatattctgacttcaccttaattttatgatgttccttttagcccactgaagaaagccttgtggcctctctatgtggagaagttgcagggttatgtactggaagggattgaagcgcccttggaaatgcaccctcaactctcatttagagagaagggtttggagggcttccaggtgtaaaagacttactcagggtaacagagaggaggcagaactcaggcgtctggatgttcacttctttggcaaagactaagtcaatggctttcataattttatttatttatttgtttatttatttatttttgagaaggagtctcactctgtctcccaggctggagtgcagtggtgcaatctccggtcactgcaacctctgcctcccgagttcaagcgattctcctgcctcagcctcccaagtagctgggattacaggcgtctgccaccacacctggctaatttttgtatttttagtagagacagggtttaggctggtctcaaatccctggccacaagtgatccacccacctcggtctcccaaagtgctgggattacaggcgtgagccactgcgcctggccggctttgataattttggttggggttgccgaatcttttcctgctaaaggagaccccttaagcttaagtgaccttcttccatgattcccttctcctgcctttctgcctttatttgctgttctctaccttgtctttcttttgctcagccatacaacccttccctctgccacctggcttcttactgaggtcctttgcatgcagctctatggggacggagtgagaggcagtgctcctgtgtagagtcctggggctgtgctggatcttgcgcatacatttccttacttgat

SEQ ID NO: 39332 - DNA, 1464 bp, Homo sapiens
caccatgttggccaggctggtctcgaactcctgacctcaggtgatccacccacctctgcctcccaaagtgctgggattacaggcatgagccaccgcacccggccaaacttgccacttacataaattgttattttgggatgatttagttatgaatctaaagagagcctacaggaatttgaaatctttgggaaagtctgtaaagaccataaacatttattctgaaaaggtaaaacatttcatttttaaggctcattttattgtgaattacagttttttaaaaaaaaccttctcagaatgtatggcattaagacatagtctactggggtatggtcattactgtcttctgcaacatgttgttgtaactcacctaacatgtgacgcccaggtggtgatttactggaagagcgtcataacactgatgtgtagtagcaatttgccttgattagaggattgggaaactgagacttcatgatgagcattaaataggtgtcaaatgattcctaaatgatatgtagaagatattataaaatcttcatgatgtaactttagcattatcaaagaactggctcctttttcaacagaagaaaatgtcagctagttaccccacgttaatattttgtatcaagaactctttggtttgtcatgcccctgagtggctgcatattctgagtctgggtctttagaaagcaggatgccttctatagtggaagagcttccatagagaccaggaggggagacgaatagaatgaacacattccttaaacctcgagagaagcttaccaggtcacatcccttaatctaagaagtgctgctctagagattagaatgatcatatttacattggtatgatttcttgcacttcatatgtacttttacatatgctgattggttttattttattttatttttgaatacaggttaaaaaaatttcaatagtttttggggaacaggtcaggtagtatttggttacatgaataagttctttaggggtaatttctgagattttggtaaacccatcacttgaggagtgtacacagcactcagtgtgcagtcttttatacctcatcctcttccacgcttccccccaagtcccccaaagtccattgtatcattctgtttttttttttttttcttttcttttcttttttgagatggagtcttgctctatcccccaggctggagtgcagtggcgtgatctctgctcactgcagcttctgcctcccaggttccagtgatcctcctgcctcagcctcctgggtagctgggattacaggcacacaccaccatacctggctaattcttgtatttttagtagagacagagtttcaccatgttggccaggctggtctcgaactcctgaccttaggtgatccgcctgcctcagcctcccaaagtgctgggattacaggcatgagccaccacacacagcccatgaggatgcctgtgcaagtgtctttttcatat

SEQ ID NO: 39333 - DNA, 1037 bp, Homo sapiens
ctcactgcaacctcagcctaccaggttcaagagattctcctgcctcagcctccggagtagctgggattacaggcatgcgccaccatgcctggctaatttttttgtattttcagtaaaggcggggtttcaccatgttggccaggctagtctcaaactcccaacttcaggtgatccacccgcctcagcctcccagagtcctgggattacaggcatgagccactgagcccggccacaatttttttttttttttgagacagggtctcactctgtcgcccaggctggagtgcagtggcacgatgttggctcactgcagcctctgcctccctggcttaattgaacctcccacctcagcttcctgagtagctggggccgcaggcgtgtgccatcatgccccgctaatttttatatatttttcttggtagaactggggtttgaccacgatgctcaggttggtctcaaactcctgggctcaagtgatccgcctgccttaaagtgctgtgattatcagcgtgagccaccgtgcctggttgataattctttctcatgtaggccacccttattctgtgaagcttttctcttcctgttgggctgtggccatacctgtaaagaggaataacatcccagtgggtttagatcttgtcttcactgttcagcctcttccatgacagaggtgggactgggtctgctgtcaaggatcacagaggcagacaccatgctaatggttcactttattggtgtcagcagcattaagattcacagctggacaaaaatataatgaaacagagctggccaagggctggatgagcttctaggattatatccccatttgttagtttggtttttctagctggtgagggacaaggcactatcaattcacaggtgccaactgtatgttctgttgagaggtttttgtgtgggtgcaaagttaatgaaatcagggtcacagttttcaaaatctctgtggtttggttttcattgaagtgtatgacagcgagtttcgtactttatttaaagcaaagtgcatgccctctatattc

SEQ ID NO: 39334 - DNA, 1004 bp, Homo sapiens
gaatttcagcttctttttctcttgctcctgaacatttagaaatggtttttgtttgcttgctttaataaaaagtagtacacctgagggcttaaacaccaaactagcatactacttcaatactagtacttgccaaaaaggaaaaagtctgagctttgttgtttccatttgcatacaacagacagcattcctaaatgttgaggaaattgacactaactggggagaagagttaggaactcaggtaaaagtggccactttgatggcggaacctagcaggtatccagggtttggccagggcttggccagggcttgggagggaaaggagcatccctgtttttggagtcaggaccattcagggggtgaacgaggcccaggccaggtgcctttttggagcctggaatattaaaaccaggatgccaaaattgtagtgtgatctcagtctttacatttaacaattatatacatttttaacatggaagattacagtataatttatttaggctaatcagaagctaattataggctatttaaaaatgttaatttgtagcacactagaggcagtatgatctgaagtgagacaaaatgtaaaggagtgcagtgaatgtttgcttatttccaggccctcagagtgggtttctgtagctggatctatgtcatttagcggtgatgtcaacagtctacatttgagactgtaggagatgactgagtggtccaagccaagtggcccacctattctgcagaaccctgtgtggggcctgaggcagtttggcatctggaatggaattaggcagacacctgcagggcccagcctggtagtcagctgaggcagggccctgagcctatgctggtgttgtcacacactacacctgacattgtcctcctgacgcacgcagtccatattttagactgatctctcaccacagctcctgtacaccgaaatgactaacagtagagagaactgagctctgggctgggcctggtggctcatgcctgtaatcccagcactt

SEQ ID NO: 39335 - DNA, 1060 bp, Homo sapiens
tgtgctatgtgtcgcaaaacccttcacaagtgttacctaattaacggcacaatgtctgacaggtggcagacccctcagaggcctgcaggaagagggggctcctgcacacacgccaccagctcagaacagtggctctgtgtcttggggttgtgttgcctctagagagaatgtgacttcgttggattgcaacagaaacagataaataacccaggatctgccctggaacacggggaatcattaagtgagattcattaccattcttagcaaccttgggtttttgccacacaaggccagttatggttagttgagcagaaatttgcaggagagaccagcctgaatttagacccagccattgagggagacctcattgtggggatttactggaaagactcagtcctccagtaggtagttgaagtctgggcaagcagcaggtgatggggaccctcaagacaagataatggggtagaggtagccctgggaaactgagaacagcccatatttgtgtgtctgctcatagctaggtctgtgagtaggtggaagagactcagtcactgaacatggatggggtggaacccctgccctgggagaagacgagggttattgtgcagttaccagaacaaggccttgcaaagaagaaatgaaaacacacttgggtacaggctagagagtaggggaggagggcagagactcaggaagctaaaggaagcctgttatcagccctggagcactgactgggagggccagtagatcttagggtagcagttaagagtgtgtatccctggtcgggcgcggtggctcatgcctgtattcccagcgctttgggagggtgaagcgggcggatcacaaggtcaagagattgagaccatcctggccaacatggtgaaaccccgtggctactaaaaatacaaaaaatagctgggtgtggtggcatgcacctgtagtcccagctactcgagaggctgagacaggagaatcgcttgaacctaggaggcagaggttgcagtgagccaagattgtgccactgcactccagcctggcaatagagcgggactctgtcaaa

SEQ ID NO: 39336 - DNA, 1050 bp, Homo sapiens
ctcctcctcccgggttcaagccattctcctgccttagcctccctagtggctgggactacagatgccggcctccacgcccggctaattattgtatttttagaagagatagggtttcaccatgttggccaggctggtctcaaactcatgacctcagatgatccacccacctcaacctcccaaagtgctggattataggtataagccatcacgcctggctgacaatgttgaattttaagtcctggtaaaatcgacacatgttccatgaattgactggaatagagaagtcagacaagagtggaatgatttcctggcaagggtgagaatgttgactttcaggttgccctgggatctacatgcctgaccgccctgcactagtccatgtgttgactgctggagctcatctagtgggacggctggttcgtctgagacaggtcagccaggactgaaaggttaaacagcagccagcaggtcatggagtcaacgcttggactcccagaactttgcaaatagttagagtctctttgaattttcaataaaaataaagacgtgatggtatttttaggtttaaaacatggagaaaggggcctcctttaaaaggtgagaaataacctacttgaatctgatcatatggacccatttgtcataagcaggaaaccaaataaaagccaagactagatagtgtacaaagtaatataatttttttttttttttttgagactgaatttcactcttgttgcccaggtggagtgcagtgacgcaatctcggctcacagcaatgtctgcctcctgggttcaagcgattctgatgcctcagcctcccaagcagctgagattacaggcctgtgccaccacgctgggctaattttgtgtttttcgtagagatggggtttctccatgttggttaggctggtctcaaactcccgacctcaggtgatctgcctgcctcggcctcccaaagtgctgggattataggcgtgagcccccacgcctgagcaatatatacatttttaagtagagtttatctggaagtttctgttcttctggtttatc

SEQ ID NO: 39337 - DNA, 1070 bp, Homo sapiens
cactactgcactccagcctggacaacagagcgagaccctgttacagaaaacaaaccaaaaaaccagttaagtagcaaagtttgggtagggcacagaattaaaatctctttcagaagagcacacatagttttaggccccaaagtagatagcagagatgagcatacagcaggaaaaaaaaatcgtcatatatgattgactagttagaaatttgtacctgttttccttaaagctgaaagttatttagtggctcctaggagatgcagctaaggttggatataaacatggactagagacctgaagacataataatctcatgataatcccattttccaacgggcagatactctcaatcatacagggagaatgtagcatttcacaggccaatatatcaaaatggagagaacatcctagtgtataacataatgtaaagactggaacaatccaagtgtccctaatgtaatggaaatattaaagtgattaatacctctaatacccaaaagtttaaacatgtcaagttaatgtgaactttgagctttcttttctctgaaagcacaatggtaataataatagtattatactaactctattgctttgatacagtgtgctgagagttttgctgcattatcatagttaattctggtaacagctctgtaagacagatttatcgtcatgcctgttttccaggtggaggaaccgaaacatagaggggttaaataatttgtcctcaggcctcccagctggtatttggttctgcattcaagctcttactcaataatcaatactgcctacctcctcccacatacatgcagaaaagaatttcgcaggttgaaatcacagttgtgaaagtggctttttcctggagcaataactgtcattgtagtggcgctaccacatcctcaagctccagggcttcgggattgtccagtcaccatcacgtgggcaggcaggttcaattatttctgtttttaagttgcttggcacatggaacatgatttgatcactgtcttaaattcatatgtgcacactgctttgtaatagggtttgaatgcagtgacaattgttttgaaccc

SEQ ID NO: 39338 - DNA, 1024 bp, Homo sapiens
aattgcagtaaagtatacataagatgacatttaccatatcagctattttaaagtgttcagtgatactggtactgttaatgatattgatcattaagtacattcacattgctgtgcaaccagcatcataatttacttccagaagttcttcatcatttcaaaccgaaactctgttccaattaaacaataactctccctacgcccccgcctcacccacctccacacacaccctgcccctggcagccaccgttctactttctgcccctgtgaatttgacacctctcaatagctcatgtaagtggaattatacaatatttgtctttgtgtgtctggtttatttcactagcataattctttcagggttcatccacgctgcagcatgtatcagaacttcatccctttttatggataaataatattccactctatgtgtataccacattttgtttatccattcatctgttaatggacacttaggttgcttccagcttttagccattatgaacaatgctgctctgaacactggtgtacaagtatctctgagtctctgctttcagttcttttgcacatacctagcacatacctaggggtagaatttctggatcatgtagtaattctgtatttacctttttgaggaaccgccatatgttttctcacagtagctgtatcgttttaccttcctgccaacaatgtacaaaagttccaaattcttgcctttctcatcaacacttgttgttttacttttttgataataattatcctaatggtgtgaaatggtatctcgtgattttgatttgcatttccctcaagcatctttcacatgttcattggccatttgtgtatcatctttgtagaaatgtctgagtcttttgcctggtcttcagttatgttgttttgctgctgttgttagcttgcaggggttctttctattttctggatattaatcccttatcagatatgtgatttgtaaatatttcctcccactctgtgggatgccttttacctctcttgatagtgtccttgatgc

SEQ ID NO: 39339 - DNA, 1050 bp, Homo sapiens
aaacgtcaagatccatgaggaatgtcaatatttctgagagctaggatgttaatggtttaaataataaaacctgttcttcattttctgcgaccaacaatacttgcaacattttgttttacagggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggtatgcagctacctggtagaatgttcccttggttcttcctgacaagaaaagctgagaatggcccttctgagattttaaatggtgctaaatacacatactccttggcattaacctgctccaagtccgtgctttatttacgtagagaaacactgaattcaacacacgtttattaagcactttgggctgctcagcaccgtgcttggtgctgggaatacaaaatacagaacttgccttctgtgtacagacaagagagacagacatgtaaagaaatggttattcttcagtgcactaagcgttgtaaatttgaatacaaaggaaggattttattttctaaactatgccttgctacaaaatggatgttacctgaatcaaacctaaagctttttttttttgggggggggggtggcagtagacttgtcgatcatagcataagttgttctagaagcacatagccagtctaagaaataaactcaaagttcttcctgggtaccaggctttggtaataatgtttcagagaggggtgttttccctcatttgccttatctgtagccatgaaggaaggtatcatagaattgatttttcccccctggatctataatttcattgctagagaaatgactgtttctgtctaaattgcatgggtggagggagtaaagatagttggagagctgggcctcaaggtaattatgaccattcaattttcaagacactctcctccagcacctgtatagcactcattttgtagcctgttgaagttcctgtgtatgagctggttgtctgcttga

SEQ ID NO: 39340 - DNA, 1049 bp, Homo sapiens
gaaaatagtatgtttgctgtatatgtgggttttaaattcatgtttccttatccaatgccaataatttgtacaaatagaaatataagaatctagccaattttttttttccaggaatacacttttttaaaagtgcatgtttcctatccaagtagattaaatatcctctgactacacttccaggtattctagtaatcatggattgtacttgatctacatttgaagtccagccttgctactgggcttttgcgtatgctgagtctctaaacctttaagtattttgtctgtgtggtagacagattttttttttcttggagattccaagaatatctattcgagaatgagaaatagtatttgagtgcttaataaatagtgacattggccacgactttaaaagtaagcgaggatgtaagtttaagaggaggagaatattggttatagaatcaaatataggtatagattgatttgattgatttcgttgaaggccaagtcgctgagaattacaaaacaacacctgtccactctgatgaacttcttcattttgttgaaacccatggcaggactcgggccttgatggaatgcctggctcccctccgccttcacagcccgaccccgaacacttggacaagcccaagctcaaggccgggggttctgtagaaagtcttcgcagttctctcagtgggcagagctccatgagtaagtcgagtttgtcattgtagattattttctttggagttaatatctgacatatactgagcactaggttcaggcaatttcaaggtgaataagaccaagtcctgcccttcaggtgctattagagaatcagaccaataaactctctggactcagagtcgtgtttgtttattagtagacatgcagcagcagcagcccaaaacaggaggtgatgaattttgatcggagacaatagggaaagcatctcagaggaaggatctagagagcagggggaataagccagggagacaagcacatgaagatgaccagcaaaataaagggagtggggaagggaggggaattttatatgtgactgataa

SEQ ID NO: 39341 - DNA, 1022 bp, Homo sapiens
ctcatcccaaacaacaaaaacaaaagaagatttgccactggcctgtcctgagttttggggtttgtgcctcgtcttgccagccttactcttgctgagctaatacaagagccctcagcacgtgttgctgagggctaagaatgctcctaaatgctaataaaatttatttcatttgacactttaatattagctcccaaatttggaaagttggcaacataactgtcttcaagcacaagtcttacagatctccgaaaaacatatgacctaatctcaccttgtgaatggggcgtttattctttctttgcttctccttgatggtgccatcactcagaagggtctgggagccccactgccaaaacaacactctacctttctcctttcctcatagccccaaggccagagtcagcttctgttcgcataactaacttaaaaggtgtcaacatattccaactgtgtgctctctccaaacttatcttcgtgcgatgaataccttattggaagaaaagttgtgatcacactagttcattttgatctcatctattttaagataaattgttctcttccaaaagctcagggcagtaactgaggataaagtcgagatctgttgactctgaaacctctgcttttcactcaccttgttgatttcatgccgtgttctctcctctaggtaacagcgaccagtcaggatcccaggagaagctgctcgttgacagccagggcctgagtggatgctcaccccgagactcaggatgctacgaaagcagtgagaacctggaaaacggtaatgtcagcatgagtcgctgggaacctgctttgacaagtactgatttcaaagcacagttttctgcaaaaggacgattctattcctgtcatgaactcagcaatcatcgtttcctttctcacctctacaccattctagtccaagttagcctccctatctattctcctggctgctgggtgaggttaataaattctgtgtcaaatacctgcagctgtaaaacctaaattgtgtgtctcctatgccc

SEQ ID NO: 39342 - DNA, 1034 bp, Homo sapiens
gatatgtgatttagactttatgggagctaaacttgttggactcattcccagctgatatgctttcctttccatttttaatttataccactttaaatggagatatagaactttagttctcagaattgccaatctttacgtatattatatatgagcctggcaatttagagtcaaaaaatgaaaagtatgtcatgttattgaatttgaaattctctaagtttaagtgcatttaaaggaaaatgtgaaaatagaggtccatatctgttacaaaatagtttctttgaacctaaaaagccaaattttatttttcttctgcatttcacacatggtataaatataatactttaggctccaaacagtaatctaggaaatgaatgcataaaatatgacgttatcaatagaaattgttgacatagaaaaaatgatattcttgttcatagctacaagtttatattgtggggttggttggggacacagtggcactatattagagaaaggatagaaaatggaattcagctatggtaatccgttctgtaaacaaatagcatgaatggtgaaaagcaatctgccttgtaaactattttttaatgtagactagtcttagtatgaattgtctaagaacacatataaatgtggattatctaaatactgtctttcttcaaattccctgtcatcaatccaggcttaagacagtggttagttttgttttggagaaactggaaagaaagtggtcaaggtttttgagtcccaaaataaatagtatcttttgcttcctcagagggagactgaaggagcaaaaacagtagcttgacctgcagctgtactggtgggtgtccatgatggacaatgaaaacgcatcttatttgatggattgtagctgctagaattattaggagttgctgctttttttttgttttttggaaagaagacttgaccacaaattaattttgtcataaatatatttatttgtattacatagaaactcggctttaagcaaacagtgatatacataaatccctttttatcagaaataggga

SEQ ID NO: 39343 - DNA, 1607 bp, Homo sapiens
attttgttttggcagataacaggattgaggccaccttgttttctttgctcatgcatttcccaactcaaaaggctgttcttgtttgcttgtagagcagagatccaaggcctgagagaccctgaaatgtttgtagttatattcttcattcgtgctgcgagataaagagttttcccagaaactaaagggagggaacaggaaatatttgttaagatccataacctctggcttttgtctcctcttttcacctgggcaaaggatatcagtgataatattttgggtctcataagatgatgaattgttcaaatgtatttggagaatactttattcaagcatctttgtctttctttcctattccttgtggctgaagagaggcatgtgctttttatgcaagggtcttgaaatgtatgcagttaccatggtggcactctgtctctgacccaaactctgtcatagagtgtatgtttagccatgttttcaggggtgcttcctagcgtggtcaggagaaactgctagagctgaatttggttgctgggcaggcttctatcttttttttttttttttaatagatgcagggagtataagtgcatgctttttacatgggtatattgcataatggtgaggtttgggttcctagtgtacccattacccaaatagtgaacactgtacacaaaaggtaatttttcaatcatcaagccttttctccctccctgcttttgagagtccccattgtctgttatttccctctgtatgtccatgtgtacccattgtttagctctcacttctaagtgagaatgtgtggtatttgagtttttgtttctgagttacttcacttaggacaatggtcttcagctccattcctgttgctgcaaaagacatctgtatatagaccacattttctttatccagtcatctgttgatggacagttagtttcattccctgactttgctgttgtgaatagtgctatgataaacatacaagggcaggtgtttatttgatagaatgattcttttccttcccgtagatacccagtagtgggattgctgggtcgaatggtagttcgatttttagttctttgagaaatctccatactgttttccacagaggttgtactaatttacattcccactaacagtgtgtacatgttcccatttctccccatccttgccaacatctgttgttttttgactttttaatactagtcattctgactggtgtgagatggtatctcattgtggttttaatttgcatttctctgataattagtgatactgagcattttctcctttgtatttttgtgggctgcttgtatatcttcttttgaaaaatgtctgttcatgtcctttgcccactttttaatagggttatttgcttttttcttgttgagttatttgagttccttgtatagattctggatattagtcctttgtgggatgcatttttgcaaatattttctccctttctgcaagttgtttgtttactctgttgattctttctttgctgtacagaagctctttagtttaattaagtcccttttgtttatttttgtttttgttgcattgcttagccatatattctttgcccaggccaatgttcagaagagtttttc

SEQ ID NO: 39344 - DNA, 1034 bp, Homo sapiens
cttattgaatagggtatcctttccccattgtatatttttgccaactttgtttacgatcagttggttgtaggtatgtggctttatttctgggttctctactgtcttctattgctctatatgtctgtttttgtaccagtaccatgctgttttggttactatcatcttgtagtataatttgaattcagataatgctatccctccagctttgttctttttgcttaggattgctttgactattcagggtctttttggttccatataaattttaggattgttttttctaattctgtgaaaaatgacatcggtaattttcaaacacacatgctctacaaacaatttgtgtagttaatacaatcgtcacagggtcctgaggtgacatacatcctcagcttacgaagatgatgggattaagagattaaagtaaagacaggcataggaaatcatgagagtattgattggggaagtgataaatgtccatgaaatcttcacaatttatgttcagagattgtagtaaagacaggcataagaaattataaaagtattaatttggggaactaatacatgtccatgaaatcttcacaatttatgttcttctgccttcagcctgtccctccgttcggggtccctgacttcctgcagcatcttgcctaattgctctggctaggacttctactattatgttgaatagtgtagtgggagttggcattcttgtcttgttccagttcataggggaagttcttttaaattttctccattcagtatgatgttggctgtgggtttgtcctatatggcttttattattttgaggtatgttcctttgatgcctagtttgttgagggcttttatcatgaaaagatgttagattttatggaatgctttttctgcagctgttgagatgatcgtatggttttggttaggcttatatcttcatacttcatttgttttatggcataatgcgtttctgtgccaaaatatagcctctcttccccagattttttccctgtcaccttgtcagaatgatagttgactttgtt

SEQ ID NO: 39345 - DNA, 1989 bp, Homo sapiens
cacaaaattgtttaaggaattttaaaaaaaattatagaaaataggatctatgttgaaagaattataaagtgcattacaatttgagacttaaatttccatatcttttaattttacctaaatttatatgaattttaaaatggtgattgttggccaggtctggtggctcacgcctgtaatcccaacaatttgggtggctgagatgggtgggatcacctgaggtcaggagttcgagaccagcctggccaacatggtgaaaccccatctctaccaaaaatacaaaaattagccggctgtggtggcagatgcctttaatcccagctactcaggaggctgaggcaggagaatcgcttgaacccgggaagtagaggttgcagtgagccaagattgtgccactgtactccaacctgggtgacaagagcaaaactctgtctcaaaaaaaaaaaaaagtgattgtttttcatgtttggaattatatgacatgtatgtattaagagtctaatttatttttcaagtataaatgaggtaaatgcaaatcccagaagactgttttctatgcacacacaaaactacatttcttttagtacacagggaaaggtaaatattcaaattctttccgttgggtgacattttgttcacatatttttgtagggcatccatacttttgttttacactgaacaaaaggacagtgtgagggacagatgtcagagtgaaggtgtgaatttgcaccaaatgccaggtttagggctcagaatagcatttttttgtacgtggggcgccatgaacgcaaagacttccagcgggatgggcgttgagcagggattgtctaagaggaatcaaattgccaaatgtctgctgccagattattcttccctaaaattgatctccctgagaacttgtcttgcggcccaattcccaccagcttccctctgtcctccccgactttataaagaagcttatctgactctatgctggtgtcaaacacctccaggtaccaaaggaagaattcaaaatcctggcatggagaaagtgaatgactagtgactacagcaaacccttttgcaggtcacgtggctcctattcttggctttcaaccaaagtgaaggaggatctaatctagttatcccctcaggtagatcaccaacagatcactatgggatttagaaagatgttaaagaagcgtgtgacacggctataactaaacactctccattcctgtctgttaaagcgaacaaggttattttatatatatatatatatataaaaatataatgaataaataggaataaaattgaaatcagtgaaatttacttatagacaaggccctattcactgtatttatgatcaaattccacttttgattttaattatttgtgaaatgtgtaaaatctttatattgttttgatcaactgtgaaacaaaggtaatcttaataataactcaaattcaggatatatagtttaaacttttaaagcattatggtcacaagaatattttttaaatgaattttactttacctacatagttttgtcatgtagaaatagaacagagagatcaatacagtaatttcaagcgtgaagtataatctgttagaacaaaaatctgtggggggaatggaatgaaaatacaagctgaaaaatttgttactcagactttcttttcagcattttttagaggatttgtgaatttcagagaaaaatgagtgcatgaggtcaggtgcggtggctcacgcctgtaatcctagcacttcgggaggccaaggtgggcggatcacctgaggtcaggagttcgaaaccagcctgaccaacatggtgaaaccccgtctttactaaaaatacaaaattagccaggcatggtggcaggcgcctgtaatcccagctactggggaggctggggcaggagaatcacttgaacctgggatgcgggggttgcagtcagccgagattacgccactacactccagcctggagtctgacagagtgagacttcatc

SEQ ID NO: 39346 - DNA, 1025 bp, Homo sapiens
taaggctcgcagggtctgtccagggcacctgtaagtaagccatcatcactgacattgtgttgatttaagaattgaaactccaggcctggggcaacttgccgagggttataaagccattacatggtagggagtggggtcttgagccagagctctggtcatctctgatgacgaccaaggcccacccccctccatcccatccggaatccagattgcattggttgagcgtatcacccctctcttccctctgttttccatcctcatggtggtcacagcagctcagcccattgccctcttctgcaaggccgagcccaccctcctgggctgcagccatagctgtggctgtccttacccgctgtggatgccgctgtgggacttctctctttttctctccacaaagaaccaaagaatgttctttgtggcacatttttttttttttttcaaccagaaagtactacctcaagcctcctggaaaattccttattatttcagaaacatcactgtacttcttccgttgactcagcacttctgtctccttttcaagtgtggatttcagacccttgtcattctatggagcaaatgaaatacagtcttgaggagaagcattacgtaacattaaatttcatcacagctctttttaagaatactttgagaatttcagagtgttttcaagggaatctctttgacgttagttcctcctcttggttcctcaccagataaaggaaatctccaactctggggaagacatgtgagggaagtctgggagaatgtcgtgcattgacacccatgaacttgctgacatctggaggaatgagcagggctgagagaattccggtcctggtcctgcctctgttgctcccaccacgccagggaaataataattcccactcagcccgctccacgggatgtcgtaaggacaaaatgagatgtgatatatgtggaaacacttggaaaattcagacgttaaagtgactctagaaatgtaggtgtcatcatggctggaaatattagtatagctttgagagaaa

SEQ ID NO: 39347 - DNA, 1042 bp, Homo sapiens
agagcaagactccatcttaaaaaaaaaaaaaaaagcatacatgcatttaggcattaagatgctatagaccattatcttttatagtctgtgtcacacttcatgttatgtatcaagaggagaaaagcatctcagcccaagatttgattcctgattttactactcaatagctagatgatttggggacaactgcataatatctttgagactacttagatatacaaatgaggactatgataatgcctacctcaaaggttgttgtgagggttaaatgaggcaatgcaaatgaaaattgctttataaagactaaagtgctatattaatttgcctttattgaaattacatactattaaaatgaccagcgaactaccatttgtgcagagtggttgaagaatatggcatgctgattatttgaacattctggataatagaagtatagtacatgtctttctggttaaaaagaattacaataaagtattcttaacatcaaagcttactaacacaactaatcgtttggatgagatttcaagatatttctatatattttgtgggcagcacttgaacacttgaatagtataagatgttgaggaaaaaaatgcttaggaaaagaatacactctaactgataccccaaaccatgtatgttaaaaaagtagttccttaaaatatacatttactcattattgatcccttgcttataaaaaatgtatgaattgaggaaccatcattggatatacagaagtagaattatagaatttgtttttatgggtattttgaggggtagaaaacaagaattattttattttgccctgttcagacaaaaatatcatgttagctttttaaatagtatatagtgcaattggaactcaatcttaagacatttttgcttaatgaaaatgctaccatgacagatcttttttttttttcctaacaggatgtatatgattctcttttcattaaatttgcctcaaagagtttcaactctcaatttttagactaactttactttagataaaagggtttttatactattatttcttttttta

SEQ ID NO: 39348 - DNA, 1034 bp, Homo sapiens
agctgagattacaggcgcctcccatgatgtccggctatgttttgtatttttagtagagacggggtttcaccatcttggctgggctggtctcctgacctcaggtgatccaccggccacttccaaagtgctaggattataggcatgagccaccgcgcccaaccttctccgataattcttaatagtttagaaagcactgtcagctgggtgttgtggcatgcacctgtagccccagctactcaggaggctgaggtgggaggagcacttgaacccaggagttcgaggctgcagtcagctatgatcacaccactgcaccctagcctgggcagcagaatgaaaccctgtctctaaaaatgaacgaacaaaaaccaaacaaacaagcaaacaaacaaaccccacaaaacaacagcaacaacaaaataatagaaagcactattttatatgctgctttatatactttagttcttacaaataaatccaaaggtcaatacattgtaaaaacaaagaactgtgtcaaaaaacattcctaatatgttattgatttattcagcaagcttttatggaacacctgctatgtgctaggcattgtggtatgcattgggaatacaaagccttaatgattttaagcacctgttctgaagggaagacagtaagaaaagtgagtgttcagagtacacagtgataaggtatgtgatggaaaatgtatccttcgaatgttgtgggagcgtagaggggtggtagttggaataaacgtgaaggtcttcccagaggaggtgatatttgcattgagttttgaaagacaacgaggagttgttcataggaaggagggaaggaaggcagttcagacaagaagaacaatatgtgagaaggccagtgtgatgattttgagaacaccattcaacatgtctagagcctaggggatgaagagatgggtgctaggagggtaggagtggtggcaaatgatgaggccagataggtaagcagtggcaagtttgtaaagagcacaccagtgtactccattaaggggttgggagttt

SEQ ID NO: 39349 - DNA, 1133 bp, Homo sapiens
ctattcctccaccctcataggcgaatgttttccttcctttacttttcttaaaaatactttttaccagcataagatcctaaacatgacccctttcctaggagagatggcttttgcctgcttgtgaggggggtgggctttctactcctgccctggcagccgccaccctttacctgggatggggataggtgggtgggaggctttcttgccccacccctagtagcatatggcttttgcctcatgctgaagcagggtcaggtgtggaatgtgggcaggtttctgtccctccccagcaggagatggcttttgcttgatataaattaaagaagcgttgggatatgggtggatttaataccacctgttatggactgaatgttctagtgtctccccaaattcatatgttgaagcttcagcccccaatgtcatggtatttggaggcagagcctttgggaggtgattaggtttagatgaaatcatggagatggagccctcatgatgggattagtgcctttattagaagaagaacagacaccagaactccctctcttcagcatgtgaggacacagtgagaaggtggccatctgcaagccaggaagagagccctcaccaggaattgaatctgctgggcctttgatcttggacttccccacctccagaatgatgagaagtaaatatctgttgtgtaagccacccggtctatggtattttgttatagcagcccatgctgactaagacactgtccctcactggcaactaatcatcaccttgtactcgagcgaggcctgaagtgcagatgggcttgtcaggaaactcctgtcaccaactcaaacctcagcagggcctgtgccctgagcacagctcactcaggcctttggcactgtcctcagagtttctcaggggagttcagagtcctgtggaaaaagagtaggcagtagggacagacttctcgtgtttggggatctcagaagtcttaatctgtcacactaaaccacacggaatttcttaaaaccttagttttttgttttttttttttttctcacctgcttttcttgctgccacctctttctcccatacactgtcaaagctgaaacagtgcttgtgtcctttcttcctcagaggtgcgtgtcaccctttga

SEQ ID NO: 39350 - DNA, 1076 bp, Homo sapiens
ctcaactctcttttctctctacagtccctaaaactataatacaaggtgtcaccagagaggaagagcaattttttttaaaaagcctataaaattattactaccagcaccatacattgccagtgaacctgactctggtgttaaaactacttctcaaatagtatcccttcatatctatccttatgaattacagattatcagctaaaatacaaaataattccccaaagaaagttgggagtattgtatactaattaatctgcatcaagtcataaaagaaattgacatatgtaaggtgatgacattgagtttttccaagctggcattttcaagttttatgaaaggtacaccagtttatcatatacattgatttaatgtgattattatatcagctatctattgccacaataataataatgctgtgtaacaaacaaccaccaaagcccactggcatacaaaggatacatcgattattgctcatgatctatgggtcagctgggcagttcttctggtcttacctgggggacttacttatgtgttatgactccccagctggttggtctgggagtagttggctcacctgtacatggtccttcatcttccaacagacaaacctaggcttgttcttttagtgatgcctgggtattatgagagtggaaaggcagaggctatatgaggcctaagctcaaaaccagcacaccgtttcttctctgcacaccacagcaagccacaagtctagcccagattcaaaaaatgaggaaagagactctgcttctcaatgtcttatagcaaaaagtatggatgtcggaatgggtgagaattggcgccattttaaaaattggtctcattctggttactctggctgcttagcacattccctaaaacttagtgacatgaagctatcttattttgttcacagctttgtggtttaggcatttgggaagggctcagcttggcagttctcatttgggagtcacttggctcacccacatggatagcagttggtgtctacacatggcttttgcagcatttgagtagtcagactttcagcatgacaggtggcttccctcagaatgagtgtc

SEQ ID NO: 39351 - DNA, 1070 bp, Homo sapiens
aagctggtctcaaactcctgaccttgtgatccacccaccttggcctcccaaagtgctgggattacagaagtgagccaccgtgtccagcccagaagaaattttaattggcaagaaacttgaccattacgaaatagaatgtgtccttcaccatttatgctgaatttcagttgtgccatctttatatttctgaggcaatgtaaagcaaacctgctgtagaccaggatactgaaagggccattctatatcaggcaatttttgaagcctttattacaatctgtgaactaatttaatatgttataaatgaatactcaattaatagtcatacattttgagtccacaccccccctttgccatttatatgagataaaatataactgtttcattttcatgtctgtaaaaatcttttcggcctttccaggaacccatctggatgcatttacacgatgcactttccatcatttcaaaatttattaaattttatagcaccttccatgttatgggcgctcaataaattgccatcaccaagttaaatgatggggtaataaggacaggactctggttgttcacactaatgacacagtttgcattgatgatgaagtccccagaacagagggcaggaggagccacctgtatgaggagtgtgtggggaggagctgtcctttacagcccgctgtaaggatcatgctgtacaaataaacctaactgtgtgggtggtcctttctctgcccccttctgcttttagagacttagaagagctgccaaagtacctataggaggtgtttgatttaaaaggaaacacaccagttatgccttcttgtaggggcatgtgagccagtagagtttgcagctgcatggagagatgaagcaaaactctgaacattcaactgcattaaaaaaaaaatcatgccaagagggcctttgagcaagaaattcttgcagatttatgacacccgatgcctgaactctgtgtgtgacatcagggttatggctctgtaagctcttaaccctgcagctgacccagtcagcttctggctgtactaggggttgatgcggttcactgtggttgtttg

SEQ ID NO: 39352 - DNA, 1018 bp, Homo sapiens
tacacctatggttttcaaatcacactgtgaggcagagtcacttgggaagattttgcaactaccaatgcttggatcccaccaaaaatggattatcagcttctctgatatcagcttctcctccaacatttggaggatcccaaatgtggtatttttgaagaagtttcccagatgatgctatggtacagttaaggctgagaactagaactagaagctttcagccaatttccctggtatgtggctagtattgcttccattgtacagagaaggtaaaaaggggtaacttgccaaaggtcatttggccagtaaatggtaaggtggaggtttcaacttagttctaattccaaatttagagcttttttcatagtaccacactacctccctacttccctattttgggcaaaactcactttgctaggtattgaagggaatgttgtctgagtcggactccagtcaggaaacagaaactcgttggctattgcaaacagagggtatctaatacaagaggtttggtacaatgatattgagagggcaagaggaacaaaaggaatagttgcagaaggaacccaaaggaaggtatgttcccagagatcaggcaacctctaggatcctgggatggaaacttggactttgcatctggggctgcactgctagagatgctgcttctggtgctcatgctggaaccactggagccaggtttctcccagaccctcagccccatgtgaatccaaaccctgtttcaaaaggaatgtccatgggaaaatggggtttgatttacacgttcagttttcaggctacatttgctagaatgcacctcttttgtatgtgcaagaatgccaataggtgctctgaaagctgaattctttagctattcgtcatatcctagtggttagcatcagaaggaagccagtacagttgggtctcggtatctgcaggggattggttccaggcccacctgcagataccagaatccaagcaaacttaagtcccacagtggactctgagggacctgtggatacga

SEQ ID NO: 39353 - DNA, 1053 bp, Homo sapiens
tttgagggagagtcagatggtcatatgcacacatctgttatatgtaactgtcttacaccaatcattattttatttacaagatctagctatttgagagagattgcaaaaactggttttagctgcttgtgtttcaagtcagaagtgcgtgaaggaggtcaggccatgatcactacagtgtggaggccgccggctgactttgttgaggaaaatgaggtccagcctgtagaagggagctagggagtacagagcccgaaggaaggtggtggggagttttctcgtctgcacatccctccctctgtggttatcccagcaaagtgggaatattatttaaaccatgtactgctttattttgctggagcatttgatatgtttaaaaagtgtcagaccatttcctcggcaggcatatgcttgcacttagccttaattcctacccttggagaaggcaaatacagcgtggccctcgtctgtatattttaagaggtttcttataacaggcctagtctgtggcaatcctagtgagtagtacttagtgggtttacaaaccactctgtcgcggtgatgacatactctgtgtggttctgggagctaaataaaacaccggaaatagatattaaataaaataaagaacacgcctatgtaattattgccagaaatgaaattttgcaaccctaaatttgaatgtggtctaggcacctgaagattcctgtagctaaacaaacatcatttcccagattaaaatttcaggaaagcaacgtctatcaagtgtcttatttgggtaaaatattttgaaaatgttttgactgatcacagggggaatgggaagcagatggtaagtgagacaggtgcccctaaagtccacatccccttctgaatggctccatttcctattacattagacagcaaaggccactggcccaggccaatgtcacttatgttctgctaggggacttttggccaactcagaagatattggtccttactgtggaattgttttgtgattttaaaatatagatctctttaaaccctgaaaaaatatatttttaaaaggactaa

SEQ ID NO: 39354 - DNA, 1121 bp, Homo sapiens
aaaaggttcagggatggatcctctccaccctttcgttcacctggtaaaatactatttcaaggactaatttataccatcgtctcctttaggtagctttctctgacccactttgtcactgaggcagaattgtttcctcatctctgtatgacttagcactgtttatgtacttccatgtcacttttttaaaagcaagaatgaaaataacttttatttattgtgcaatgtgctagacattaaactaaatactctacacattttgtctctttaatcctcaaaacagccctgggaggtaaggctgttgtcctatgttacaagcgaggaaagtggggcttaaagagaataagttacttgccccaggtcttacagttagtgaatttcaaagatgcagtaggaacccagttctcgcctgttttcaatatattcttttcttattaagataaaatttgcagtaatgtgcacatatcttacatgtacagtttgatgagttttgataatacacacatctgcttaaccgttgatccagtcaagatgtagaacatgtccactgatcagaaagttacctcattgccccttccctgtctgctccagccactcaggattagggctgcctgttctttatttaaatcaattaatttatttcttattttattttattgtttctctcagttgaattttattttattttttcctgcttttattttagatacaggggtacatgtgtaggattgttacatgggtatattggacccaagtagtgagcatagtacccagtgagtagttttgcaacccacgctcctgtcatttcctgcccctgtagtaggttgcagtgtgtattgttctcgtgtttatatccatatgtgcttaatggttacctcccacttacaggtgagaacatgtggcatttggttttctgttcctgtgctaattcacttggcattatggtctccagctttgctgcaaagaacatggtttcattgttgttgttttttttaatggctgcatagtattccatggtgtatgtgtaccacatagtctcgatccaatcctccactgatgggcacctaggttgattccatgtctttgctattgtgaatagcatggtgattaacataagagtgcat

SEQ ID NO: 39355 - DNA, 1876 bp, Homo sapiens
gtgtgccgtggtggtttgctgcacctatcaacccatcacgtaggtattaagccccacatgcatcagctatttttcctgatgctctccctccctcccccaacaggcccctgtgtgtgtattcccctccctgtgtccacgtgttctcactgttcagctccacttataagtgagaacatgtggtgtttggttttctgtgcctgtgttactttgctgaggataatggcttccagcttcatccatgtccctgcaaaggacatgatcttgttcctttttatggctgcatagtattccatggtgtatatgtaccacattttctttatccagtctgtcgtctgtcattgatgggcatttgggttgattccatgtctttgctattgtgaatagtgctgccatgaatatacatatacagatatctttataatagaatgacttatattcctttgggtgtatacccagtaaagggatcgctgggtcaaatggtatttctggttctaggtctctgaggaattgtcacaccgtcttccacaatggttgaactaatttacattcccaccaacagtgtaaaagcgttcctgtttctctgcaacctcaccggcatctgttctttcttgagtttttaataatcatgattctgactgatatgagatggtatcttattgtggttttgatttgtatttctctaatgatcagtgatgttgaactttttttcatatgtttggttggccgcatgtatgtcttcttttgagaagtgtctgttcatgtcctttgtccactttttaatggggttgtttgtttttcttaaagccatttgttcttcaacaggggactcctgtactccaagtaacactttctgctcccagagccacttccctaccccctgcatacccaaaatactggggtgatattttagatttccagtcctccagatacataaggacaaaaatgtgcaaccttttgcatcatataacaaagttctttctttcttccctaacagatatcacacatgatgaagtctgatagctagtgtcgggtagttgacagaaaaacaaacaaaaaggtttttttaaataaaaaagcaagcctgtgggtcttcagaataaaatcactttgattcagctataaaaatatgacttagaaacattgcagtgagcattgccaaatacagctcctctgctaccgtctgtcctggagctgcacacctgtccctgtaccgctgagcccacgctgtaggatcttggaattggggcgtggacttgttcattgtgagcacacagaatgtggacatgattctgaatgtgtggctgtgttggaacttgcccaatctatttcaagatgataaattacatacttccggaaaggctattctgttttccccacagaagatcttaactactctttgtcttctccttttatagaactgaaaatttaattttgtctaaatgtgcttttcttcatatttacttacattctcagcattacagtatactgtctacagaaacacagtcctagtttttcattttaggaaaaggtgattcattatggaacaaatcttaattttaatattaccatgctttggtagaagtcagtgttggaaaactctagaaagtattgccttggaataaaaatatcaggtgggggaaggagcaaggatagctgggggagggctgagcttctatttcctgatgaattgaagttcacatatggatggggtgagatcatggtgtaatacacaaaacttgggtcaagagggtagaaattaaaggtaggaaaacattttagaagcctctgttgctgaaatatttttgcattgtagtggatattaattattccgatgttaattattcgctaggggtctgtgttagtccattttcacact

SEQ ID NO: 39356 - DNA, 1022 bp, Homo sapiens
tgtatgagtggggggggtcatgtatgagtgcggggatcgtgtatgagtgggggggatcgtgtatgagtgtggggatcgtgtacgagtgcggggggtcatgtacgagtgcggagattgtgtatgagtgggggggtcgtgtatgagtgtgggggatcgtgtatgagtggggtgtcgtgtatgagtgtgggtatcgtgtatgagtacagggattgtgtatgagtgcggggatcgtgtatgagtgcggggggtcatgtatgagtgtgggggatcgtgtatgagtaggggggtcgtgtatgagtgcgggggtcgtgtattagtgtgggtgtcgtgtatgagtgtggagatcgtgtatgagtgcggggggtcgtgtataagtgcgggggtcgtgtatgagtgcgggggtcgtgtgtgagtgcggaggtcgtgtatgagtgcaggggatcatgtatgagtcgggggttcaggtatgagtggtggggtcaggtatgagtgtggggatcaggtatgagtgtggagattgtgtatgaatgtggggattatgtatgagtatggggattatgtgtgagtgtggggatcatgtatgagtgtctccaggactgacagaatatcccctggtggtttaagtcaagtggggcccagagaaactctggacagatagagggtgatgctcttagttcctctttttacccataaaacaagaggttcaacagaacaatacattgtttgcaggaacaatatgttctgaaattataagctctgaaatttattcttgaaaagatctttagggccccagaaaggtttaggctcccatatggtttaggggataagctctatgcccggaggtgccctgtgccagcccactcccaggcaacctgtgagctaggcctggccctttacaatttccttgcacccccttggagcaggtgctgaccagaacagcttgatcaccttcccctgtcactgggagttctgtgatcatccacgctccatcagcattctcttttgacaagaagcttgttttg

SEQ ID NO: 39357 - DNA, 1024 bp, Homo sapiens
gtaattgttcctgagatgataaaatagcaaactgtttcaagatataggaataataaaattacaaagatgccataatggatcttagattttcttaaacggtctgctggacccatatggtagttgcaaggtagaatgagttttattctctttctttttttaaaaaaaagtattttctctttttctttgtaatatctctaagaaagaataaagttataaaatattaatccatacaaatagctagaactgcttcaaatttataaaacctaaaaaactaaaagtgggtccaatggatgctaatagtatattgagggttaagatatattactgatatctacacttacatacaaaagcatttttatatataaaatattatgtttgcatataaagtattagtattcaaaattccgttgtaaaatgggttcattagaaggcggcttacaattattatgctgatccagcaatctccaaatgaatgagaagtagtaatatgaactgagataatatttgtatagtgctttgcagtgtctggcagtgaaccattgctcaataaagttgagtccttcctacctacacccccagaagctaatttccctttagtattgattgtttaatgcctacttagtctaagggatcaggaagacatttaaagaattgaagatgatctctgtaatctaacagcttataatctggttgtgtcatgaggtttgatggaatcaaagacagagagcacatgcttctgtgactgatagattcttaagtctaagtgacatgcattcatccaagtgtttactatgcatcaaatttgtcttgggctctgtgctgggtgctgaggctgtcaggccacagaatgcacagtctatgccctccgggagtttagtccagtcaaaggacaggctggcaaacagattcatacagtaagtatgctaagtgggctgctggatgctatgatgaggatgcacactcaacacaaggagaatgcaggaagctcaacttgaccttttttccaggtgcaagtcctgaagtt

SEQ ID NO: 39358 - DNA, 1109 bp, Homo sapiens
acgatcttggctcaccacaacctccgcctcctgggttcaaacgattcttctgcctcagcctcccaagtagctgggataacaggcatgcaccaccacacccagctaagtttgtatttttagtagagatggggtttctccatgttggtcaggctggtctcaaactcccgacctcaggtgatccgcccgcctgaacctcccaaagtgctggcattacaggcaggatgcttttttgacacccccacttctactcagctttctttccttccttcagaaccctgttcagggtgtgaaggacaagttaagccatctccgtctctctcatactgcagcccacctgttctttaggtcataaccacagactcacatctttaaagaaagttagcaaatcaactcagaacccttacatgggtctttctctcctgctgtctcatcaatcagagcaagttcaactttctactaaatttatctatatttatatatgtatgtttataaaaggtatgagttaggtgtgcaaaaatgtaacattatgggttaaataaccttatttaacccataccttacatgatttaaggtattactaaacatgcatcctaaggtaaataaacccagcacaggaactgcccatttccactgatgatagaaaggtgtctgtttctaatcgtttagtctcagcttctcaggggtctccccttctcatttctttcttcctttctccttccggctgatccaagttcccagggggcctttggggaacagacccttgtccaggcgctgtcctctgtccaggattgtctcagttcactaggcctggtcttgggattcagcccattgcttccacgtctgaattggctggccctgacccctccagggtctctggtgaagcccagaggccctgcatccccccttgccctgaccccaggcacctctagcccttttttcagagattcagaaaagttccagaaatgttcttatcatgaattgccccaggatcgtgtgtctgagaaggtcactcagtcatcaccactctgaagctcaagctctaatgagaagctggacctctctctgagaggtagagcctcagagctcacaccctgggaggccagctcctt

SEQ ID NO: 39359 - DNA, 1095 bp, Homo sapiens
tataaatggaattagtgcccttataggaagagatacaacttgctcttggacttcccatcctccagaactatgggaaataagttttcattccaatgcagtattttgatgaaaatgtgtcataagtggtgctgaatgttttccattgtactgcattaggagatacataaggtttggtttctctttttttgcaatattgttaaatacagtcttaactttaagtatagtcttaactttcatactctcatacgagagttcagaaatcttacccgaaactcgattctacctttgataaatgaaatatggcagtggtccccaacctttttggcaccagggaccagttgtgtggaagataatttttccatagattggggggtgggtggggaggatggtttcaggatgaaactgttccacctcagatggtcaggcattagattctcacagggaacgtgcaaccattaatatatcccttgcatgtgtagttcgtagtcttttctatgatatgtagtccaatttaatttgcaatggtttgaatgtttgtgtcctcccaaaattcgtataccagaacctaatccctaatgtgatagtataagagttcacgctcctatgagaatataatactgccgctgatctaataggaggcagaggtcaggcagtaatgctcactcgcccgcccaccactcacctctttctgtgcagcccagttcgttacaggccacggaccagtaccagtccatagcccaggggtgggggatccctgaaatatggtatatagaactaaatatataaaatctaatatatacattgatatttatacatgtaatataaaagattatgtctttcaggcttctataacaaaataccatagactgggtagcttataaactacagaaagttatttctcacagttctggagggtggaaggtcaaaaggtcaagatgctggccgattcagtgtctggtgactgcctgattcctggttcacagatggtgccttctcacatggtggagggggcatggcaattctctggggtctttttttataagagcactaatcccgtttatgcctcaggacctaatcacttccccaaagtcccac

SEQ ID NO: 39360 - DNA, 1042 bp, Homo sapiens
gagaccccgtcaaccggttcttatccaactattttttccgtcgctttggagactggagaggggaacaaaatcacatgatccgcacccccagcatgaggcaggaggagcgctacctggtaagtcctgtcgcatgcaaaaggcggtctccccactgcctgaggagtgggccctccaccagggaaggttcactcttcccttcccaggccttctccttggcgcctccatggagcgtggcgcagagagggtgcttccgcaggaaggaggtcttggcgagagaaactggttccgggtgacccagatcctaatgaacatttcctcaaattattttctgattttgctttgctcagttgtctttagtgctaggttttgggacccagagcgttaacagtctttcctaaggagtcctgactagcactgtagtgcttaagaagaacaaaggtgttgggggggtgtctgttagagggcggcagagccccttctcatccctcagcccattcagttcccatgaccactctgggagggggaggtgttttcagatgaggaccctgagattctaaaggttgtgggatttgccacagtcacctctcaggtaagggcgcaactgcgaccgactgtttcgggtttcctgccttcacagtctgggttctttccaccacagcgcgatagaaccctgtcattgcaccagtaattgtttgctttctctggacttgttttgggaccctcagctccataagggatgttagtctcgagcccagtaattatttccgcagcacagaggttggtaacaaaaacggagggcggagttgcgcgtctttctttcagcactagaacgaaaggtacatttcccatccctgtgttgagaaacatgtactgaggagctgacagcctggtgcccaggaggctgaaatcctggtctctgtgtctgagagagcccttggggttcacccggacccatcctgggctgttgtcgggcacaagcaggaaagtaggaagtgttgaggatcagtcagaggtgttgttcccaaagctggaagatcgccca

SEQ ID NO: 39361 - DNA, 1061 bp, Homo sapiens
taaaggaatcctaggatttgcaggaaccccaaagaggatgaggactctctcattttacaggtgtgggaacgggcctgggattcggggtggggtaaagtccctgccaggaggagaatccagacctcctgattccacttcggtgctgtttgcccactcagaccttatgttcctgaagggtaaagggagaagaggactgggccgagtcccacgcttttgaagcagaatcatttgatgtaacatcgtctctccatctttacaaagacatcgctgttacagcaatttgttttcaaatattcaagcatcttatagctataccttattttctgggaacaactagcttttctcaaactttctatttctttccaaactcttcttcctttgcatttcctggaaaatcatttttaaataaattagtgctcgcatagatgcaagttcaacttctagcagccatactgtgaaaaggcagttgtcttaggctcatttctttttgtccagagctggaagctccccagtgtggaggtggctgcctcctttttgggggtgggagtcctctgaacccaggcacacttggacacatcccagcacctgagactctaatccagctcatgtccagcctcctttatttccagggtagggaaatacctggcacacagaccatatttaatgaatggtggaaagctttttctaatgaagagcaactgttgtcatctccagatgagggagagcatcttattcctgctgaagccactcccttttccagtcttggagcttccatgaaagtggatttcttatgctgtcattttcaccctgctggttacacatcaagttctcaaaaatgtcaaattgggctgctgccctaaccattattgccacttcactaggccatcctccatttgaagaataggaagaaaagggagaaaatcttcccagagagaacactgcctctgtgacactgtttattcggcttggctgtaaaatgtggaaagtaatgcatgtttaaaagaaaagatgtgtaatttacagcttcttaattcataaagaattcagtgaatcatgttggc

SEQ ID NO: 39362 - DNA, 1048 bp, Homo sapiens
aaggaaaaagacaaagattatcatattaacacccctcggccccgcatgcacctgtaacctacgtgtcctttttgataacccaccacttccagagtggcttcattgtcaaccacctgtgtcaccagagtaaattcaagtgtgtcctttcttgaggtttctggactggatgttgtcttgtgtcctttcccatgggtgtggtttccctggcagtcagttcctcagtgaccacatttaacaaattgtaataaatgcagactagaaccataattcacagttttgcaatacaaaggaaagatgaaaaacaactggaggcttaaagtcctgtgagatacccattttaccttgctttaattacggcagcagatgtaaatttgatttgccccaagcctaggtggtctttggctagggctcattcacctctgacacagagaccccacatctccctgacttctgttgaagaagtactgggaaggtctttgaatggaccctgagcacacttgacattggaaaagggagaaatctttgactaagaccctgtactttgagcagttttcagtccatccattcagctacaaatgtggaagcaaatatgccaaggtccttgaaaagaatgttgatgcttgattgcacgatgtttccctttaaagttttggccttgagaacttcaaagtgatgacactgttcttcctgccatgcccgctcttagctctgtgtggtcagtaagcagcgactcttatttttcttttatttttggaaactaagttggagtgagggcataaaccccctcacttgaattgttttggcttaagatgtatctgagattttaactttgttatttccagctgcttccctcattaaatttaggtcattaatttcataaatcagcatatgccttttacttttatgtgcaaagcccaggtgttaaagctcgagtaactctttgtttggaatggtgggtttcgtatctggcccatcccaaatgggcttattgtgcctcacaatatttctttccttccctaagtcctttggtccttcatctttatcaagg

SEQ ID NO: 39363 - DNA, 1033 bp, Homo sapiens
catatgaaaaagaaacgaaataattaaagtaaagttggcattatgtctcacttatccagaaattctttatctgccatcctgccatcagacacatagccataaactcagaagtagtgtaaaggaccagaaagccactacggtagatgccacagatattaaatatccaacatcgcaagctgtgcttacaacagggagagcaacgtgcttctctgcctgatgctgatgcttcctggatggctgtattgagaattccgaaggacacttcccatctcaactagagtgtgtcatcagtgattcatgctagacatgagcatggaatgggagaatgatggtatctggccatctgccactttccaatccattaagcctcactaaaaagtcttgtttgactcctctggttctggctcagatttttttacaaggttggaaaaaagccttttacaaggaagagtgtatgaggcaataaaagttaacttagaccacatccattccatttaacccattaaacttgtactctgattaccgtggtccacttatgggtcaaggatttgggtactgcctcaatggtgaatgacagtcatttttctctctcccacttctaacacagccagcgtaagaaaccgtccttttccataatatccatatttttagcgtgtgaagactggctccaaaaatcaattttaagtccacattgaaaaagagctttttatatcatcgtgttacattgcgtcatgtgcagagtaagatgagctataagaagtccaaagttccacagtggtatattttgcataataccgtttgtgtttccattaaattgtattgttgttttgactgacatagcacattacatgtttctgtatttttcttcctctctgttttctctgtgagttagccagagtcactatttaaaaaaaaaaaaaaaaaaactatcagaatcaccaggaatggtgtttttgaatataagattaagtaaaaaggaatgaaatgctgaaggtataataaagatggcataatcttaacaggtgagtggcag

SEQ ID NO: 39364 - DNA, 1090 bp, Homo sapiens
acacacacacacacacacacacacacacacacacatctgtcagtgtcaaactcttcttagaaaggtatttcaggtctagtgtcttgcattttaatgggttttcatacacaatgagatgctcttaatcaccctcaccacatggctggacagacatatgcacccccctattcacttctcatatgttcctccctggaaactgcacctccgcctctcatggtaaactcaagtgcttgagtactctcaattgtgttttttgcagattctgtttatttccgttgaatttgttattgtaattgtgtaatttacttaattggcatataaactgaagaagtatgaggggattattgtttttaagaaaaagcataaattatatttctctcattcccaatttgaactaaaaaaattgttactagctaaacacccacacctaaacacctacacccacacatgtatatcagatacagtagcttctaccgactcataatttcatcaaccatatttgggagttgtgtccagtcttaatctgccttgccagtatagtctctggaaaaacatcctacagctgtttggtttatttgtagattgagttatcttttctccttagaaatacctgagaatgaggcatgtcttatttagaatctctaatatgatctaccttgataaaagttggttttgagcccttctgcttacccccaccaagccatttcaagctctggtaacgccctcagaaacaccatgtccaacctcatataagagaaatggaaaacctggacgtcacaactgttgcctttgaaagtgagagggtgtctgtatataaacatcctgctactttttaagctaatatagtgttagaagtgattttacagctcctctaaaatttgcaaactcttatgagactattgtaggtacttagttgttggatgcatggatacacagagaagccctaaattcatgcaacaaacatttattaattgccaactgtatacctactaattggctggcaactggtggcgccaccacgaagcacagtgggtaccactgttctcccaaggcctgtgaccaaacttaagactcggagccaccaggaagt

SEQ ID NO: 39365 - DNA, 1068 bp, Homo sapiens
aagttcatgtcttagggcatactaaaatcattactctttccctttattgaagagtttgataactgagtagattagagaacagagagaagaaaagctaaaatctaagatactgatttaagggatctagtgacccttaactcattgtagattaactaaccatctgaagagctgaattaagatgcaaaaacaccactggccatttttctttggtgtttgtcctgttattgaaaaacaaaaacaaaaaaaaaaataggagtttgctgacttctggtaactcctctctagcaatactaaaaatatgtataccagtctcattacagaagaaaaaacactaatagcaatgactctttggagagctagtaaaaatcgtaatgtctgttagtcatatgggttgtcacttatttcagattgaaatgatattcattgattctttcaaatcaatactacctgtcccaataactcaccatttagacaggttaataacctttctcaataacagcgtaactgtcttttcttctgttcctttcttgtagaaatatatgctgacatcaagtaaatttgtctcctaccaaaaatattggagaaacttagcctttagaactttttttaaacagtcattttatgttaatatttgcattttatggagacagaatagagtatctcagaagcttaggatagtaagtacttgagatgaaataaaaattagagttttagcaagatggataaccaagagaatatgcttggtatttcttccagccggtgcgcagctgctgatattaggacaagtactgtggagtgggcattcagaaaacactgctcaatcctgaccatgagtttgaattagggagcaccaaggccccagcaggtttactcggtagaagcaacctcactggttgaacatatacataattattacatatgatcacatatgtcatcttatacataattattttttattgattaatccttattatgtttgtttattacttatcaccttttaaaaatgagaaactgaggccaggtatagtgacttgcacctgtaatcctaccattttgggaagccaaggc

SEQ ID NO: 39366 - DNA, 1079 bp, Homo sapiens
cacgagacaatctgttgttattggaggggtaacaggaaaagcttctcctccaccctctgaagcttacttgaaaatgaacttacaataggcagattaacaggaaaaaaaggaataaaatttattaatatgcatgaaactgagcatggtagctcactcctgtagtcccaaatactcaggaggttgaggggaggatcgcttgagcccaggagtttgaggctgcagtgagccaccactgcactctagcctgggcaacagagcaagaccctacctcttaaaaataaaatgctacacaggagaaaatcacaggagagtggttacctcataacccagggaggtccagcttttttctatacctttcttcatagggaaaggggaaatggaggttaaatgtggcaattttgaagagtagtaaatgatatttaaggggaatgaatgggcccaatgctcagacaatggaaggtaaataattctctttgggaactgaatgggacccaagaacaggcaatagtttgggacaacgttcatctgagctctgagtgtggtgtttaatcttcagtcccttcctctgtgacatgagttttgatcttctctgattaatgaaattttaggggaggtgactgaaggcaattttgttcctctttggcaggtccaatttctaggtagataagggaacttcagagaacagcttcatccaggatgtactggtctccaatggccttcaatttgaaatatcgccataccaagttgccatatttggcggtcaccctccctggatccttaactattcaagaaaggatcttttaaagctcttgccttgtagccaaacatgaaaaagtcccccttccctcttgtcttaaaagtctgtcctctctgtggagtgttctagcaaacatagggctgggcctcctcatgttctgactagcactatcaaatagccaaagcacttttgtcaggctggtaaggtgacatgcaattaaaatttggttggaaaggctacctgggatcttatcaaatatcaatcttattaaagacctctcattactgtataaaagttggataagatatgtcaatgtaggggg

SEQ ID NO: 39367 - DNA, 1027 bp, Homo sapiens
gtaaaatggaaatggattttgtatcaaattaaactttatgtcaatattttaaaacttacaaaacaagattattagaaagtggttagacagctcttccatgcctccttctgagggtaaagcccttttctggtgtatcaagaaataaaagagggaaaatggatagattctgctgttcaaaagaatgtagaactcagagttaacaattgaatttggtccaatcgcatggttcacatctgatgaaaggaaatttgatagcttgtgcttcgtcaactcatgttgacattaacacctagagttggtaagtgtttccaaatattgtcaggaacccttcttctcttctaatacttggatatgcagttgcttccttaggtgctaccagagttgtacaggtaatgtgggtcctcgccgggatcccttctaagctactgcaaatgatggctcatgtgcgaccccggttctcttccagagcacaggaagcttggaaacatgactgtgacggtgaagaagactgtcccctctcctgaggctgtgcagatcctctaccagcggatgagatacgagtacgagttttaccactacgtcaaagagcagttccacctgctgaagcgcaagtttggacttaagtctcacgtcagcaagccccccctgaggccacacttctttatcccaactccactggaaaccgaggagccaatcgacgatgaagaacaggatgatgaaaagtggctggaagatatttataagaggtgatgtgactgtgttgcctctatggctttatctcccttttccagaaagttctttgtttggggaagtaaaatccttaagggactaaattaatgcttgggtgcattaaaaagaacaaaacattcccacatgttggggtcattgggagatgcccggttttgcgggttttatttgtttaattttattctgtgttttctcttggctctttgggtctttcccgggtacactagatggctccatcccaaggcatcttgtcataaaacagctttcccccaccccatat

SEQ ID NO: 39368 - DNA, 1047 bp, Homo sapiens
aaagggcatggctgtgtcttttgcacccaatatgaaacatcttctcccaacactgctttaatggaagttctaggaaccaatttagctcaggcatttgactcctacagcagaagttctgagcctgaccacagatggtgtgtaatctatcaaacacacccctggccaagttgggtcctataggacctggtactatgtactattgtaacttctagttccctaagaggtacctgttttcagtaaaaaggggtcctgagttctgtgcaggtggaagagctacccgagaactacctgagttctgtgcaggtagagtcccatttcttatgggacctgtgtgctcctgagaactcttacttgagacatcaaaaagaagcagcaagagcttctgggacagagactgcttggccagctttgtaagtaagtggctgcctccaatgtgatgtgagtacatgttgggcagtctcactgtcctaaggtatgtcttctttccacctcccactgcccctcccctgccacctatcaatgatgccttggttcagtcattagaaatctgttgctttgagttctgaaatattttcaccttaaaaaaaatgctgaaaatacacattctcctgggaagacgataaacagctagctaagaagccgaggttcagtggtggcagcaggaaggacactgccacaaattttgtctatttcatatttgtcccctagagccagccctagcaaatgtgtgagttgggagtagttaatagtaaataagactctgactttacacaagctacacattttatacttttcataaaccacaaagtctctctagaattttttctgccttcactaaaattggactgtagccaagatataaagcaagtcatttggaacctgccgagtgagcactgaagctactttatcatgagatgtgtgttaagaaggctgcagcccacaggagtccagggaaggcggggaccacagaggcacagagtccagcacttggccgctcatgggccttctttctgcctcagaggacgggggcagagaagtgatgaaggg

SEQ ID NO: 39369 - DNA, 1066 bp, Homo sapiens
tctaacttgcactcttcctccctccgcctctttccttcccccagtggcgtggcggagagggaggccccccgagtcccccagtccggtgggggtggggagcatcgggccgggcctgggctccggggcgtccgtgcggggggggagggggagcttcattggaatcgagcgcctaggagagccccgggtgggggagggcgcaaggggctcgggagggcccctccctgcgtcggcgcccctgacccgcccccaggcatgtgtgaggtgggggcgggggaggaaaaatctccttttggggagccgaggtctagttaaagatgactcaggggcgggggttttggggacagacacggggcagttatgtgggggtcgggcgggagggagaacatcgttcctttgcggatcttggttttctgcagccgtctttgaagtggggggcaagccctactatgaatatgtggccccttaaatttcactggatgtttctggttttcggtcccatcaacctcaaaccctacgattgtggttgagtcagggaggctgcaagggtctcttggcggtgctgaacaggtgacaggtggatctttctgttgctgatgctgtgagatgttcaggcacagtcgtacaccaaagtgtcagagaccgtgtgagtttgtatttatgtgtttggccatgtttcattccatatatagtatatttgagatgttaggtttccattcttcaagtcagcttaattgttgtggataaattcttcaaatgtttctgataagagggttttccaggagagcggagggaatttgcagcctcacaggggtttctccgtagttcacgaaatttaggcccccagtgcaggctgttgagtacccttattcattggaaagttcttgaacgctaagatcgtattcagagcaactgtacggcaatataattttgcatccattttgtctgttttaggtaagtttgtaaagtgtctaattttggggtcagattgattcacattttagaaaaggaatttcgtttccgctttagcatactctaaaggttatgatgatcattatgcaattccaga

SEQ ID NO: 39370 - DNA, 1507 bp, Homo sapiens
ataggttgatgagctggatctcagcattttaacaaggaaataacagtgtataaaattccaattcatgtaaatacttttaaaatatttagtacagtacctggcacatagtaactatagagtaaatgtttgctttttgtcatcattttgcttgttaattcaaagaatcttttatacaaattattaaggaaagtttttgcaaagataaaataactcaaattgtgaatgggatttttgagggaagagtggaataaccatgcaagttgcaatacttattttcatttttagactggaagatcacgaaacagcacctcaagtgcagaacatgtcttcctttcagtctttacttcacattattttcagtggttggcctgtagttaagagctcaagaaatactgtgtgttaaatgttgaatagttcttaatgatcatttttctgtaaattacagctctttttgtagtaaactcctgagtctgaaaggtgactgcactggaatctctacttttaattttaagcactgaataagatatcattatgcaaagtctcttaaatgctattttgtgaatctagccaaaagttcaaaaaatattctagaaattgagaggaagaaatcaattatttgtagctagattagtcttcattaacctatttctatgatgttattggcatcaaagtgaaaaagtaatatagcagtttttaaaagagtagaagaaaatttatgaataattatttgctcttaactgttaaagaacaagtttaccttatctttttaagataatttcaatgaaagtgtagatttgtcctggttttatggattaaatagcttggtcgtttacttacatttctgtgatacaggaaatactggtgttttcactgaaaagtgaaaacgtcccaccagcatcccacctcccatcttcacagtattttaagcattcttcagatgcctaaatcttagtaccagtcaactctttcctgttctgctgtaagttatcctctacctaaagaataataattttagctttccccaaacttaagacttctgtcaggttatgaggctttcagtcatttacccaaaatatttcttggatttttaaaaagttctccacaaagcatgtatcgtgtgctttatattcaaatatgaacaaataggatgaaaagtatttcattttagtatttgatgtgccacagtactactttagaaatgagataggaatacatacaactgaatattttatactcttgtaattttttttctttgctttttttgaacaataactgtctactacaggacagaaataattcctacaaggtgtcagtttgagtggcttcagaaaggaagtctgatttacctacaaacaagtacaagagacaagagcagtataagaatttgtagtattttaattgccttgttaaaagaaaatggaattcttgtttcacttaagaagaaaaacaaaaaccggcctagtaccagtgctcctagtacaagtcacagaagccagataataaagta

SEQ ID NO: 39371 - DNA, 1049 bp, Homo sapiens
agaaaagagccagacttgggaggaagaggcaggcatataagtatctatttgagagttgattaggacccaaattaaggcactgataatggggtaattaagaagaataggtaatgtgtttgagaaggaaataattgaatgtgacataaagcagtgaagatcacacatgccctgggtgcatagttgtgatggtgatgttcaccattacagaacagaccagggttgcaacaggtgaggaagacatttgagttctgtttgttgattttaaggttctatggagggagaaagaggaagacttcacttgatatggaggagatagagaatgcttgtcttgattagataacatttgagcaggtacatgaatgaaaatagaggcagtagcaaatgcagtggcctttaagtgggatgtccttgccatcttctaagagcaggaaggccaatataattggagctggggggggcggggttggggggtggaagtagggtagatggtatccaactgtgtatgctgttcatgtagggtgtttagactgtgataaggactttagattttactcaggatggggtaggaagtcaccaaagggctttaagataaaatctaatttgtattttccccctcacttcttagaacattgtttatttattgacatttgtatgtgtgtggttctgtaacattattatgtatatgtataaattcatgtgaccttcacaattaggttataaaaactgtttcatcatcataaagagactcccttgttttaccccttaagtttcacctttccttcctggcaaccacttacctgcttctgttctctatcactataattgtcacttcaagaatgttacataaatcgtacgtgatgttacctttggagatgggctcttttttttttcacccagtataatccccttgaggtccttccaaattgttgcatttatcaatatttattcctttttaatgctaaagagtttaccattgtatggatataccacaatttgactttggaatttccaactttgggttgtaaaaataaaactgctgtgaacaggtt

SEQ ID NO: 39372 - DNA, 1008 bp, Homo sapiens
cttaattaaataggagtatctaggttctgatagaggtgaactataagcctaatttatgtctgttttaactccttagtggaacttttggcttatcttgatgtattttctggtactcgaagttgccaaacagatgatcttctgtgcttgatttattgggggcacttgctgagtactttatatgtgcctatattatgtatatgcagtgttctatgtgtaagcacatagcacatgtctccggggatcttataacttagatgaagagacacagaagtagactgtaagagaataattaaatgttgattcataaagcattgacctacagctacattagtagttgtaggaaaagatccatgtgggctgaagcaggataaaaagaattcaagtagaaggtgaaattggaattggttttgaagaggtagttaagattttgataagcctcaaggtgaagacataacattctaagcaagggcagtagtgtagtaagcaaagaaaggaaagtgtgggttgaacatgttcagacaggcctgcccagattcctaagggtgtggggactgctgggaaatagaagcaggtgaatttaatagagtagttttaatctgcaagaccctgaagggatccagggatacaatttagagggctgcatgcatttagataaaaaaaaaaaagtgacatctttatatttttatgaactttgaactgaaatttagcatttacttttaataagattttaagcggcagactacagtaatattagcagtacgtatatcttttattactaatagaaaaagcacagatattttcagattacagctgttgatatctctataatttatgcatattactacttcagaattatggtttttattagactcccactagattttattgtattattactaaagaagcatatgtatgaatatatcacatacaaggtttttaaaaacacttgataactgtttcggtataattggttttcttagtaatgtatattttatgcatttaaaacca

SEQ ID NO: 39373 - DNA, 1050 bp, Homo sapiens
agagacggggttttaccatgttggccaagctggtctcaaactcctgacctcactcaggtgatccacccgcctcagcctcccaaagtgctgagccaccatgcccggcctcaataattactcttgaaatttgtttaattgctctgttcatatttactgtatataaatgtaggcatttactttacgattcataagtaataatgctaattttttgtgttaaacttttattcagattctactgacatattatttgaactttatgtttttcttctattaaataagggtgttggactagataatctataaggctcctttcaacatcaaatctatgattcggaatcttttaagtttcatcaagtagaataaaaagcttaaactacaatttaaaggagattctccttagattatgctgtgagtgtaaataagatgccagaggaacaagtgagagaatgaatgttataactttacacctacatccttttggctaacattaataagaggcatagaaataagaattctaagaaactagaatgcagagtgttgaccggaaaagaagttttcagaaagaaaattattagtaacgtcaagctagtacaataaagaaggaaccttggacatgaggttagacagctacagatacatttctggttttaactctgctgcttattggagtttcgatgagtaaatattacttaatatgtttttttaaaagagtaaaagcaagttcattataatttgtaaataacgttgtatacctggaaaagccaagagaatcaactgaaatattactataagtaatgagatttcagtatgatgactagttaaaaaatttaaaaaagtggtttatctgaagtggtttttttatttgatggtctttaaactgaaagcctattcatatgagttactgaatggaaatcctcaaacttaaataccctttccccttctttctgaggaatgcagtaattcagtcttatcatctaagttttagtatattttgaataagacacttccatgttaactttttaaaacttttaaaatgaagttgtggcagag

SEQ ID NO: 39374 - DNA, 1051 bp, Homo sapiens
gtcttccacttctctctacctagtctccattgctatccacagtacaggctattaccatttcctggctgaactacagcagtggttttctgactggtcttctcatatattcttttaccctttttccatacaatagccgttttttatacacacatgatttcttgatcatgtcacctttcctacctctgagctttaaatccttcatcggcttcccattgttcttaagataaaatccccaaatgttaatggcctataaggcacttcatgatttgggccctacctattttgcttgatctttgctctctacagtttttcccaatgtaccatgctcccatgctctgctttggaatgatgtgaaagagaaaaacagtggctgtgatagccacaagcgagatggcaggcagcagaccgagtgcagaagacgcagacagaagataaaataatgagcaagttaaaatagttatctaaattataaacgtgtatttatgtgcctttaacctagcaatttctgtgatctgcagggcaaggacattgactctaatacttgtactatctccagcatggtatctcctgcatactaggcactcattcaatgtgtggttggtagataaatagatgatgatagtcccagttttaaatactcttatctagttgcctcataaatgcccagattttcataagacctatatatccagttgcattctttgtttctgtttgtttttttaatctggagacgtggtctcgtgttaaacagttagcttttgtatactcttatagtcctagaaacatccactatgataaactgcactgaatatgaagcataacttgcagtctgagtgagccattaaccagtgcctagtactcttcactgtaatagttactaagaaatcaaaaattgtttacataatctttaagaaaggaaagaatatggcacattttataaaccgttccaatatgtctacttatgttttgtagtgctgtatatactctgctactatttagaaggaattaaccctcctagatcattttagctggtggaagtttagatgccaga

SEQ ID NO: 39375 - DNA, 1047 bp, Homo sapiens
cggggctcagtcaagcatatttactcttgaagtgatttttaaagtttgaaattatatgaaatttttatcaaatctgtaatttataataatgactacattttgttcacacccttatcaccattatcaccttttaattggtctacctgcctttacctaacccagttttggtctctccaatctatcctcttctgccagagtgcagagctgttcacacacttaaaacctgttgattgttccctgtgcccttctgaatgaagctcatatagcttgactagggcatacaaggtctgtgatctggaatcctggctgtttctacaccctgatctttgtccagtccttcctgttcataccctatgttctggtcatcctgagctgcatggaattctcccaccagcaatgccttttcttatagtataatggttaagagcatatcttttggtgataaaccaaactgagttcaagttttgacagttgctagcagtaacttaattaacttctctgaccctcattttctgactttcatttcctccactgtacagtgggaataaaaaaaactacacagagagttaaatttgacaatgtagataaaacaaccagtagggtaactgattcatagtgagtattcaataaatgttagcagccaatactaaaaggaataacaacagcagaaagcccataaggtatatttggtaaatgaatcagtggtttacatttgttaatataaaatgtgaaaaaaaaatgagagaataaaaacatgtaataaagatggagtcagaagttaaaagaaagtgtgggaaaggagcggagatagtggggaaaaatagtctcccccctagaacccaagtaacttctccctaacttttcaagtaaaagagaattttgtggtaaaataaagctatgctgttcagtaggttattaaaaaactaacagaaagatactgtaagttctttgataaatttctgtagacttcgtattgaaagaactgtccagagcatttccctacatatagtacaggtatagagattttgaaataccgtaactgggagt

SEQ ID NO: 39376 - DNA, 1033 bp, Homo sapiens
tttttttctgagatagagtctcactgtcatccaggctggagtgcagtagcacgatctcagctcactgcaaccttcacctcccggattcaagcagttctcctgcctcagcctcccgggtagctgtgattacaggcacatgccaccacgcccagctagtttttgtatttttaagagagatgtggtttcaccttgttggccaggctggtctcgaactcctgacctcaggcaatccgcctgcctcagactcccaaagtgctggggttacagacgtgagccaccgcacctagctcagtgacacaatcttgatctagtgtttcattcacttaattcaagacaaaggaggcctttgctggaaaatgcatcttttctgcttttaccctacatagttcacagacactctctgcagttactaaacggggtggcctgagtaatcctgatctttaagcaaggatcttttctaaactctgagtggtatgggtaagaaaaagaaaagaaatatctcggtcttctgcagtgaaattgatttttctaatgctcctggaaatactgttttagagtagaaaaataagtggagccaggcactagaatcataggaaaatactttttccaaattgagaagggaacatacgtacatacataaatttggtaaccaaaatgcattttttcttttttcttttaatctaccatttgaaatctaaaatactgtgataaaaactgtcaaaagtgaaaatttgtttatgaaaggtatattgtttaatacatcctctactatagagtgatcagaagcaaaagaagtaaattaatgaaacatcaagaccccactcatctcagcactaagtctgtcagcaccaccatccttcctaaaggaaataaattaaacttgattccttaaggtactacaggaatcagagacaaaagtggaaagaacaaattaaggttggagagaaattttcagtttaaagtttatagatatgaagaaaattcttattttacccattaagaacaaatacagaagtgaaattttcttactggt

SEQ ID NO: 39377 - DNA, 1059 bp, Homo sapiens
gcagctgagaagttgtaatagacaactccagattgacattgactgcttaaccaaagaaattgatctttttcaagcccgaggtaaagttcagtgtatttgtagctgaaattcatcgtatttaattcaccagcagtttttctgtggctaaaaacagacttatcaatcataatcttactgtctcagaacatgtggctttggagccagacagacttttaagaatatatttaaaaagtcacccccatctcaatggcactatcttaactgataaaatatagaagatagtaaaaataaggtttatacattctttagacaatgatagtttcttatacttgagctattaatgacaagcaatgttttcttatagtaaataatgtttacaatttaattcagttccatagagaactaaaaggaaatgttatcacttaaacctaattctgaagttggataaataataaaaagatataaaatggaaaagacaggaaggggaaggaatctaaccaaaagagaagtctttaatcacacttgggactgtgttctagaatctgttcaactggaagatgattatttttatttttattctttttaaatgttgattaagctatttatctttaaacattcatagaaaaataccataatttaactctaaaaagttggtgctgttctagaaactacaatccttgaacttactctttttgtgtaaaattttaaccattctattacatagtgcaaggtttttatatttacttgaggtaaagctgtttagttacttaagtccatgtttgatcgtttaaaattacattttaaattgtgaaattttaagttattttaacttgccacatagaacagggatctacttctacttctattaatgtcttaccagcattaatttgacttctttcacagtttaccacttacccgtgtttatgagtactacattatacctaagataatatatttgaaatatgttttgaaatcttacatataattcgaggttagaggggcaaaataaatgaaaagcatttcttatagcgtgtttatttttagaaagaaatacttgtt

SEQ ID NO: 39378 - DNA, 1079 bp, Homo sapiens
atttaaacacagtcttgaataatcattgagtcaagaaggaaatcaaaagggaatcttaacagtatcttcagacaaaaaggaaaacatagcatactagaacctatgggatgaagcaaaggcagtactaagagagaagtttctagagataaacaatactacattaaaaaaaaaaaaagaaagatctcaattatacctcagggaaccagtagaagaacaacaagctaagcctaatgttagcataatgaagaaaataataagaattagagcaaaaatagagaatttagaaacaacagaaaaagaaatagtaaaactaagaggttttttaaaaaatcaacaagattgacaaacccttagctagataaattgagaaaaaaaggagacaaaatcagaaatgaaaatgaagacaacagatgcctcagaaataaaaggatcataagggaatattaggaacaattttatgccaacagactagataacctagaaaaaaattgatacattcctatccaaaaaatatccaaaaaaaattgatatcacctattaaagctgaatcaagaagaattagaaagactgagtagaccaataacaaataaggagattgaatcagtaatcaaaaatctcccaacaaatatccagcatggatttagaaatttaaaaaaaaattcccaacaaagaaaagtccagaactggatggcttcatgagtgaattctgtcaaacactcaaacaagaattaataccaacccatcttaagctcttccaaaaatgagaagggggaacacttccaaactcattctgaggccagcctcaccctggtaccaaaaccagacaaagacactacaactaaagaaaactacagaccaatattactgatgaacatagacgcaaaaagtcctcagtaaaatactggcaaaccaaactgagcacattaaaaggaccatacgccatgaccaagtggggtttatctctgggacttaaggatggttcaacatacacaaatcagttaatgtgatacagcacacacattgaagtaaaatgaaaggaataaccatgtagtcatcttaatagatgctaaaaagcattt

SEQ ID NO: 39379 - DNA, 1028 bp, Homo sapiens
tcagccttttttcagtagaatggtagggaaaagtttgaatattttaaagagcaagtgttctgagaatgacaagaaactatgtcggtacacctcttcctagtcaagacttgaatatgaacactctaaatacaaaggcgaagggcacggtaagtgtcactttgaccaacaaggtgaaaccccgtctctactaaaaatagaaaaattagctgggcgtggttgcaggtgcctgtagtcccagctactcgggaggcggagacaggagaattgcttgaacccgggaggcagaggttgcagtgagccgagatcgtgccactgcattccagcctgggtgagggagctcaaaacaaaacaaacaaacaaaaacaaaaaaaccaagtgttaacgttttaggataatgacattaccccacgtgggtacaaaaatgatgagcatgtctcagttctgcagggcattccaagaagccacgacattgcctgccataagaaccacctatatctgaaattatatgtggaccacagttgcatctggttaaacaataggaatgtgatggacaggcaccaagggaccaaataaaagtgaaatagttctaaaaagttctggaaatacggacattattttcctatttttcaagttttaaagattcataattgacacctatgtgtcaatgagatgtttacgtctatataatctgcgaaaaatacattttgactgcaggcttaaaatacactgcattgtcggctggctcttagtgatgattttactatttcagttctcccttcttgggccttcatttcactttcagaaagtccagatctaaactcggaaattcacatattacgctgggtgcagtggctcacgcctgtaatcccagctactgggaatccaaagccagaggattgcctgagaccaagagttgggtgttggatgataagcctggttaacatagcaagagcctgtctcaacaacaaaaagtttcacagattaaatgagtgctgaacaactagaaagagaatctcattacctggact

SEQ ID NO: 39380 - DNA, 1035 bp, Homo sapiens
aaggattgattaaaaaactcaatgttcttactgcttgggcatcttctctcacaggattttgtggatggatgaatgtatgtgcttattatgttaaaacgtgggattggctgtatcttctggctggctttatagttgtgccatgttggttcctcatggccaacctgtataaaagaataggaaagatgggccaggcgtggtcgttcacgcctgtaatcccagcactttgggcagccaaggtgggtgaatcacttgaggtcaggagttagcaagaccagcccggccaatatggtgaaaccctatctctgctaaaaatacaaaaaaacagctgagcatggtggtgcaagcctgtaaacccagctacttgggaggctgaggcaggagaatcccttgaacccaggaggcaaaggttgcagtgagccaaggtggcaccactgcactccagcctgggcgacagagcaagactccatctcaaaaaaaaaaaaaaaaaaaaaagaataggaaagatgttgctagtgtggtatttcatacaaagtctaaagatcaacacattttaccctttcaaatgagtgtaagcagtcataaagatttgtcagattgtctttgtttttaataaatctgaaacagcattgaggtcagggatgaagaaagccaaagaaatgggttttcaactgtcttgttccatgtaaatgtcatcaaaataatcacactcactcacagatttggtggtaatctttgttcaaaggtgtcactacttttttttttatagtgaagaatgaaaatcttgaaaatttggaggaaaaagaatattttggaattgtcagtgtaaggattttagttcatgagtggcctatgacatctggttccagtttgcaactaattgtcattcaagaagaggtagtagagattgatggaaaacaagtaagatagtatgtttattaattgggaattaaatgatatttagatttgtgctagatattatgcatgtgttcagttattttatttgtttccgacttgataaggaaggtgcctaatgtt

SEQ ID NO: 39381 - DNA, 1050 bp, Homo sapiens
gaccttaagttctgctctcgctcttaaagtatagaaacatgttttgtacacagtgaacttcccatgtattctaaaattttctaatatgtttgtctttctcttccttctcttgtgctctaggtactggaaacagttgactctgctccatttcgtttataatggactagcctaacgaatctcttgtcaattagcaattattttcacttgatttgtagttagaaaacaatataaataattttacaggctattaacatttttgtgcttgtattgttagaacataatttttaaagttgtaagtaacttcattgaggtacattctaaaataaaatcaccatttaaaatatacaattagttttgacaaatgtagtcacccatgtaactaccagcacaatcaaaatatagaatatttttatcatcccaaagctaaaacattaaaaaatttaaagtttattcttagagattgatgcaacttgcatatctaatcgaaattcctttttcaggtaatgtgtcagtggatggaaaagtttagaaaagatctgtgtaggttctggagcaacgttttcccagtattctttcagtttttgaacatcatggtggttggaattacaggagcagctgtggtaataaccatcttaaaggtgtttttcccagtttctgaatacaagtaagtatttcttatttttgaaatgttagtatttttaatgattaaaaagtgagacatatttgctatgttttagaatagaaaatataaaaattagaaagggtaagacaaatgggagggaaaataacacctactgtttttctagctcatcttccaatgttagcaaaattgaaacacatttattgaatagctattgtgatcaagacattcttggagagattcagatgtaagtaagacaaactctgctaagaacttaaaatctagtagcagaggaaggaaacaaatacatgtaatggaaaatgcaactgtatgatcagaggtgaacaaaacccgaggacttcatgatgtattttcaaccccagagtatcagtttaaaatgttaatttcag

SEQ ID NO: 39382 - DNA, 1065 bp, Homo sapiens
atgtttcccaggctgatcttgaactcctgggctcaagtgatctgcccgccttggcctcccaaagtgctgggattataggtgtgagcccctacacctggcctactatcatgttttaataaaacctttgagagctacttaagacaactttgtcttctccccattgttcttttaaaaaaaatcttatggctgttcttgcagttactcccctgtgaactttagaatctgtttggttctataaacaactaacccccgttgatgttcttattagaataacactgaatttacaatgcagggtcctagattcaatccaaagacgtactctctggtcagggattttaagtaacaaaaagagcaacactatctaaagacctaaggttgtgttgtggtggtgagtattatttagagagaggcttaggcttaggctttttgctcagcctgggtgtatctaggaacctaactctgccttggagatctatacttaccctattcttccctaaaataggaaataatgaacttcctcgatgcctttctattctctcagccagtttggttaaagtgactttgggctcagtttgtacaaccactatgaatttttaaatagaatgtagcaaaagcacctaaccttaggtgtatattataaccttgaagtagccttttctcactatcaaactacaggcagaggaaacatttaattttgatagtaattaatcactttctatttcagaggaattcttcagttggataaagtggacgtcatacctgtgacagctatcaacttatatccagatggtccagagaaaagagctgaaaaccttgaagataaaacatgtatttaaaacgccatctcatatcatggactccgaagtagcctgttgcctccaaatttgccacttgaatataattttctttaaatcgttaagaatcagtttatacactagagaaattgctaaactctaagactgcctgaaaattgacctttacagtgccaagttaaagtttaccttattctcggccgggtgcagtggctcatgcctgtaatcccaggactttgggaggccaatgcgg

SEQ ID NO: 39383 - DNA, 1092 bp, Homo sapiens
ggctggtctcaaactcctgacctcaggtaatccacccacctagacctcccaaaatgctggaattacaggcgtgagccaccatgcccggccatggttggtttttttgagaccactttatatttaggccaaataggtatgtgtgtgatgggggtggagaggatgacaagtagaatgaaggagtgatgtttcactttgccagactttaaattaattacattgcatggagctctattatgcaatactctctccatactgctgaaaaaaataatctgcaacttacaatttgatccttgagttaccaaccagtaacacttgttctttacaccctttctcattccctaagtcattagaaagcaccagttctaactccaaatgatgacatggtcttattttatctattaaccataagcttacagattctagtgaagaaaaaactttaggaggctacatggtctattggagagtgtaggctctgcagtcagaagatccctacccaggcttctgtctttctcagtaagacttgggaccacagcaaggtccgcaatctcctgaggctctgttttctatggttgggataacatggtaagttattttcttctaagtagtcacacatggaaatcttatctaaaattttataccattaacttttatttcacttattaactcataccattaatactttactttagctatgtttggtatgcatgagttaatgagtgattagagtactatgagcagcacaggtttagaaatgcctatttgcctatagtgcagcctcttacataggcaaaataaaagtcaagtaagaattttattttatttttttaaaatgcaaagtaaaatgtgtctttaaaactctcccaggaggtgaagggaagctaccataacaccaggtgggaaggaagacatactgggcttggctcatgctttaattagctactgtgtaaaaatgttcagggattttcagttatccgctggcacccagaggcaatgggtaaggttaactggagctagagccaatatttttttcttcctagaaggagtaacagcagcaaacagtaggagagaagatgccaagttagaagtgcatat

SEQ ID NO: 39384 - DNA, 1078 bp, Homo sapiens
cagtggctcatacctataatcctaacactttgggaggccaaggtgggcagatcacctgaggtcaggagttcaagaccagcctggtcaacatggcaaaacctcatctctactaaaaatacaaaaattagccaggcatggtagtgcacttgtgtagtcccagctactcaggaggctaaggtgggaggatcgcttgaggctaggaggtgaaggctgctgtgagccgagattgcaacactgcactccagcctaggtgacagaatgagaccctgtcaaaaaaaatagaattcatgtcttgaccaggattggtgacccatgcctataaatctagcactttgggagtctgaagcaagaggatcacttgaacccaggagttcaagatcagcctgggcaacacagcaagaccccatctgtaaaaaaaaaaaaaaaaaaaaaatgagctgagtgtggtggctcatgtccatcatcccagctgcttgggaggcttagatgggaagagcacttgggcctgggaggtcacggatgcagcgagttgtgatcatgctcctgcataccagcctaggcaagactgagaacccatttcaaaaaaaagaagattcacgtctttgtcactaatagcataactctatcctaattacataaaactactctgtttcttagaggcaagagtgacgtaatcagtgaagcttaacaaagtctgaagtttaaaaggctgtggaattcaatctaaacactctaccagaacttgttgaattacatttcttctattggtactctgatttgtattggtggaagaaagaacctaatccaaagattaggtcattaaaatgaaggcatttggtgcagttaatagatcggaggtgacctaagttccacaataaattatgattctcaccttttggcatcattgttacaatactgtggttatcatattataactaaacctattgatttaaaaaacataatttcagattcctacagaagattagtaatgcagatcccataatgtgagcatgccccaaaactggtagatttggatctacatctggagaaaaagagacaaagagaaactctaattatt

SEQ ID NO: 39385 - DNA, 1026 bp, Homo sapiens
tattcgctactatgcagtaatcatatcttgtcacatggtatttttaattgtcctgtgttacttagcttttcatgtgtttgtcttatttctcaactcgatttgtaatttccttaacggctggcaccattaaaaaaaattttttttggccgggctcattggctcacgcctgtaatgccagcactttgggaggccgaggcgggtggattacctgagttcaggagttcgagaccagccaggccgacatggtgaaaccccatctctactaaaaatacaaaaattagccgggcgtggtggtgcctgcctgtaatcccagctacttgtgaggctgaggcaggagaatcgcgtgaacccgggacggggaggttgcagtgagccaagatcttgccactgcactccagcctgggcaacaagggaggaaactccgcctcaaaaaaaaaatttttttttgaattttctctaagaatttaacagtcatccctttttttcataaatgcccattaaatgtccgttatatgcctaaatctgtgctagacagacaaaggtaattgagagaaattaggagtactgtttggcacatggttggtactttttttttttttttttttttttgagacagagactccctctgtagcccagactggagtgcaatggcgcggtcttagctcactgcaacctccgcctcccaggttcaaacaattgtcctgtctcagcctcctgagtggctgggactacaggcgcctgccagcacgcctggctaatttttgtatttttagtagagaaggggtttcactatgttggccaggctgatgtcgaactcctgacttcatgatctgcccacctcggcctcccaaagtgctgggattataggcgtgagccaccgcgccaggccggtacttgatatattagtcattttggatttttttttggtggggggacaatacttaatgtggaaactgagtctttagtgtttggtaagagagaatgttgattattttttttttttagacagggtttcactgtcaccca

SEQ ID NO: 39386 - DNA, 1109 bp, Homo sapiens
cttatgtttcttttgcattcttgattttgtcattttacatatataatgtttatggaatttgtcatttagtcagctgatattttagtgctttctatatgacaggcactggggatacagcagtgaacaaaacaaacatccactccctcttgtagcttctaatgggagcagccaagtatagtatgtcacatgataagtgacaaagtagggagggaggacagagtgtgtggggcagtaggtttatagttgtagagaaggcctcagtaaggtatcattagaccaaagatttgctggaggagtagacacatatcacgcaggtagacttgggataagcattccaggcagaagaaatagcgaattccagatttggatttaggatctgggagaaaagattggaggcaaggatccaacaccaaggttttaggccttggcaactggaatgatttgccattttctaaattggaaatggtgagtgagtgagcagccacgtttattctgtgaggaggggactgtgggagatcagattattttgaggaatgcttttcttataagacatttaagtcgagatttttagtaggcatttgaatatgcaagaattatgatttgtagtttttatatcctaaaagcatttacttttgtaaataatgaaattattttctatctacagcaccagttcttagccactagtaggtgttgctagtagaaaagagcatttattctttccctttttttttttttgagacagagcctctttctgtcgcccaagctggagtgccgtggcgtgatcttagctcactgcaacctctgtttcctgggttcaagcgactcctccatctcagcctcccgagtaactgggactacagatgcacaccaccatgactggcttttttttttttttttttttttttttttttttggtagagacggggttttgtcatgttgcccaggcaggtctcaaacccctgggctcaagtgatccacccgcctcagtctccaatattgctgggattataggcatgagcccctgcgcccagccagcatttactcttaatattccactacttttgtatgcacatgggaaaaatagaaccagctggtaaaatcctaagaaa

SEQ ID NO: 39387 - DNA, 1034 bp, Homo sapiens
aggattacaggagtgagccactgcgcccaaccaattttttttttctttctttctttcttttttttttttttttttctgagacagagtcttgctctgtcgtccaggctggagtgcagtggcgcaacctcagctcactgcaacctccgcctccccggttcaagcaattctcctgcctcagcctcctgagtagctaggattacaggcatatgctaccacgcctggctaatttttgtattttttagtagaggcgaggtttcaccatgttggccaggctggtctcaaactcctgactttgtgatctgcccacctcggcctcccaaagtgctgggattacaagcattagccactgcacctggcccaatttttttcttttttttaatagtgttatggattgcatgaaattacttgtggagtgtatgtgttttagtagccagctacagaagtttaacattaacttctaatgttacctgcattttaggttttgtataacattgtagtttgttagagatgtaaaggaatccaaggaacatatcctttgagaaataacatctaaatactatgtatcaattaaaagttattaaggtatagtgaaagatccattttattttttttccccattgattggcagaggaaggtacatattttaaaataatctctggtacttagagaatatgctttaccgtaacttgccatcacataaaattcttccttaattatattgtgaattttttttttcttttttgagacggagttttgctcttgttgcccaggctagagtgcaatggcgcgatctcggctcacgacaacctccaccttgtgggttcaagtgattctcctacctcagcctcccgaatagctgggattacaggcacatgccaccatgcccagctagtttttgtatttttagtagagacagggtttcaccaagttggccaggatggtctcaatctcttgacctcgtgatctgcccggctcggcctcccaaagtgctgggattacaggcgtgagccaccgcgcccggccatgttgtgaat

SEQ ID NO: 39388 - DNA, 1032 bp, Homo sapiens
ccagcctgaccaacatggagaaacctcatctctattaaaaatacaaaattagcctttgtatttttgtatttgcttatatatgcaaagaatctattccttcctttttggaaggagtcacaagaaactagtaatattggttacctttacagagtgaaacctggatggttggaaatgggagtagggtggagacttttcacttataaatcttttaatttttttactgaattaattaaaagttaaaaattcacacactggaggtctaaaattactgaaacacatgatctgaatgtaagaattctaatcaaacagtttacttaagtaatacctgggcagatagccaagataacttggttatcttggtagatgacaatagtagaaaaattggtagaaagttggcaactttatttatataccatgatgtgtgtactttagtcttaatgaatattttgttttcttttggcagcatgcatatgcgctagaacttctatttgatcagttgcatgaaggagctaaagctcttgatgtaggatctggaagtggaatccttactgcatgttttgcacgtatggtaagagttttatttctcactctggccccaacagaagaatattatatgatttggctgtatgtttttttaactagtggttttcatgtttatttgtttgttaattctattaggatagcagttggaatgagcatcacttaggattttgttgttgttgcaagtgacagaacatgcaacccaaactggcagagctaaaagggagtttatttagttcatataacagaaaagtctaggggtgtatacggtctgttgtgtggctggatttagaagagcagatgttgttattgacgatagggttctctctgtttcttgatttggctttactttcctccacatgttggtgtcattatccggtaagctctacccttgtaatcacaagatggtggccagtagctcccaaactaccttcttccaagttctgatttggcagaaaagaatagaataagcctggttttcttttctttttt

SEQ ID NO: 39389 - DNA, 1072 bp, Homo sapiens
attaaagagctagtagatgactcagtaaataatgtcaggaaggacgatccaacacttctgtcttcagggagagtacagcttgttggtaagtatcagaaaactttaaaaatttcttcagaggatttttattttcagaagatccaatgcaagctaaataatactcagaggtaattattgtatttttttttacaatcacttttaagtactaaaaaataaaaacgattatttttgctcacctagtgtgtattttgcagccatctctttgtgagtttaattttgtattttcctattaacctctgagattgaattttttgtaatgtgtctgaccattaggattttgtcttttgtgaagtacctgttcagatattggattgcttgtatttttgacttacagggcttctagccctttgtctatatatataaatacatttcttctcccatctgaggtgtgccttttcatcttattggtacccttttgataatagaaattcttaattttaatgtagtcagacttaccaatttttttcagtgctttctgtgtcctttttaaggatactctgagaccatgaagatatgtctcttattatttcttagaacctttatcatttttagcttttcatgtttaggtttttgatcttcctgatgttggtttttgtgtatgtgtgaggtaaaggtgcagttatatgtttttgtgtatgaatatccagttgtattccccagacacactcagttttgtttaaaagataaaatattggccaggagcggtggctcacacctgtaatcccagcactttgggaggctgaggtgggcagatcatgaggtcaagagtttgagaccagcctgaccaacatggtgaaactccgtctctactaaaaatacaaaaataagctgggcgtggtggcgcacgcctgtagtcctagctactcgggaggctgaggcaggagaatcgcttgaacccgagaggtggaggttgcagtaagctgagatcgcaccactgaactacagtctggcgacagagctagagtccgtctcaaaaaaacaaataaaataaaataaaggcccgggcagctct

SEQ ID NO: 39390 - DNA, 1031 bp, Homo sapiens
gagaattgtgcagtgagtggtcaaggagacatcacacacggatggaacttgaactgaatcttaaagaatagtaggatatatggccgggcatggtggctcatgcatgtaaccccagcaccttgggaggccaaggtgggaggattgcttgagcctaggagtttgagaccagtctgagtaacatggcaagaccctgtttaaaaaaaaaattagccaggcacagtggcgcatatgcctgtagccccagctactctggaggctgaggtgggagaattgcttgagcccaagctgttgaggctgcattgagccatgtttgtgccatggcactgtagcctgtggtcctagatttctgttacatatggcttttgcgtagttcttgactagatgaccggggatgaaggtgacactgtttcttctgtctagtctcatccgtttttttggtaggcttagatcagttatgggaagatgaaagttgtataatttgttctggtcattgacttgctgcttattggccaagtgactgggaaaatgacttaattgctttggccctgttgattatctgtttaaaaaaaaaaagtagctcacgcctgtaatcccagcactttgggaggctaaggcagatgaatcacttgcgctcagaagttcgagaccagcctgggcaacatggcaaaactccatctctacaaaaaatacaaaaaattagatgtggcaggcacttgtagtcccagctactcaagaggctgaggtgggaggatagcttggattgcgtgagcctgacaggttgaggctgcagtgagccatgcttgtactactgcattccagcctgggtgacaaagtgagaccctgtctcaaaaaaaaaaaaaaaggtagattgaactggtggttttacacattttaactgaagtattaatataatgtagaaaattttacaagtcataaacgaacagctcaatgaatttgaacacatgaccaatgggtttttaacttttcaaaaaaaatattgataacctagagtgaacagttaaaatctgaaa

SEQ ID NO: 39391 - DNA, 1034 bp, Homo sapiens
aagtgatcttgaaagatatttctagatttaattaaattgaatttaaatattgtagtaatacttgcaagtattataggggtatgtatacatctgatttaagatagatgtactgaaggggctttccagttttaagatagcagaatgaagatgtttatgccttcttttggatatcaccccaagataaccagaaaaacagaagcataaactccatactcaattaactaggagactatacctgcagtcctgaactccacagtgtgtgaagatagaaagcagatggaataatagctgacccaggagggtagaggaagtagaaactaaagagactacagagtgaaatattatgcatacgcagtttgcactgcaaaactctgaaaaggcttaggaattggtggcatcaagaccttgaaaatcataggtaaaacatgggtctgaaaagagggaatgctgcttgagactctgcatgaggaataatcagcactaatctctacgtaagaaattttctaaaaactgatggacataattctaacacaaagaatttttaaaataagaaaaaagaacaaccatatcatttatattcagaatattaggggataaagagaagattctgaaagcctctagaggccaggtgtggtggctcacacttctcagcagtttgggaggccaaggaaggaggatcgcttgaggatctgagtttgagaccagcctgggcaacatagcgagaccccatctgtacaaaaaaattttaaaattagccagatgtggcagcctgtgcctgtagtcccagctacatgggaggctgaggtgggaggattgcttgagcccaggaagttgagatttcagtgaaccatgattgcaccactgtattccagccgaggtgacagagaaagaccctgtctctaaaaaaaataaaagcttctagaaaaataaaacagatctcctgttaaggactggtaatcagaaaggcatcagactgcaaacagcattagaattcgtaagtcagagtaccaaaccatcaaattctgagttgaaaa

SEQ ID NO: 39392 - DNA, 1041 bp, Homo sapiens
gccaagatggtctccatctcctgaccctgggatctgcctgccttggcctcccaaagtgttgggattacaggcgtgagccaccgtccctggcccactgaacttttaaaattggtatataatgtacctctattaaagcatcttaaaaattcaattgatctaaaatagactgacatctttgagtaataatgctcatgaatttttgaagctattcttggtgtgtgattgtcagccaggaaacagctgcttagttttgtttcattagccaggtgggtatttttggttttcagctaaatgttaacaaattttcaatagtttgatattttactaaaatatatgagtatggtaactgaacactaatattgtaaatgaactaatggattatttttagtgttctaaatggggttcagaggctaatacattattttaggtaagtgctaacattcttctaggtataaatcattgcctacaacttattgtgttcttaaagaactgaacagtaaaacaaatgggttctgattggatttcagttggatctctggattcctctgaccattttccagaaagatgagtgttgtgttctcactgaacctagcacgtggctcaaatagagggctggtgaaagaatcccacttgaagaaaaccagctgacccaaggggccaaggaatgtttgtgtattgtaatatgataaaaaggaaatcaggccgggtggggtggctcacgcctttaatcccagcactttgggaggccgaggtgggtggatcacctgaggttaggagttcaagaccagcctgaccaacatggcgaaaccccatctctactaaaaatacaaaattagccgggtgtggtggtgggtgcctgtaatcccagctacttgggaggttgagacaggagaatcactagaacccaggaggcagaggttgcaatgagccgagatcacgccactgcactccagcctgggcgacagagccagactctctcaaaaaaaacaaaaaagagggaatcaagtccaataatttccttatccttaatccttctaatat

SEQ ID NO: 39393 - DNA, 1040 bp, Homo sapiens
cccatctctactaaaaaaaatacaaaaattagctgggcatggtggcgcacacctgtagtcccagctaatcggaggctgaggcacgagaactgcttgaacctgtgaggcggaggttgcagtgagctgaggtgagatcatgccactgcactacagcctgggcaacagagtgagactcggtcccaaaaaaagaaaaagagcatctctatgtgtgggtcaaaggaaaatctagtaaagggccatgtgaacagccatcagtaactgaagagaggtgttgctgagtggcactgagttgtggggccagaacacaggttttgaagtcattgggagcaagatgaaaaaaatcctgttattttcctatggaagagaatgtattgggtactcagctgatttgaaacagtaaaatgctgtggaaggctggaggagtagctgctatctactaagaatgaaaggaaaaagtaagttttaagtgttcaggaggagttagtgagccttaggaaaagacatgtaaaacacaagaacatgtttaagagagaaattgtggacacctttccctttaaaattatgtttccattgtcttagatgcagaactccttcaatcagataatctacaggtaagaagatcacttttaaaagtcacattcagtctacctgatataaatattttgtagaccttgattctccttccctcgagtatgctttatgtggccctgggcatgtcactttctctaatactcaatttcccccgttgtaaaatagggttggtatgattgaatccaaataatgcagtaacagctcagtcaataatagcaacttatgattatattaaaaggaaaaaaaggcttaataataaaatacaatttattaaaggaatcatgtttacatagatacagaacatcttggatatttcaacaccatagcaacacaaaattaatttcttcatgtataaaagatgtgctgaaagctgcatgcctcatcagtttttattttattggttatggctatagttgacatctttccatataaaaacaaactgcacagca

SEQ ID NO: 39394 - DNA, 1050 bp, Homo sapiens
gtaagatgaccttgaagcaacataatgctttttattttttatttttattttttgccatagaccttggagagcttgagcaggattgttatgaggagaaactttcactagtgatgaaaatgctgactgagggtatcatcaaaccctccaaggactagttgttatataagttattaatattaaaaataacatgataatatataatattaactaagaattgtacatgatttcaaagtttgccaaacactttcacatacatgattttatgtgccttcacagagactttgaccacctcactcctgcctttgggaccgtgaaagagaagtcagtatagagtgagccctagctcacatgttccgtggtagggaagtggacaggggagaggacagcatttctcaggggcattcatttctaaatccctccagcaccatcaaagattttcctgcatctgcaactttacaataggtctttttgggagaagtggaaattatttaatgttgtgtttaccgtgagcagtggttatttctgggctgtgagttgcaagtactgaaggggaaatactgacttttataatttataagactttgttgaattttttttttgcaatgagcttgttgtaaatgattttctattttttaaaaataagtgttgacatctgcttcagccaggagggagcaacaaggactggacttactctgtgacctgaaatgaaaaatctgtgaaaaaaatgtatggaacaatggttttcagacattgggcaacaggcaatgcagggcccaagagaagggagacaaaggaagtgaacatgctgcttgctccagcttactgcctggagagggtttccaagccgcaatgcagacaggcgaaccaaaagagactctgagttggaaaatagagctgagaattcagggaggccagggtggctagagtaccagagaggagagagtgcaacggaaggagggagctctggagatctgtgcagggttcctctgagtcttcagcagaagttcgaccaggtacatgcatgtgaggaaacttcccaagacagagagg

SEQ ID NO: 39395 - DNA, 1006 bp, Homo sapiens
gggtacagagccaggggtagtgttggagggaaaagcatgtttcttatttgtgggagaggttccgaaatggggagggcctgggaaggatcacccaggagaacagacccaggtttttctcagccacttaaaccaatgcttcatcttttctcaaggtggaaagtgatatcaagaagcctctgttagcctggtctgggtcctgctctcccttcagggaggccgcctgtctactcaccactgtgcctttctggaaagcaggagttcaagccttagcaagcccagaggcccccagcagacgatgaggacattgtcggctcaacatctcaggccactcattaccttcgctcatgatcccagcagccatttttcttaacaccttctgccactttctgtcggtgctaatggatggaactcctgcacaagttttaactgaacaagaaatcccagcaaaaggcatttttttttctacttctttgattgtagaaaagcagacacttctctgaaacatgaccttattcttccaaacagtatcgctagtaaaatagcatgctggacttcagacctcagggatccttttgatgcactgaccaggaattgtgataatccttttcatttttatggctttttacagtttctcattctgtcaaccatattgaagtgaagtggcatagtcttcactcactgtaatctccagctcctgggctcaagtgatcctctagactcagcctctagaatagctgggactacaggcacatgccaccaggactggcaaactgttttatttttaggtagaggtagggtcttcctatgttgcccaggatggtcttcaaatcttggtctcgagcaatgctaccaccttggcctcccaatgctctgggattacagacatgaaccacagtgcctgttgtagaaatttttaattatttaatatgaaaatattacattcatgattattttatttagtaaataaaataatagagagcccagaaatcaacctgcacacctaccg

SEQ ID NO: 39396 - DNA, 1047 bp, Homo sapiens
taaattacacatgcaaaaagtcagtggataaagccaggcatggtggctctagcctgtaatcccagcactgacggatcgcttgaggccaggagttggagaccagcctgaggaatatgatgaaactccgtctctacaaaaaatacaaaaattagccaaagatggtggcatgcgctggtggtccctgcttctcaggaggctgaggtgggaggatcacctgagcccggggaggttaaggctgcagtgaaccaagatcacaccactgtactccagcctgggcaacagcctgcctcaaataaaaagaaaaaaaaaagtcagtagataaaagaattctaaattgccaaaggaaggaaagaaaactgcttaacacattccctttggaacagtggttagggaaatgcggggtggaagcagtggttacaatgtgtgctttgaagtgcgatgaacctgaattcacatgtggccctgtcattcagtgggtatatgtgattaggcaatttccttcacccctctgagcctcactttctccatacatatgtgtgtgtgtgtgtgtgtgtgtgtatgtgtgtgtatatttcagacagtctgactcctgttgcccaggctagctagagtgcagtggggctatcacggctcattgcatcgttgaccacccaggctcaagtgatcctcccacctaatttttttttttctttttttttttttttttttttttgtggagacaaggtttcactgtgttggccaggctggtctcgaattcctgggcttaagtgatccgtcagcctcagccttccaaagtgttgggattacaggtgtgagccactgcgcccggctactttctctgtatgttgaaggaaatcatcctggtgcctttgcagggctgtcaggaggactgattggtgagacaccaagcatagtacttaggacatagcatgtcagtgttgttattggagccacaagctgccactaactgttggttattctctatgatggagacagaggaaaggggtgaagaaaacaaggtattcacatctatttggtgcaataatt

SEQ ID NO: 39397 - DNA, 1024 bp, Homo sapiens
tttcagccttcttctgcagacaggtgggtctcttggcagacagatgagtctctttaactctgtttaatacctgaggatgcctggttctcactgtgttttcctaacgtgctttatcttgttcagtcttcagaataatgccgatgccagccagcgctaggaatggaggcccgcagaggcttatggaactggcccatggtcactcagccaggacatgggagcccaagactgcagacctgaggctcctaagcaccccaatctctcatctcaacttcaggatagcctcgtgagttctgctcacgccattcccaggatcccccatcctcaaagcttcctctgtcttagtcctgcccatccttcaaagcccaacttgaaccccgtctccatgaggtcttttgttttaggctgaaatcaatttgcttatttggcacctctccctcccccccacccccgagatttgttaaggtattattgaaaaataataattatatatacttgcagtgtacagacatgatgctttgataggtgcatacgttgtgaaatgattaaatcaagctaattagcatattcatcacctcacatacttaccattttctaaattgtgagaacacttactaacttacccatacttcttggtatttataaatcaattacaaagaaatgctatgagtctccctctgtcgcccaggctggagtgcagtggtgcgatctcggctcactgcaagctctgcctcctgggttcacaccattctcctgcctcagcctcctgagtagctgggactaccggtgccccccaccactcccaggtaatctgtatttttagtagagatggggtttcaccgtgttagccaggatggtctcgatctcctgaccttgtgatccgcccaccttggcctcccaaagtgctgggattacaggcgtgagccaccacgcctggccgtgtgtgcatttttatcttctcaattcgactgtaagctcctagagggtaggaacattggcttataatatattctgtcctctggaaggc

SEQ ID NO: 39398 - DNA, 1010 bp, Homo sapiens
atggtcttcaaaagccctcaggagcaattttcccatccactttgaaggatataattccactgttggtctgaagagcaaatgccctgcgtaatttagagctgggcctcagaggggagtgtgttaccggacagtcccctcagcaaactcagttattccactgggcttttgctgagccctgctgtgtgtttggactttatgtgaccttcaatactgactgatccataggcttgtcattgcataggtgagctccacatcctgtcaacttgattttgacaatctgaagctggaaaagctttggggagcagcgcctctgcacactgtgtcaggacctgggcttccggggctccagagtggttgataaacatcatggcggctcagagagggagaagccaaccaacagtgtttgctagaggccaaggtggggtcagggcctgaggcgggggatgacctgaagctggggacggcctggaccagtaggtggctgactcaaagactgagcactgagagcctggggaagaaagggggagaaagttcaggaaatggataccagctgggggtggctgctaagaatgaggcaaagctggagaagttgctggggtccaaccaggaggaccttgtgggccaagccagggagtcagaattttcagctgagtgaggagccatggaagcagtggtgtggggtggtcaggtttgacttttcttttaagttatgcttgacttagtcttttttttttttgagacggagtttcactcttgtcgcccaggctggagtgcaatggtgcaatcttggctcactgcaaccttcgcctcctgggttcaagagattctcctgcgtcagcctcctgggtagctgggattataggcacctgccaccatgcccagcaaatttttgtatttttagtagagacaagatttcattcaccatgttggccaggctggtcttgaactcctgacctcaggtgatctgcccaccttggcctttctctttctctgtgtgtgtgtgtgtgtgt

SEQ ID NO: 39399 - DNA, 1031 bp, Homo sapiens
ttttgagtatgttctcctcaatccaaattgttccctgctcaggagaaaataaagctctggggagaggcttaaccatttaatcatgtaccatttaacacctctttctgggaatggaaacatagatcagcataaagaacttgtcccattagtatttgccaccgtttttcctttgaaaagtaaagatgtgtttcaatcacttcatttgttaaaattaaagcatggcctctccttctccctgtccatctgctgtgacttgtgatctgatttgagtgtctgttctagtagcagaagcagcagaggtagatgagacaacaatttactgcctcagtggaaacttacttcatggccgagtcagaataacacagttggagtttttaaaattaattggaattttattctacactacttgtctggagtctaagctacaaagctgttgttgtaaaggtgaaaatctagcctaatcagtgccaatggcatttgcagaagatgccaagaacttcctgggtctcaggaaggctggaatgtacttgtcctcccttctccctccctccagtaaacacaaccttccaccctcccctcaggctccagctgctgcttgctgcacctctatagatcccgagtttgggaactggctggagtctctgttgaaggactggagaaggttacaaggattgtctctgcccctgcctacctcaggcctcccagaggtgggggatgagggagtctgtggaagaggaaagaactaagggaggagcccagtgtgagaggctctgctcccgcctgcggcacttccctgcacctgccacaggtccaattcatgggaacagctggactttctagccactgtcgttggtctaggaagttaaactgtgggcctcttacccaccgcagtcactccctggaggtggcctcagagctctggctccagagggcacctgtcttgcatggagaggtaagaaatgtttgagttgaactgaatattcgctgccggcctggggtcggtgagattagtgagaagggaacaggtggcg

SEQ ID NO: 39400 - DNA, 1050 bp, Homo sapiens
tggggcagagatccctgtgatcctcagagggactgtgaagggctgggactgctgccttagaccaagttttcttgtcaattgcaatgtctgcgtcaaaatttttctccaaatgatggtggagatccagcacctcagcagcgagaatttgccacgtgaaacataaaccaaattatgcaaaacccataagacatgtgagccatctgggggataaggatgtcttcccaaccaagactggaaattcagaagctaaaatgaaaaaaagtagacttatttctaaaatttaaaataaatacgaaatttttatggcaaaatgcaacataaagtcatcaagcaggacatttgggggaaaatgataatgcagaggacaaagatattacatttacacaaagagattttataaatcaacaaggagaaaagtatgaataattatagcatttgtgaacttattagcaacctagtaaatatttttaaaaagattataccctatgacttaacattccaggatatgtgtatgaggatatttgctaagctttattcaatatggcaaagcaaaacaaaacaaaacaaaaaatcttgaagcatttactgagcacattctgcatggcagaaactgtgttaagtcctcattcaactgtttgaacagcacaatgagtcggccattagacacagccccttattaggatgagaaactctagactcagagaaggcaagcaattcagtcaagattatacaaagaagctacatggcagtaaatgccagatatgaaaaaagatgaagctaaaaatgaaaaaaaaagaataacatcaagaaatgtaaaagacagaactaaaacttaaagctaaggccaggaacggtggcccacacctgtcttcccagcacgttgggaggttgaggtaggcagatcgtttgagcccaggagtttgagaccagcctgggcaacatggtgaaaccctgtctctacaaaaaatacaaaaattagggctgggcgccatggctcatgcctgtaatcccagcactttgggaggctgaaaggtcaggagatcgagacca

SEQ ID NO: 39401 - DNA, 1026 bp, Homo sapiens
tgccctcagtatgttatccagtgccacactgacttccacaagaaaaccacactcaagactaacttgaaaagtgcatagaggtcagaaactcagctttgggataaagcattttttgtaaagaattaagtgaataaaaataaacatctaaaatatttcaactgaaagaaaaaatagattccccattattagagccaatggtttaaattcagacatatggaaaaatttaattttcaattccaggctttaagcctaattctggaagaaaacccattaaagtaatgaagtaataaaacaattgaacaataaatcttgattttgtagagaacagaacaaatgcttggagatacgtcatcattttcatgcttgtggattcatacagacaccagcatctttgcctaaaagttacaaggctgtggtttgtagccgacctcagagtaggagtgggtaggaatttacaggatgttattcttccaagaagagttgggagcatttttgggggatgtagaaacttaaaacaatccaggtgttgaagtagttaagggactctttttctggaaaaataattagttctcaaacctgtttaatttgaatattcaatagagctatcaccaggaaccaaaggaaatgaaaatgagggacagatatggttcctacccttcacgggcttatcacagaatgctttgactttcacacaaatgttttacatcatttcattacctttactccagcacattccaattagcctcctggcaagcaagtaaattgcagctttcacagactttttttctttttaaattttgtttttggagttgtggagactgtgctgcaaattttgctcttgataaatgacattgaaatgtttttaatgccccgagataatgaatgggaatcttaatagtcttctaattaaaatgaaaaatagaaaagtcatgagtggacattttaggagtgtagttctgttgtttcttgttttggaatttgtggatacactaagtgtaatttgtaattaaaaacaattgggaaaca

SEQ ID NO: 39402 - DNA, 1050 bp, Homo sapiens
cctttgtaagtttctggaatttttgtacatgatattttgagttcttctacaataaaatttaatggtccatttgagaaagtgtactcatattaaatgtagtgtctattattgggtagtctgagacaattcctgagtgctcaactctcctttgatctgtcgaaacatagtggttgccatggagtcttgctggccgatgaccaagtaggagttccacattccactcagctgggcgcagtgttcctaatcaggccggacctgaaactctagcacaaaggactttaaaaccggaatgctttatgtgtaatcactgaaaataagttgattatttgtagggcagagtatggtaaaggttaaaaatttcatgtttcacttatttaaattttgatttgtttctggaaaaatattttagtcttctgatgatatgaaatgtaaaattctctctagtccccctgctttgtacaaagtaatacaaaacaagatttgtcttatttgaccttaaatataaataaaatggcagctgaattattgtgagcaatgtagctcaagtatctggccgtcatctttgcattttattgcagtgatgactccatgccattgttaatctggatttatttttaaacagtttaactagggcctttttttgcaggcttttctttgtttctcccctacttagttctgaggaaagcctaaaataagatccctgtaaacactgatgttcattttttaactcaaacatttgcacagccccactgtgggttcaggaaagacaaaaggaggctcctgacttagatctagccctcaaatagagaggggagaaagccttgaagacacatcactgtagatagctgggatgtgtttttgctgtacagaatgagtaggagtgaggagaaaagatgacttttgcctggatagatggggggttgaagaggcttctgagatggtttttgattgcctaccgaggtcattctctgacctagtttgatgtctaactcccttataattgcatcagcttgaacccataaggcttcagtctgtggggagaattaaccc

SEQ ID NO: 39403 - DNA, 1035 bp, Homo sapiens
ttgtgtgtgtgtgtattccctgctctgaaaaagcttaatatttaaaaaatgaaattcaacatactttaaatctttgatatttgtagatgcagtttaggtgctttcacttatttgcaagttataggagaggtctttacttacacaagttgatgattttgctaaagcagaaaccgcggatgaactaataaatgactgtcccataggacccaatatggcccccgctgtcacttcaaagctgtccttcaggactgtcacttttctggtgggtaagcttagcaaactgcccaccatccacacacacagcaactttgctgtctttgtttacgtttaacatacatggaatctctcagaaatagcactttagaaacatgtttcttggcaaaaagcaaaaaaaaaaatccaagtacaatgtaattttattggaagttaaaagtagctgtgttgtgatctgaggctgtgcacgatggatgagtcattaggaagcctagaacctctgtgtattttatcccatctaagagtttagagctttgtgtctgcctcgagaatatcaaatctatggtataggaaggttccctgcccccaacagctaccatgcagggtaggagtgagacacttagaaaacgattaaatatgagaccacatgatccttactctaagtgtaataaacagctgttaaagtaatggaaagagctgtgggttggagtggttgtagcagatcaaacgggagcttgatgtgagctggctcttcgttgagcaggagggaagagcccagcttaggcactggtatgggagacacagacatgatgtgggaagccacaggggttgctgtggaggccagaatagaggatgaagagtctccacagcccagggaggaccctgcctctcaaactgccttctcagcatgctggatttactgatttccatcaaactggtgaattttgtgagaaattccaacaagttgtcttctgaactatttcctttaaaaatcacttatttaaatagccatgtgtaggttcagcctgatttgaaaggaaa

SEQ ID NO: 39404 - DNA, 1050 bp, Homo sapiens
agaggtcgttagaccacacttggagaactgctatccagatcatttcccaaatttgtacatttgctcagtgcatgaaaaagacccacccaaagcctactatcacaaaattttgtaattatgtcaactaagagaaaactttaaaagctttcagaatgggctgggggtcatcagaatgatactggaatctcaatagcagcattggaatctataaatcacaggtagacaaatagctccctgagtactcagagaaaattacttccaaccaagacttttatatctactgacatcattagccaagtgcgaagggagaacatttttgaaacaggaagagtctcagaaagcataccttctgttactcttactcagaaactattgctcgattttgtaatctcccaaaggaaggaatacattggaaatagcaatacagaagaccagcaaaggctatcattaggatggtgttgaagaaacaaccagcaggcctggacagcagcctgtccaggttggagcagaggtcaccaagaaagaaatgcaaagcatagaatatctgatatttgaacacagtgagacaagattgatacttctggcatacaatttgctaataaattaatggtctttatcttgaaaaaagaaaaaaaaagagaaacaattttaactccagggaaaacatgattctctaagaaaggaaatgaaatcatagtatactctgaggctaacagggcataatacttacatagtcttaaagatgtaaattctgacatttaatcgaatcaaattacataacagaactagttaagaaggctggccacggttgctcacactacccagcgcttcagaaagatcacttgagcccaggaagacctgcctggttgacagagtgagaccctgtctctaaaattaaaaaaaaaaaaaagagagagagagacatcttagaactagttgagaagacagaagggtaagtttgaggaaactgagagtaaataatacctaaagttgaaaaataatgaaaacacattatcagcatggttagaagcatggaccttcttagagcag

SEQ ID NO: 39405 - DNA, 1126 bp, Homo sapiens
ttttttttttttttttgagatagagtttcgctcttgttgcccaggctggagtgcagtggcacaatctcggctcactgcaacctccgcctcccgggttcaagcggttctcctgcctcagcctcccaagtagctgggattacaggcatgcatcaccatgcccggctaattttgtatttatagtagagacgggtttcttcatgttggtcaggctggtctcgaactcccgacctcaggtgattcgcccgcctctgccttccaaagtgctgggattacaggcgtgagccactgtgcctggccaaaactgctattttcatttcaagtgtaattaccttaaaaagatacttcagcggcacagctggcttgagcaactgaactggaaacaagatgcaggaccccaacgcagacactgagtggaatgacatcttacgcaaaaagggtttcttacccgccaaggaaagaattggaagaattggaagaggaggcagaagaggagcagcgcatcctccagcagtcagtggtgaaaacatatgaagatatgactttggaagagctggaggatcacgaaggcgagtttaatgaggaggatgaatgtgctattgaaatgtacagacagcagagactggctgagtggaaagcaactaaactgaagaataaatctggaaaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatactgataggaatctgcccacgatatttgtttacctggaaggagatatcaaggctcagtttattggtcctctgagtgtttggcggcatgaacctgacaagagatgagttggaatggaaactgtctgaatctggagcaattacgacagacctggaggaaaaccctaagaagccgattgaagacgtgttgctctcctcagtgcggcgctctgtcctcatgaagagggacagcgattccaagggtgactgaggctacagctgctatcccat

SEQ ID NO: 39406 - DNA, 1048 bp, Homo sapiens
cctgctgtgggacatctggctagagatttccaaagctgagggtgaaaggtttgggcatcggtgtgactgtgtaacactagagttctatctaccatctcttaaactacaggtagtcttaccggtgtgggctgaccttccggttatcaggcagcctgctgcaaccactagaaactgcctttgaaggtttccagtccggcacaacatttgtgttctcattaaacagtagagcataggctttggggacacacagctctgggctcaagccttagctgttgctgctctgagcctgttccctcgcgtagaaaggcaatcataatactccctactttatggggcagttgtgggaatggaattaaatgctaatgtgggccgggtgcagtggttcacgcctgtaatcccagcactttgggaggctgaggagggcagattgcttgagcccaggagtttgagaccagcctggcaacatggcgaaactccatctctaaaaaagtacaaaaattagccaggcgtggtggctgtagtcccaggtactttggaggctgaggtgggatgatcacctgaatctggggaggtcgaggttgcagtgagctgagattgcaccaccgcactgcaacctggagtgcaggctggaggaagagaaatatatgggtcaattaggcaaatcactcagatcgtaagtagatatactagtaaaatagcgtgacttagggtccttcactggaagcctggtattaatgcttccattgtgtgggtgggggaaggagagagtgtctccagctctctgtctgtgaggtctcccagccgaatattggccaagggagtgaaaccagaagcaagactaccatgagacaacgttccagagaaaggagggactaaccagagcaggtgcccagctttggccagtcaggctcatcttccagtcctcagtagattattatcaactttaagtgatgtcacagactcccttcctccaaagctgtggacctcttccttcccatgcctcttgttacttggaagtcactctacttccaaacatgtcggctggaga

SEQ ID NO: 39407 - DNA, 1050 bp, Homo sapiens
ggaaggcccaggcgggcagatcacttgagcccaggaattcaagaccagcctgggcaacatggtgaaaccctgtctctacaaaaaatatttaaaaaacaaaatgaactgagcatggtgaagcacatctatagtcccagctacttagaggctgaggtaggaggatcgcttaagcccagaagtcagggctgcagtgagctgagactgcagtgccactgcattccagcctagaggacagagtgagaccccgtctccaaaaataaataaattaattaaataaagccttgtgaagaatctgccgtggagcataatgtaacccataaagccacttaactgggcgcacataaactacataaactacagtgtgtcccagttcattgagagtgaaaatcaagcaagggaccacctcagtgtggtagagccccctccctgccctccagaccctgctctgttctctgtgtctgaccattgactggccatcactcaggcactagttgagaatgccaatgtctttagttattgtaatttcagaagcacatccttgctggacaaagaacctacctgttaattttttaaagtaatgttcatcattttgaacattgttttctttcttttttattcagctgaccctcatgaggaatttaacttggttttctgaactgtgttggtaacatttgaaggacatagaaacagttttcataggtctcaagtgatataaaccacaattctttagaaaatatctttttttttttacccattctggattttgaaatatatacagatctcatacctcagattctcatatgatatgaactgtttcaaaacacattgatagcagaagatacatactgtcttctagtcaagagggtagcgctgtatttagtttaaaacattttaatgcattttatttgctaaatacaaaattataatattctgtataactttccaaatctcatctgtcctccctttcccccatctctttatattcagatgcttgtccctccagcttaaaaattcatgactttgagaaaattcgtcttcatgttatctaaa

SEQ ID NO: 39408 - DNA, 1054 bp, Homo sapiens
atagcacatttctaaatagtctacaagttttaattttagcaactttgtttagtatgaaaatttgatctaggaataatggagaaaggttttttttcccctctttttttcataatcccactactgtaaagaaatgaataaactttttgaaatattaaaaagaaaagagctcttatttaaacttaagatgagaagaacttttaataaacttgtggctgggtgaagacagagttttataatgaaatttttattcttaccttcatggtacagagtccctcctccttacccccgtaaaaatagatgggatgttgtgatttatgatgaggcaattctgtagagacattttatggaatacgtaatcctaggagagattttcctgatggctaatatcccagacacagagctcagaaaacaattatacccagctagttggttctgttcactctactattgcatgagtccaatgtttagattttaaaacaaggaaatttcaacattctgttttctagctgtaagagtaactactttaaaaaaaaaaaaaaagacaaccaaaaaaacctatttcttagaaaaagtcttgctctgttgcccaggctagagtacagtggcacgatcacagcctcaaactcctgggctccagcaatcctccctcctcagctaattaaaacaattttttttgttgttgttgaggcagggttctcactgtgttgcccaggctggtcttgaactcccggcctcaaatagtcctcccgcctccacctccaaaaagtgctgagattactggtgtaaaccaccatgtctggcctaaaaaaattatttcaaatgaaaaaactacgcactgctcttgtagtgccctgcttgctaaacagcagatttcatcataagcaaaatcattttgtaccctaaatattaggacttatttactgatgtaacaaatgggaccaaggagaagctggtcttccgtcttaggctcagaaaacagtatcaaaacagcaactctgtggctcagagtaatttatagcatcattttaagctaatgtaattctatttagtgtgg

SEQ ID NO: 39409 - DNA, 1048 bp, Homo sapiens
atcaatatctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtttcttctccctaccccacacatcttttggtactaccatttggggaagccaagcaaggatagtaaattgatcagaacacagttgtgggaatttggcctgaagttagtgaaataaaactttaaagagtggaaaaaaaaaatttttaacaatgcttgtgatgtactaaagaacaattttatgaggccttacttggtaatgtaataggctctcttcaatacctaatactgtgatgttatgaacatgggaacatttggttttgcaaagtgttgtcatcaacaataagattctcaagagcagaagtttccgccatagtatgcacagggcctgtggactttttgaatatttgaaggactgtcatatggaaagggatcaggcttagtgtgtaggactccaagagctaggacacaacatgaatgcagatgccttctctctagaacaaagaacttttgaactgtaacagctgtctgtaaatgagtgggccaccccagaggtcatgaccttatcaccatctgtgttcaagcatggcagggagaagccctgggcagggatatctggaaggagaaggacaagtggggactttagggtcccttctaatcctgagagtctggcagtgccctactcacccaaggaccgttgagctaggccctgtccccaaaccataggccctgtgcccacaccctgccccaataaatggctcaggaagaacaactgctatatactcatcagcaagaaatgccccaccatcagctgaattatttaaaccattttgatgagtggttttatggcctttcttgaaactgatgttgttattagcactgcctaataccttttccttttttggtttcttggtaaaggtgtg

SEQ ID NO: 39410 - DNA, 1040 bp, Homo sapiens
tacaaaaagtagctgggcgtggtggcaggcgcctgtaatcccagctccttgggaggcggaggcaggaggatcactcaaacctgggaggcagaggttgcagtgagccgagatcatgccactgcactccagcccaggcaacaagagcgagactccgtctccaaataaataaataaataaaaataaaaccactatcagttaccattttacttgtcaaattgacaaaattggatttttcaaaatagttatgataccaaattttggcaaagaaattgaaatggactcccacacactgctggaaagtgtatgttgataaaaacacttcaggaagaagagtagaaatacatattaagtgttttaccgtgcatatcctttggcccaaataaattcatttttagtgtaccctaaggaaaaaatgaatgtatgggaatatagatcattttaaattaaatataccctcacatagtttataacattaaaaaatggggggataataataggacatcaggttaactgtattttgaagaatctttaatgatgtaaaaatgcttgctatgttgagagtgtaagagctaaagtataaactgttacgatgttatgattccaatatttaaaagtacaaatatatatttataaaatatatatacatatgtaatttttcatgttttctccagttaacattattttatgttataaagtaaaattttaacaagaaaatatttaaccttccaagaaattaaggaaatgcagctttaaaaagaataacactttctcaactattaaattatttcttagtctaaaagttactttatttctgaagtaactgatctactactagtgttttgcagatgacacttcatctctttcaaaaagcaatttggtgatattatcaagatctcaaaggccggatgtggtggctcatgcctgtaatcccagcactttgggagtctgaggtgggcagatcacaaggtcaggagtttgagaccagcctggccaacatggtgaaaccacatctctactaaaaatacaaaaattaaccaggt

SEQ ID NO: 39411 - DNA, 1412 bp, Homo sapiens
gccagccccagtctcacccacaatactaaggcagcaaggaaacaaaagacaaaaccaaaacacaggcattcatggaggagtcccttaatctgacatatgagggactgcattggcagatttcccatgctaacaggtaattcccattaaccacacgtatacctataatcggagacagcaatctcttctttcactcttatcatcagctttggatcaaactcaaaagagttattttattagaagagagtgtgctggacaaaagaacttggcactgcattttatgctcagacatcacaaagttcattcagtgttattgagactcttttaagaattccttgtggactggcagtcaggatcagatgaggcttggtggagctccactcctccatgatctgttttctgcagctctcatgtactttgctccttcggtagcaaatccactgcaagagtggctagacatactgtctaagtggatttgctcaattgatcgctgcctaattgtagagctaatggacgaggaggctgggtcagggcgggcactggaaagttgggtgcttaagtgaagtggtggttctgatgcatcagctctgcaaataaagtagcttctagaaggaagcactctattttatgctgacagagatctctgcccataccagttcttactttgtcaaacacatatttataaaatacatgttatcatggcagaatactttcaaagatataaactgatgatgtatgcaaagcaaacgagccctctgtgtgaccttgaacaagccattagcctctctgggtgtgtcccctgtagacattctcatctgaaaaatgagaagttggaccagatgaggagttggatgtggatgtgtagccgtggactcagagttagacactgtggaattggagccctgactggtagtgtgttttcatttctctagggctcaattttttatttaataaaaagaatacttctgtattttaatgaataggatcaagtgagaaactgctttgtaaaatatgaactatgttcaggtcagcaattatactaattctttctatgatctcatctagtctaagatgccgtaagtgggggggtttttcatgaggatgaaatctgtccgttgccagatggttcaaagggcaagccctaagtcagaggttttacctcaactgctttcaagtcacagataaccttgggcacatgaacccttctcttccttggtttccctacctgtaaaatagggctttggatagggcttccctctcgaaaggacttggtaggtttgaaatgaggcatcaatgagatcatggggttgagtcctggcacctgacacatggtaagactcaatccttcttggccactcctggctgtcattgttacccccactattgatacactactgatgaaggttacattttct

SEQ ID NO: 39412 - DNA, 1056 bp, Homo sapiens
gctggtggcaaagccagtgtattgcacagtgggaacggggtgtggtcaggagacagtgttccttgcccattgcttggtcaagcctgcactgtggggctcgttcattccttgcccttggatgaagtttataatagttccctctcattctcagttaatatctagtccctctaacacatatattttttaattcctctggtcactttcaatcataagaatagcccctaaaattaaaaatgcatatccagttgtatatcaaaaccaaaaactccaaatgtcactcagacttgagctcctctcctcccctgtctgggcctcctctggctgacagtgggaaggggaaggtggctgcttgcttctctgccacccttgtcttgcacttgggctcgccctggcccctcctaggttgaagctttggcatgaaatggtgcccatgtagcctctaccagcagacgtcctcacacttttggcagaagccccctgagcagtacctcatttagactttcctacctctgattccacacctggtctcgggtaccacagacctctgacctctggctggggacacgccctgagccttgccaactggtcttctggtcctcacttgtggcttaagggggaagcggggacgccaaggcgggtggatcacctgaggtcaggtgttcaaaaccagcctggccaacatggtgaaaccccgtctctactaaaaatacaaaaaaatttagcggggcttggtggcgcatgatgtaatatcagctactcaggaggctgaggcaggagaatcgcttgaaccccaggaggcagaggttgcagtgagctgagatcacaccattgcactccagcctaggcaacagagacagactctgtctcaaaaaataaaaataagggggaagcagcttcgcatgctcttcactgggagctgggaggggagctggatgtggcacactgataactttctttgaagaaattctttcccaggttctaacccgtcaacccttttgaagcctcaatgggctaaggcatacaaaatctatttcaaactgctttgcaaaccctccc

SEQ ID NO: 39413 - DNA, 1052 bp, Homo sapiens
attaaatatgaaagtaatggaaagatgtttatgacataaggagagaggaaccttcgcctgtcaggataatagaaattgaaagatttttatgacctggctcagcagaaaaaggagtatatgatgttagcaattttttagaattgatttttcagaagaaacatgcaaaacaaatgagaattaagtagctagaaagcctttttcccccctttattcagataaagtaactgaagacttttaatgagaagcctggtttctgtctttctacacggtgcactgggaatagtaagctgttagaagtcagtgcttagaagtacctaccatcctaaacacaggaaccaaaaacaagggaaaaaaaaaaaaaaaggaagataaataaagtaaaagtaaaaaagtacctaccgtcccaaattttgtatatgatgatgttcacgtttttgaacttacacatattcttctgtataagtaaaatatttcataaaattaaaaatgttttataaaattaggaacagaatttcttaaagatcaacatggtactaatacatcttacaatctgtctttcaaagtttcaatagacttaacttagagtcattttttaaattgcattttgatgccaatataattcatgtgtcattttccgctataatacaatgaaaatccagataatggagatggattttcttctgagtagccacgcatattaggtttcaggctccaattgcctggttttgaattgctctttgccatgtgctgtctgtgaccttgggtgggtcacttcacctcccccaaatctaggtttctccaatacctacctccaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctctgtgagtatacttttttccatcttttttcttttggtaaatgaaactcactgagaaatttgacttctga

SEQ ID NO: 39414 - DNA, 1057 bp, Homo sapiens
ctttaggaatgaaagggtatctaagtggaatgataaaggaagacttcatgcaacagaagaatttaagtaaaactgaaaaactgaaactaatgtgatcatggcattaaatagtgtaaccctgaagacgcatccagtatataaggaacaccacagcagtgcctatactcaccgttattattcatcattattctgaagcatgaataagaacaatttcaaaaattataaatattggaaaggaagagacacattttattatttatgtacagaataattatataactagaaaattcaagagaggcaactgacaacttattttaagtaataaaagttttagtttgctagtggatgcaatgtaaatatgtaaatgtcaatagttttctttttttgttagccataaatacatactgtaatagagaaaatgtcctacttatacatgtcccccaaaggatagaatacttaggaaataagtttagcaagaaatgagcacatagaataaaactataaaactttattgaaagacaaacaacaagacctgaataaatggtaagacacatgacatactcttagatgggaataactggtattaatcatccttcctctgtcaaactaacacctaaattactataaaattactatactatatcatgccacactatactatactgtatttactgtaaaaactgcagaggaaaatgaacttcgtggttaaattaatcacagcatttgtctagattctgcaagaatgaattcatgaggatggatttaaaagctttttcaaggccgggcgcagtggctcacgcctgtaatctcagcactttgggaggccaaggtgggcagatcacttgaggtcaggagttcgagaccagcttggccaacatggtgaaaccctgtctctactaaaaatacaaaaattagccaggtgaggtggtgcgtgcctgtagtcccagctacttgggaggctgaggcaggagaatcgcttgaaccagggaggcagaggttgcagtgagcctagattgtaccactgcactccagcccggcgacggagtgagattctgtc

SEQ ID NO: 39415 - DNA, 1085 bp, Homo sapiens
tacttctgggtatgtccacactgctggagctcagaaatgcacaatgaaaaaacaaaacgggttgtggaagtgtgtatacaatctgttacatttttgaaaaacacataacacaatgctatattctgtttatgcatgtgtgcttatgtagaaaaagtctgaaaacctgatctgcataagctctgagttcataggagttatgaccatgggaagaagtagaggggtgggatgagcgcatgggatactgaactcagctatgctgctttacttctctgaaagaggaacaatcttaagtaatcatggtaaaatgttaatgtttgtccatttcagggtggggaaggaaatttaggtctgtaatttaggagagaggttgaggccagagccaagattggcagttgtgatgagtatgtggttacatcttcactttttttagaactaaatctggatgtcaatggccatgtttagtgggccaggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggttttaaattttttcgtatgtttgagtgtttatgcaaacaaagatgctgaattgtaaacaccagcaatctgagtaccttcttttgatttctctctccatattgtttagtccctttttctttgtttgttttatgaaattgcatagatgttttggttgagagtagattgtttttacttttcagggacaggcaacaatttcatgatataacttctaaaaatattttaaacaagtatgaaaatagttttttcttccaaaaaaccatttcttcatttggcacatacacaaacaaatgagcagaatttagagtaatttagagacagaat

SEQ ID NO: 39416 - DNA, 1027 bp, Homo sapiens
actccttgatcatcatgggttctgtgctacctggtagtccaggatggttgcacaagctccagccattgcatctgtatcccaatcagcaagaaaaaggaagaaaggcatacccccttttcaggaggcttcctggaaatcacatacaacatacctggttacatctcatcagtgaccttagtcacacagccatacttagctgcaagacaagcgaagacattcagattctacctcttcttcttgaaatagaaaggtgagttgccaatccactgtcagcgtgacgacagttcaagaggttttcctagacacagagttgagttaatcccgtcatctgtgtcatcgtctctattttgacagcatctgtcaggtggtcaaccagagtttaggcaagaagacctatgacttctctacacagacatgattaggattatcttctaaatcaaccaaactgaccagcccaccctttcattcttctgtgcatcacagatcatttttgaaaaagagtttaggacacatccaatagtaagagtgtagttttataaatcaggactcagtcttacagtggaagattatatggtagttagtgtcatggagaaaagcttcatattagattagttgaatcgattgggatacagaaccgtctttagagcatggcatcgttacattgcagataaagcatgtaggtagagaatgatatctttgttggggagagccccaaactgctcttcaggaacctttctccgagatttgcaagccaattaggcataatgaaaccttgtttttaatgcatatcttttgccagtataataaacataataattaaatgtttatatatctttcgtattttcctgtataatacaactaatcatatttttgtcaggctgaggacatctcaagaggagggaaaggtggcaaattgagggtctgttcttcttttataccagatggcaattataacaaattacttctggacttagggatgggggaggggtggggagatgggaacatgagaattattcctgatttttgt

SEQ ID NO: 39417 - DNA, 1025 bp, Homo sapiens
aggttaagcatccctaattcaaaaatccaaaatccaaagaagtgctcaaaaatccaaagttttttgagtgacaacatgatgccaccagtggaaaattccacacctgatctcgtgtggcgggttgcagtcagcatgcagttaaatctttcatatatgcacaaaattattaaaactattgtccagggccaggcacagtggctcacacctgtaatcccagcattttgggaggccagggcaggcagatcacttgagctcaggagttcgagaccagcctaggcaaggtgatgaaaccctgtctcctctaaaaatacaaaaaaaaaaaaaaaacattagctgggcacggtggcacacacctgtagtcccagctatttgggaggctgaggtgggagaatcacttgaactgggtggcagaggttgcagtgagccaagatcatgtcactgcactccagcctgggcaaacagagggagaccctgtcttaaaaaaatatatatacatatatatatatagtttaggctatgtctataaggagtatatgaaatataaatgaatttcatgtttagacaggggtcccaaccccaagatatctcgttatgtatatgcaaatattacaaaatctgaaaaaatttaaaagccaaaaatcacttcagtctggtgccaaccatttttgcataattgcattttccatgttgcattttgcaaccattttgcataattctgtacttctttcccttttgggtttgttttcataactgctcagtaaaaagtgttctgtgtcatctttccattattttgggctaaatcatgttaatggccaagcctgtcagaattcatttgttttgagttaacttcctggtgtccagttctcaggagttgcaagaatagagctcttccctcatgcaatcatccaaaatcccaggcctctaaccaggattggggaacaccactgttggccaagagcagaaggcttaaagctctggtcatagtcatggcactgtacaaactgttcttgttccctacaagaaca

SEQ ID NO: 39418 - DNA, 1041 bp, Homo sapiens
ggccctattaccttacccttgggaatttattccaagaacgtaatttgaaagagattaaagcacataggcacaaatattttcagtgcagtattgtttatattggaaacaacccaaatgttcagtaacagggggaacaattttgtaaatcttgctacagcaacttaacaaaattataagctgccacttataattgtaaattttgaaagtttgtagcacagcaaggaaactgatcatgttaaatgtttctgatatcttagttaatttttctcccgccagttccgatcggtgtcctggtcataccgtcagcatataagtatgtatttcataaacatttactttgtattaactcagtagtattcccttcctagagtggtttgcttcccagattgtaatggacaatcatctcacctggggatcttgtaacaatgtgattctgattctgtaaactttgtggggagcccaagattccacatgtcttagaggctctcagatactgctgatgctgttgatcacgaatcacgcattgagcagcaaggtcctagagctctttgtgtatgaagaagatactactgacccagtgcctcgctatcttgaaaggcagctgtgacctttctagcaactgagggggtggggactagaaacgagtgttttctggtgtttctctaataaagctgctgtcttgtatccagattgaccatcagtatccttatgcccttcaactaacttgaaatttgtcagttaacagaaattactgggtggcactaaaataaattattcttaatataaagggtaagaaagggtcgggtgtggtggctcatgcctgtaatcccagcactttgggaggccaaggtgggcagatcacctgagatcaggactttgagaccagcctggccaacatggcaaaaacccgtctctactaacaataaaaaaaaaaaattagccgggtgtggtggtgggttcctgtaatcccagctacttgggaagctgaggcaggagaatcgcttgaacccgggaggcggaggttgcagtgagctgagattg

SEQ ID NO: 39419 - DNA, 1088 bp, Homo sapiens
ataagtgaagaagaaatccgtgaagcaagagcttagcagcgttgttgataagcctggagtcacagtggtgagagaacggggctgatgtattaatatttaatattaccacagctctcgcttttaaggagttgtttgtgagctgggtatatgggcgctttgcacatgttcacctctttggtcctaacatccctcttaggtggaaactggtgatatcttcccattttacagacaagaaaactaaagcacgaagagactaagtcaactgctcagtgtcccatagctaggaagaggcagagctgggagaaagaatatccagatggttgaggtcatcaccctgctctgttcttcagagctaagtactgtgctcaaaagtgtgtgtgtattggaggtctggggggagacatagttaaaggggacagtgactgagtgacccccctgaagagaaagggtgacagtgatgggcataggcacagattccatgccacacaggggacatcatcgctggcacgcagtcagtgtttacggaaggaaggacacagggaattaattggaggctagctcataaaaggtttttcatttttatgaggccattttgtgaatgaggaactagaatattctggactacagaggcggtagagatcaattgagggagaagattttggatgagtgaaaagaaaaatgttccagttggaagctttgagttctcagacctagaggtgttcagcgcaaaatagatgtagccctgctgtgggcaagtcagaggcattgaagccaactcagatggcaggtggccaaggagaccctgggttcctgttctttggtcctgggtaaggcttgccagggtacctacaacccttggcacatgccagagcctttctacataaaccactgtagggagagtcacccccagatcctgctgtgagtgtgcctctgatcatgccatctgatcatgccatcttgccgtctgatcatgaaccaccccactctgcatagcaaaggcagttattttcatgaatgatttcacaaagtgcggctcttttcaaggaaaacatcccaggtgaaaaagaggtcagtaatcagaagaaatg

SEQ ID NO: 39420 - DNA, 1023 bp, Homo sapiens
ttacaggtgtgggccactatgcccagcaaatttttgtatttttagtaaaggcagagtttcaccatgttggctgggctggtctcgaactcctgacctcaagtgatctgtcctcctcagcctcccaaagtgccgggattacaggcatgagccactgcaccaagccccggatacctcctgcttgaccagaccttctgcaaacacaccttagatccctctcaaatctagatgcttctccaacactggcttctaggttctttatgaaacctctgctggccggcagtatataacccaccacccagcctgccaggcacgtcattcagctgtgttagacagtttcgagggatctgcacctgtcatgagcactggcccaaccttctcaaagcatcccactcatccctgtgattctggcaaagcttgccccagctttctttcctcgatggttgaaatagcacccaatgagaaaaaaacagtggcctgtatttattatacttacacatgtcacaagaatccctgtagtgtcattgaaagctttcttctagcatgcaaaatgattgtcactatgatgtaagtttctagaaatgccttatttcatctaaaattatgagagaaggtaaaatgatgaactatcaaagtcacactacatgttggccggctgccttctaccactcactccatccctccccaggctttctgacttaaatttagatcacatgagaccattgcagtggagagagtgtccactttctcaatctaaaagcaagctcgtgaagaccattaaatatgatcacaggaacaaacattaaaggtaccacacgtaatggaccacttaagacagaaaactacgatcttagggtttaggggaaaaaaacactcaaacagcacaggcttccagtctccccagtctctgagaggttgggatttttttttttaataaagtacaagggctccttgaacatgaacacggaacgagcgttgcacctgtattcattcatttcgctcttgtaacacattgatgttcctaag

SEQ ID NO: 39421 - DNA, 1050 bp, Homo sapiens
aaaaattagcttggagtcatggtgcacccctgtagtcgcagctactcaggaggctgagatgggaggatcacttgagcctgggaggttgaggctgcagtgggctgagattgtgccactgcacgacagagtgatactgtcttaaaaaaaaaaaagaaattatagtaaactatatttttttaatgctacaatggataaaaatggttacaactagataagaagcctctaaattgcctgaacacctaagacttatttgctagttgacatctgatctatttctgacactgaaaatttcagtgctttagggtgctaaaaggaaaaaagagggtttgctaggaatcctgcagttgctgagggggtactctgataagggaattttaagcaattacagaacatctcactaaagtttttaaaaaatctttaaccagattaaacttatacaattttgttataatttgtgtttctccaggttccaattgtggacaagataaggaccattgctcaggctgtctatggagccaaagatattgaactctctcctgaggcacaagccaaaatagatcgttacactcaacaggtaaaagttctacttttaggggaaaagaaaaaattcaccttaggctctcagaatactcagcttgacttgaggatttgtacatatcgcaccagctaacctttgcttaatctattgtatggttaacaaagatgaaggtaatatcctcgggtagagtgtagactatatttagaactttatggtgaggcatatatcctctgatccatgcatcatttacttctgtgactataaatgtgtctgatatgggtggtatccctgtttttaggtgatgtgtgatctttcatccctcccactcagccctgaatgttgaagctatcctttggagtagagctgcggagtcagatttagatgaattgcaatgcttcctcttccttacaggcctcttacttactaccttaaaaatgctagcgtggtgccagggtaggcagataggagtgcagcctataaagatgggaatgtttgctgttcttcttatgcaa

SEQ ID NO: 39422 - DNA, 1090 bp, Homo sapiens
aagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactggtgtaacagcttcactagtctatttcactgccccatgctgttgtaactgaagcccccagcacaagcattcccagctcgtggtcatctaagacctttgaggtcattcttacatgcattgctagtgttttccatattccttgatggtagccaatttttccttcttaaaataactttcttcattcctagtaagcttcatatgtattttatgtattcttccctcttttttatgacatgatacatattattgaaagctaggaaataatgcaagattcttgaacgacataataccacttagtacatctttttgtaagagatagtttttctaatacaaatctttgatatgggaagaaacaagcaagttgttttttaaggttttccaaccctatattctactacaaattaccctgttatggtatgcttccaaaattctttcaaggattatggtttatagagttcaataaacctaatagtttataaaacttctcaaaaaataatctcatgccaaaaataatttagtagtaggtggtctttgtcttgtggtcacatggttttgatattgtctttaagtttctataatttacaagggctgtttaatcagttggcataaatttcatgacaaaaatactaatatgtaagcaaagtatatgaaacaatattattgagaagtaaattacattccatgtagaaaaagactagaaagacaacaccaaaaccttaaattagacagtgttattatgagtagctttttttcttctctttttccatatagatcaaattactacattgggcgtatatcacttttataacatga

SEQ ID NO: 39423 - DNA, 1565 bp, Homo sapiens
gaggcgtataatcagaagcagctaagcaatatatgcaagggaaataaaatgaatgcaaaccaagataccggttttgtaaattagatagccaggccaccctcagagtcagtttgagggtatagtgggaagcctgaataaaaagagaagttaaacttttaagaaaagggtcaagctttaaaactggaattgggttttcaaatctaatgagtaaaaagaaaccccaaaactggaattgtaattgtggagaaatataacggataatatctggaactcgcggcagtttacaggcttaactatgtatgtgttccttaaattatccacccgcagatatcagattacaataagtcctcacttaatgtcattgataggttcttggaaactaccactttaagcaaaaagacatgatgcatatgaaaccagttttcccatagtctaattgataggaaaaagagttaagttatgcagccacacagtacctcgtttggcttaaagtcactgtttccaagaacctatccacaatgttaagtaaggacttaccgtatatgaaaatatttgcagtaaattgcttttgagagaattggttatcacactcttctctgggtatcattgaaaattcagaatgtttaattacatcaggctatactcactggtataaaatcagggagcaagtataaagtaggtgtagggaaataatttatgttggattaaatgatccaatgaagggattttattaagcccctagaagtcccagaatgaaaatgtataactgcatgactaacccctaagaatttgctggggtttctgcattaagtacgcttcccaggccatttgtaatgaaggtaccgtgatctgttaaggaagagacctacagctgggaacaaaaagagccaattccatcctagacatcagtctcctgtttgactcattccaaccccaagaatatgttgtagagtgtaggacccatgaaagttacttactgtgcttccctgtaccttccgtcatccagttcccagacatatctgtgtttcttctctgaatgcctagttacttgggatcccatgctgtattggtctgttctcacactgctgtaaagaactacctgagactggatagtttataaagaaaagaggtttaattgactcagttttacaggctatacgggaagcatggctggggaggcctcaggaaacttacaatcatggtggaaggcaaaggggaagcaagcacatcttcacatggcggcaggaaagagagagagtgaaggggcagtgccacacacttttaaacaaccagatctcatgagaactcactatcacgagaacaacaagggggaaattcacccccatgatccagtcacctcccaccaggcccctcctccaacactgaagatcataattcatcatgagatttggctggggatacagcgccaaaccatagcacatgcctttcccaggactggtgatggaggaacggtgcccttgtcacacctaccagaatatactcacccacctccagacactccatttctctttcaagcacacctcttcacttgtgccgccagctaa

SEQ ID NO: 39424 - DNA, 1069 bp, Homo sapiens
ggccgtgcatgctgagcattgagacacatcacaagggagtgaaaacctgctgccatacccccccagaggcagcaggatgtttggataaataaggcataaacacctggagaattaaagcaagtacaattagtgcagcctttgccaagagaaaggtgtaagtgctaaatgcagtagatgttcaaatacggcagagaccacagtgggcagggtaggccaagaatgctgcctaaggagtggggcttggggtgaaactggggcatttgagacactgcaggcccatcaccctggctgcgccctcctgagggaggcagggactgaggcgggaggcctggagaggtctgtgcgtgagcctgggggctcattgataaggagcttccagtgggggcaataacattggaagtggagaggatggcatgtgtgccgggagacgcagtggagtggaagtcgccggaactgacaagggatgggatgtgagcaaggagtccaggtgagtcctggggacctgaaaggatggacccagagagataaacgacttcaaaccggcacggcagtgaagtgactgacccgcgagtgccctgcaccgaggctgacatttgacttcctgccaagttggccatcagacagttagaaatcaattttggagttcaggagagaggccagagctgaaaattggggagttgtttacattgggagtgatatacagtctctacatttccatccagttcaaaacattcttgcgtgtctgctatgcactgtgcactgaggttaccaagactggaaagacccaatccctgtcctggaagcttagtgttggcaggaggcagacaagctgatacatgcaaacaaagggctcacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattaggg

SEQ ID NO: 39425 - DNA, 1995 bp, Homo sapiens
gggattacaggcgcgtgccaccatgcccagctaatttttgtatttttagaagagacagtttcaccatattggccagactggtctcaaactcctgaccgcacattatctgcctgccaccacctcccaaagtgctaggatttcaggcataagccaccatgcccagctggaggccttatttttactgctattcagagaacctgtggcttatccatggagggcttaagctttgccttttctcttgctcatttccatacctagcaagagcttaagctggtttattgcactgacattctaatgaaatataaatagcttctcaacagagagataagaaagaggagtatctagtacagcaagaccctctgggtgggtcagggccagctggggccgtgccggggctctgagtggaggaggtggcgtgggagcactgatgctcgggctctgtcacatccgtttttggcatttgtcctggcaaaggctgcatttctgatctttcagaaagctgtgggtacactgtacagaaatgtgttttgcttgctttgaaggatgacctactggctgacagccagccagaattaattccatatacatttgcagattttcagtatgagagacggcaattagcctacagaaacccatttaacccccgaggtggagctgtatggtgaagactgttatttatgggagtctgtgtaatttgcctctgtgacaagggacagccatggctcaggagggcccacgccaccctccttttcaaggactcctgcccctgcctgagtggcttggcctggcctggccatgtgagtcttgtggacacgtgcacatcagtcagggacccctgtggtatggaccaaagggttgttttttactgttttaacttatttaatagcatctcatcagtattacaggcatgtgccgccacgccaggctaattttttttgtatttttaatagagacggggtttcaccatattggccaggctggtcttgaactcctgacctcaggtgatcaccccgtgtcagcttccaaagtgctgggagtacaggcgtgagccaccgcacctggcccacagagcttctaaaggaaatgtgttggttttttaatcaaagttgaggcagtgcctcagtgaggggcaggctggagcagtggtaagcgcgctgaaggagtcgggctctctgggcccaaagtcctgccctggccacagagtggctcccttccccctgaggtgggatgatgttctccagggccttttagctccaggctgctacagttctaaactggtggtggtggtggtggtggtggtggttgtggtggttgttttagatgcagtctcactcttttccccaggctgggatgcagtggcatgatctcggctcactgcaaccttcgcctcctgggttcaagcgattttcctgcctgcgccaccacgcacagctaatttttgtattagtagagttggggttttgccatgttggccaggctgctctcgaactcctgacctcaggtgatccgctcacctcagcctcccaaagtgctgggattacagatacgagccaccgcacctggccatgattgttgtttttataaaatcagaatataaaatttgaaaatgttcttttttggtgagaaatgagaactaccaaaggagtaaaatgctctaaaagccatcaggtccttcccacagtattgaggctctgctcttaccattttgttaaataagttttgttcctaacactctttgtgatatgaagtattcttgctaatcaagctgcccggagactggcgtttcccagagcagtttcgaaagtggaaatgatgctgcatttcctacccacagtctggagggtggctgtgctctctgcacggtgggtctgtgctgctcagttacgggatggtaagggaaggctctaactcggtgtcttacaccatgcactagggagtcgcccgctttatttacgagcgagttgatgctttcagtgggttttggctttgcctggt

SEQ ID NO: 39426 - DNA, 1084 bp, Homo sapiens
acaagatacacttagttcctccagcattgaactatgacgacacctgaaatattgtctgcagaagaggctcattagagactcagtccccaaggtttttattgggtaatggtcacgtaccaaatttcagtctctcagaacaaaagcaaatgttcagcatagaccattttgtttgtgaaatttaggcacagtgagcccctcttgtcagttagaggatagttgaaaccctcccacaatccaagttctcagactcaggcctgctacattatttctttcctacacagtagtggatttggttactaacatgttggatctgaagcatttgttgtaatttacagtgaagatgtccactgcacagttccgtattgagtctgaggttcactggagacatctgtgctatcaatgaaagtttctggagtcattagcccctcaaagggtcattaaaaccaggtcttctagagagaaagtctaaccctgtattcctttaaaccaccatagagaccatctagttcttcacattataaaaatgagaaaactgagtccccagcgatgtggcttggttgcacatttttctatttcaagtctgttactccttccatcataccagactgcctcacaaaatgacaaagtcaggcattgttcataaaagaacaaaatggcatttaggttataaatcaggcccttgtaagtttggttaatacaacttatttcccaaagatcctggtcctcagaccctcaaaaggagagctgatcacatcaaggcctctacctggaaggaatttctaagcagcctctaagtcaactgttcatgttcagtccaccttgatttacaaagaacagtgaatcattaagacctttctctccaaggccgggtgcggtggctcacgcctgtaatcccagcactttggaaggccgaggcgagcggatcacgaggtcaggagatcgagaccattctagctaatacgatgaaaccccgtctctactaaaaatacaaaaaaaattagccaggcttggtggcgtgcacctgtagtcccagctactcgggaggctgaggtaggagaatggcgtgaatccggggggcagagct

SEQ ID NO: 39427 - DNA, 1047 bp, Homo sapiens
attctaaatattaagcaacattgtaagtacagattttttttttttttttttttttgagttggagtctcactccgatcatccagactggagtgcaatggcgcgatcttggctcactgcaacctctgcctcctgggttcaagcagttctcctgcctcggcctcctgagtagctgggattccaggcacccaccaccacatttggttaatttttgtatttttagtagagatggggtttccccatgttggccaggctagtctcgaactcctgactcacctcagcctcccaaagtgctgagagtacaggcgtgagccaccacgcccggctagtacagaattttttatggccccttttaaagactgcaaacctttttataccaaaaaaaaattatttttcctgtatttattttacacattagtaaatgaatgaaattttggctctaggtttagaaagcaatttcattttaagctcattttactgtgtcattggactttttattaattttattcttgaactacttagctgaaaatcgaattctgtcattatatgtaatcatataatgcttctcataatgttacactttaattagatgcagttgaataataacctaaaaaatcttcatagtctataaaattcacacttatatttataagacaatattatctcacccattgatacataatgttatgttaaaagtacacaatatggccaggtgtggtggctcacacctggaatcccagtactttgggaggctgaggcggcagatcacttgagcccaggagttcgacatcagcatgagcaacatgttgaaaccccgtctctaccaaaaatacaaaaattagccaggcatggtggcgcacatctgtaatcccagcaacttgggaggctgaggcaggaggatcacttgaacccaggggacagaggttgcagtgaacagaggttgcagtgagcggagattgtgcctcctctgcactccagcctggatgacagagtgatactctgtctcaaaaaataaaaagagtacacaatattatctcacccattgataca

SEQ ID NO: 39428 - DNA, 1049 bp, Homo sapiens
tttctattgtatgtttgcatgtataaatacttaccattctgttacagccacctactgtattcagaacaataacatgctatgcaggcttgtagccctggtgcagtaggctgtaccatacagccaaggtgtgtaggaggctataccatctaggtttgcaagtacactgtatgatgttcacacagtgacaaaatcacccagtgatgtgtttctcagaatgtacccgtctttaagcaacacaggactgtgctgtaaatgcaaggtaaccatttcagtaattcaacaacgttatagttaaagagttgtaaccttgttatagttaacaaagttaatatatagttatctacaaagtagataaaatgaaatcattaaaaataatccagaggaagcagaaaagggaaaaaggaacaaagaacagataggacaataagaaaaagaatagcaaaatagtagatttaaactcaactatatcgataatcacactagatataaatgtcctaaatacactaattaaaatgcaaagaatgtcagattggctaaaaatgcaagagccgactattactgtcaacaagaaaccctttttaaatctaaagacataagtaggttaaaggtaaaaggatggaaaagcgctaatactaatcaaaagaaaattgaattggtatatcaatatcaaagtagaactagagcaaagagtagtaccaaggatataaaagaggcttgtttcattatgacaaaggggccgtttcacgaacaggacatagcagttctaagtgtttaagcatataataacagagcatcaacataaatgaagaaaaaaaaagataaaattatagggaaaaatagaaaatccacaaatatagtcagaattttttaaacccctctcagaacaagtagagtaaaaatcaataaggatttagaagacttaaacaatgctacaattcagcttgactccacccaacaacagcagattacgcattcttttcaaacgtacacagaacatttgccaaaatagaccatattctgagtcacaaaatgtcttaataaatttgtaa

SEQ ID NO: 39429 - DNA, 1074 bp, Homo sapiens
aaaaaaaaaaaaaaaagactgaccataccaaatgttggcaaggatgtggaacaactggaaccctcatacactgctggtaggaatatataacagtaccacccccttggaaatcaatttggggtcgtttcttaaaaagttaaagtgcacctgccatatagtcaagacattctctttctaaatatttacccaagagaaatgcagtatatgtccatgtaaagatccgtgcatgaatgttcgtagcagcttttttgtaataatatacagtaagctttacactttgacatgtgcagtttattgtatgtaatttgcctcaataaaagttttaaataatacaattttatccaaaataaagttgtgaaaagtagaaaaatgaggaaaaagtttcaaaggttagaggggtcagtccaggagacctaacatctaactaatgggaattccaataagacagaagaaaccagaagggaagaaattatcagagaaataatcctcagccttccacccaaaattttctctcctagaactgaaggactcccaaatcaaaagggtcagcaaaataaatgtatagactcacaccaacacacttcatcataatagtaaaaagaacagtagagtcaaaaagaggatactaaaagctttcagagggggaaaaaacaaaacatgcaaataatctggaacccgaatggcatcagacttttcaacggtaatactgggctgggtgcagtggctcacgcctgtaatcccagcactttgggaggccaaggcaggtgaatcacctgaggtcaggaattcaagaccagcctggtcaacctgatgaaaccccatctctattaatagtacaaaaattagcttatttcttaaaagccagcaagggggatggttttttccttgggctggtggcacgcatctgtaatcctagctactcgggaagctgaggcatgagaattgcttgaacttgggaggtagaggttgcagtgagccaagatcgtgccactatactctagcctgggcggcagagtgaaactgtgtcttaaaagaaaaaaataaataaaagttatcaaaaaacaaaaacaaaac

SEQ ID NO: 39430 - DNA, 1060 bp, Homo sapiens
ttaaattgtatcgtcagccaggcgcaattgctcacccctataatcccagcactttgggaggccgaggcagacgaatcatttgagtcaggagttcaagactagtctggccaccgtggtgaaaccttgtctctaccaaaaatacaaaaattagccaggcatggcggcgggcacctgtaatcccagctatttgggaggctgagacaggagaattgcttgaacccacgaggcggaggctgcagtgagctgagatcacgctgctgcagtccagcctgggcgacagagccagaggccatctcaaaaataaataaataaataaataaataaataaataaataaataaataataaaattgtgatgtagttaactggtataatcttttcagttatttttaaatttttgaaacaacacgctgtatatcagccatccatcagagaaggaaagaaatatgtagaaggactgtcttctgcttcagatcatgaactgtaggaacaaaatagatatgtgtaaaaatgctgctccttttctgaaccaaaataaaattagatttttgttgttgtggttgttgttggaaaaggtagtagatttcaggcaaaatcagaaaataaattatttcagaaacacaacaaaactaagtacaacgatattttggttaagaaaattatggttagaaattatgattctatcactttatgaaacagaatctttaataatttttcagcttataccaaggatattcttttatttcttaatgactagttttaaatatatgactattctctctgtacagatttttaattaatgctcataaaggctattgatagaactcattctttctccaaaatggagttaacccgaaatgggtagagattcagaagcttcattgtagttaaaattagggtcatgaagggcaaaagcccaggtatttcagcctttgtagaagaatccattaatgcagcattacaagtaagtgtaatttagtggctccttagttattttaagcaagaggcctccttaaagggcacacagataaagtcaacatagatctccactgaccccaggc

SEQ ID NO: 39431 - DNA, 1175 bp, Homo sapiens
gcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaccagcaagttttcagtgccagataaaactctgcgctctagaggtaactcctcatgggaggcagctaggagtgttacctgacaccagtttcctagaaaactgtgacaagcaaagcaataacacacgtcgagaaatatctgatcaagcgggaaatcttctgactgtcggggatctctagtaagatctcttggaatgaagtgcactgtgtatccaaaactattttccagcgccagtgaagttgctcttacctaaaacaaatgggtttatgctagtttccaccaaggaatgagtctcgatggccattaaactttctaaggcccacagggctaggaaaagtcgctcttaaaggtcaggtgtttggaaaatgtttttccttttgcccaacccttaattagtagtagagaatgttctgtggcctattcccctctctgggagttcctgacccttctttgttttccagtttttcctacaataatataaaattacgtaaaagttaaaacaaa

SEQ ID NO: 39432 - DNA, 1036 bp, Homo sapiens
accctctccctttacagtaaatttgtaaacccttataatcttccaatagatttatacattgaaaaccctatatattccactcagaaagctgtctttttttttttttttttttttttttttttaagataggggctcactctgttgcctaggtggagtgcagtggtacaatcatggcccactacagccttgacctcccaggctcaggtgaagcccccacctcagcctcctgagaagctgggactataggcacgcaccaccccacccagctaatttttgtattttggtagggacagggtttcaccatgttacccaggctggtctcaaagtccgggactcaagcgatccgcccgcctcagcctcccatagtgctgcgattagaggcgtgagccaccgtgcctggccgtgaattgatttttaagcagttgtcttctgctactcatgtttttattcttttcctctgcattgaaaggttaagtttctatttttgaaaacattttttaaataaatattttaggagtctccattcaaaaagctttagcctagggactcctttccttacctacttttaccagacaactcctcaactcaaaatgtaagtaaacatcctgcacaccagtgtgggagagttttccactgctcactttggaaggactatcatccaggtgctgctggaaaccgcaaactgtttcccatcatgtaggctcattcgaagtcctctgggtgtcataactcgggctctgatggagttgtttttgctcattcactaccctactgatggtagagtgtatttgactccagctgagtgatatgcagtctccactaagaagaaacgttaattaatgggctcatcaactcctgatgacttgaggcattcatagagaaaaagaagtattattatggggagtactgggaggagccagttatcaaccatcttttctgaggccacagcatgagaaaagaaaaatcacataacctttggcatggtgggtttcagttagaaatcttcccaagaagagtggatattgatttctttctg

SEQ ID NO: 39433 - DNA, 1031 bp, Homo sapiens
cccacaagactatagactggaaagaaaaagggtgaaaccacgagaaacaccagcatggaattatagatagaggtagacgaatcagcaaaggaaactaggataaaccaggcgtgtgtctccgaggcgaagaaaggaagggttccagaagaagggaatggttagcaaaggcaaatgccactgggagtccagtaagagaaccacagcaaatgttcgttgggtttggtagtttggtgtttactgatgaccttggcagtagccggttgctgaagcaatgaagacagaagacagatcatatgggatgcagactgcatggaaggggctagagggacagagcatttatgaactgagaaataagccagggagagacagagagagagactgaaagagtaaggccttgggaggagctggaaaggccacttgagaataacagaagggaaggattaaccttgaataggaaaaatgtctcttcctcccagtccctgagaccggagagaaattgtaaggatgatgtggatgtaaacaagttggcccaggtgtggtggctcacgcctgtaatcccagcactctgggaggccaagacaggtggatcacttgaggtcaggagttcaagaccagcctagccaacatggtgaaaccccatctctactaaaaatacaaaaattagccaggcgtggtggcccatgcctgtagtcccagttactctggaggctgaggtgggaggatcgcttgaactcaggagatggaggctgcagtgagccaagatcgcaccaccatactccagcctgagtgacagaataagactccacctcagaaaaaaaagttagggagtgtgcttatgggtaagtgtaagaggacactgtgggaaattgagagaattcacaaccaatggtctctattttcacccactgaataagaatgtattcgtttcctgtggctgcagtaaaaaaatagcacaaacacactgggtggcttaaaacaagacacttatcctctcacagttctaaaggctcaaagacagaaatcagggctat

SEQ ID NO: 39434 - DNA, 1050 bp, Homo sapiens
aaccagtgtagtcctattacccccatgcttagcactgtctgaaatgtcctctccctccctcccatccttactttttttctgatcaacacctcttcatccccacttcagcattccttccgctgtgaagctttgggagactttctcaggttgagctaatcagctcctcttttgtgaccttctggtacttcctattcttctagttagagcagcggtctcatgaatagactcctatttcctgggttatctccctcacgaaagagttgtcttgaggggaggagtatggtttgttcatctttgtgcttccactggttaacaaagtacctggaaaaaaataggcattcaatgtgtgtgctgtggtattgttgaatgcggtagaggatggctgagagaatgcagagcctgagtgcagaagcggggctgcaggtgctgggggctgaaccagggcagcagtagtggggatggagatgcttaggacagctggtcctaaatcctggtcattattaaatcgccttaggaggctggggaggactttaaaatgcagatgctcaggctacttccagatgtactgactcagtctctagggaggggactccacatctgaattcattagaagtcctttagcagggccgggtgcggtggctcacacctgtaatcccagcattttgggaggctgagcgtgtggatcacctgaggtcaggagttcaagaccagtctggccaacatggtgaaaccccatctctacaaaaaatacaaaaattagccaggcatggtggcatgtgcctgtaatcccagctgctcgggaggctgaggcaggagaattgcttgaacccaggaggcggaggttgcagtgagccaacgtcacagctctgcactccagctatctcaagaaaaaaaaaaaagtctttcaggggattcggatcctcagacaagtttggaaaccactgacataggtagtgtcctgagtcaaacttggaggacacatggaaggcagggaaaggggggaaaagaaagaggagtctgggtcctaggtttgcccagcatggatgatga

SEQ ID NO: 39435 - DNA, 1024 bp, Homo sapiens
taaacaagcttttgattactcaggcttaacgtttagatgcactaaagcagaagtcttggttttatctatggttcatttctgtaaaatggaaggagtctttatcttctattcaatcttttgtaatctttattttttccgttagatccagagatagactggaaatcttttacagtctttatatgtaagatccaggcgggggcagggggaatggcttggtctgttatctgccagggtttaattttgagacatggccgtttcacaactgcagggtgcgggaagattagatgacctgaatgctggtggtaagtaaagcctcacacttcacattattccttaattgtctgtttttaaaaatttgtcttaaaaaaatattaaggtggcaacatattcaggtggcaacagagggtggggtgaccagtgacaaactgacttccatgtctctggctaatcttgatttctggagccaggctccagactaagtctggacaatcaattaattagcctttctatatgtattgcctgatgaatgatttcaatgctggacattgaacaatggtctgttgcaacagggtgaggccattgtctctggcaggtggggagatgggggctcttgttagctccatttgattacaagagccttgaatcaccaaaacataaagatgtactcgaatagaagagtccgttgtctgactggtaaatttaaggatgtgtttgaccctcgtgcattaaaacagacaattggccgggtgcggtggctcacgcctgtaatcccagcactttgggaggctgaggcaggcagatcacaaagtcaggagatccagaccatcctggctaacacggtgaaaccccatctctactaaaaatacaaaaaattagccaggcgtggtggcgggcgcctgtagtcccagccactcgggaggctgggacaggagaatggcgtgaactcgggaagcggagtttgcaatgagccgagttggcgccactgcactccaatctgggcaacagagcgagactctgtctcaaa

SEQ ID NO: 39436 - DNA, 1041 bp, Homo sapiens
agacagggtttcactatgttggccagactggtcttgaactcctgacctcaagcgatccacccaccccagcttcccaaaatgctgagattataggcgtgagccactgcacccagcctagctcccacttacaagtgataacatgcagtatttgtttttctgttcctggcttaattcgcataggataatggcctccagctgcatccatgttgctgcaaaggacatgattttattcttttttatggctgcatgtcacaacttttaaatttacagtatgtgggaagtgccttagattatcctgatgaaagatttcatatttttaatctccttattaagttacatctgtctagacttgctgatactttggggattgggtggaagagaaagaggagtagaaaatgaggataagtaaaatttttttgcattgagcacactttggatggatttcattgttcaaataattctgataatttgcattagatttagtttttattttttggtctccagtaacaactgtttgtagaactaatttctatggcacgtaattgcatgtggagctaaccctcctggggcaagccacttatgcctacaaactctcccttaaccatattttctggggccagagacaattggactactgtggagtgaaaagctgtagattattgtgtcctcaaactctctgccgctcctgcaatgaatactggaggtattgtaactgtatgtgaacttgaacgaagatcaggggaaggtcacacagagccttcttgaatggagttgcaaattcttcctctggcaaatacaagtaaagggaaatgtcacgagtttgttgctttttatggtcatgaagagggaaaaatccccaaagcttgtgattcctttgctgtgagctgaccagctggcttttttcagcattggagaagaacttgagaaggacactgatttattttttccttgagtctgatcactgacagtctcatagaaaagcaaataactatattctgagactgtaactaaactaaacttttaagaaggttgtttctttgt

SEQ ID NO: 39437 - DNA, 2209 bp, Homo sapiens
tttcaggttcctggactccaggatttgggggactggactgatgatggtgattctgcatttcaccaaagtgatttgacaaaattgagtcattcagcagctctgtctaaatgtgggctgatcaaaatatctggaataaatgtaattgatcatcctggtcagagctgtctgctgtaaaactctccttggccttgccagggttaattctttatcaacttgcatgagaagtgaagacggacatctcaaagtgacaaatgatttaaaaagttaaaagttaggatagatagctgatgctggatcacatatttttctcttctttcttttttaaattttttgatctttacttcaattatcttctgtcattgcttatttctttcactactcctatttaaatatttttcaaacttagatatggtgccagcattttggtataaagaggaaagacagtgttagctctcagtgcagcagagcagtcagacttgaagatggcgtaaggaggaaggcactggatctgtggaaggacagaggagggaggagtctaggtagaatagaagaaaaacaccctgatgaaatgcatcaattcctgtgcattttagaagatcgaattataaagcaatttggcaacatgtctcaccatataagtgttcatatcctttgctccagtgctgctaattctggaaattcaacaaataaataacacaggggaaggaaaactgtattccataaaatgtttgttacaaatgtttgccatagccttgtcgaagatgttgaaagatcagttcagtgaatcatgtatggtacatatacctgatcattgtcattcaggggcacaggagaaattttagctactaggagaaatgtttatggctgtgaaatgggaaaatatgcaaaactgtattccacaatagtaattgtatttaaaaaacgcatgtatgtggctgaaggttgaaaggagatactcaggaggctgaggcaggagaatggcgtgaacccgggaggtggagcctgccgtgagccgagatcgcgccactgcaccagcctggcggacagagcgagactccatctcaaaaaaaaaaaaaaaaaaaaaaaaaaggagaacatgaaaatcacaaagtgttggaatgatagggttttagattgtttcatcttttcaaaactttcatttctctttcttgagattttgtaaaaaaaaaccagcagacagatcaacgggaaggaattgaggatgagggagaatatagcttataagtaggggagaaggttaaaaattagctgggagtttaattgattttatattcactgtaatctcaactgtgagaaggtggttaatatagagcattttgaatagactcttatgccatattaatagaaataacaccatactgttgtttgcaccagtcagcatctatttggactattgtacttaattgacatagtcacattttaatgtcaggcattgctgcattaaagtcagacatgtagattttggaccttaaaagactcattcagttttcagctgtttgagagacagttgtcaaagcatcagtagacacatcacagtgtggaagagtccacagaatgccaaaccctggccaacagagagagggtggggtgtggagtagggctattgggtggttttcagagcaccaatccatttcctctgacgatttttgcaaagacagtcatagatatgtagaacaaacaacaagattttgtgtctatagttattatttaccatttctgatccctgttttcaggacctattacatttctagaatgtagccataaaaagacaccatcgctatgtatcactatggttaatgaaggcttttcataggcaaaaaatagcagggataatggcaggaagttacagtgtgaaaggttccatggaaggtggatgtggtttcttcaccggatttttccattgccgggagacagacatcgttcctcaggcacccaaacctgtctctctcggcgtttgctgatagagtgggctgaatggtcatcgtccttgtgccctcttcagttgccctgactcctatgcatgctccttgagtgtcaccttcctacctgacagatgccatacccttccatccccaactcccattttatcttttccttctaagctggatctaggaaccctcacgggacccacaagtaaccgttattaaaacagtgtgactgctgggtggggtggctcatgcctgtaatc

SEQ ID NO: 39438 - DNA, 1034 bp, Homo sapiens
tattcatttatgcttgtgcaaatatttctataggactaattcctggatgaaagggaatgccccacccttccacccttttctatatgataaatttctgacacatttacttgttaaccaaggaatgacttaagtttcaaaatatgcttaatgcattcagctttcaatagctcacagcacacactgtatataaaaatatggaacgctttacaaatttgggtctcatctttgagtaggggccatgtatcgtttccattttagtgtctgtgctgccaaaccaaacgagcgctcttttcttttctttctttttctttttcattttctttttttttttttttttgagaaaggaccttcctcttgttgcccaggctggagggacacaatcacacctcactgtaaccccaaagtctgggctcaagcgaccctcccacttcagccccccgagtagctaggactacagttgtaggccatcacgcccagctcttttctttttgaaaatattgtaatattagatactttacggaatactcacaatgccccattttggcaatcatatttcacaaacctttgacttttgactgagttgcagttagcttgaaacactcgcgttttgctttcacttagagaattaccatttcttatgtgtaattctaaagatatatacagttaacaaggtcatgtttaaatttaccagtaaacacattggcagcttctttccattctgcaggaagtggctgtgtttctgtgctttcatcctgttatttccttagggtaaacatctaggcttcatgcaaagtagaaggggcatgtgcgtggtgttcaggatgtggatttgaatccccaactcagccacttacattagataagtgacttaacttgcgagcctccctctacaaactggatgaaggttgctaaagaatatgtttttacaagttgtgctaattttaatgctactgagaacaaatgagtgctcagatttggccacgtcagtgatattggtagtgttactttgacaggtgaaggatggtgttttaagt

SEQ ID NO: 39439 - DNA, 1074 bp, Homo sapiens
aatttatgttaatagttgacttattaagaacttaatatgttcctggtgatgtttccaatattctttgaggtatataaaaatgaattcttggccaggcgaggtggctcacacctgtaatcccaacactttgggaagccaatgcgggtggatcacttaaggtcaggagttcgagaccaacctgaccaacatggtgaaaccccgtctctactaaaaatacaaaaaaattagccaggcgtggtggcacttgactgtgatcccaactacttgggaggctgaggcaggagaatcacttgaacccaggaggcggaggttgcagtgagccgagatggcaccactatgctgcagcctgggcaacagagtgagactccatctcaaaaaaaaaaaacaagagagaaaaatgaaaaaatttttttctttttaaaagccagtcaagtttagcagtgtagggttgtataccgactttagtaacactgatgttaatttctgataacccactaccatcggaccagcctaaaaatgaattcttaactccattttacagagaatggggaagatatgagggaggtaagaaatgtgctcaaggtcgtgaaagtaacttccttaaggcggaagcaaatgtatatgaaacacacttgtgaaatgggtacataatgcataggatacatgtgttctctgtcaggagcctgtagtggcctgctgtagaactgtgatatgcttggctccgtcccgttcaatgtttttgatgaatggcttagctgaggacattaatatgttatttacatttggagatgatataaacagaggagttaaagctccagcagtgtggcctgttggcctagatgatcttaaaagatttatgaaccctggcaagcaaggttattaacatgcttgaagcctaagaatctatgagttttagggttcaatgtattttcacttctacagtgataaagtgagtaaaaaggaaaccgtgtctgttctcccaatttccctctaagaggataaaaccaaacaacaacaatgccatagaggtaaccattattaaagatttggtacatattgttccagactttaaaa

SEQ ID NO: 39440 - DNA, 1047 bp, Homo sapiens
aggagccctgaacggtcaaggagccctaaacagccaggaggaagaagaagtcattgtcacagagggtaagccgcccctccaggaactggaaggcacacagcacttgcaacaaactttggactcagcagaaaatactctgtcatactgcctggtggtggattggtgttaacagcaaaaacaatcaattggttacaaaaggaagtatttatctgaccatttggataccccctatacttagaccttgaagttatgtttcctttttcttatctggaacttgatgctttttaaattattgttgctttgtcccaactgcttgtctggagttgaatgtgaattcttgttggaaacagaagtcatggttgctttaaaagagtcattatctctccctctagagaggagcctgctatacttgtacaactctttctgataggcgcattgcaaggcacgtacccctctttgcttaaactatgatgtgctgcgtgttttatagctcttgagcctagagatcttcgaggaatggttattgaagagtgaccgtttggacacagtattgggatttgatttttacccatatagggggtgaggaaccgtatcttgaggtcagaattgagagcatgtggcccagtaagtctcttgtgaaaagcgaaaggctgcatgttgaagaaggaccttgagctcgttgttccatttaattataaataaagggataaccaataactgctatcaaatatatgtaaaatgatgattcggcatacggtaaattgattcgtgtaatatgaataagagagacaaatgaagggaaaagtcctttcacaggagattcaacatcgcctcacttagatgagattcttcaaacatgtggaacctgtttttcttcttgtttgatgcccccacagagctgcttcaagcagggagctgcttttgaagttggtgggaatacttatctgtatatagcaccacaggcacaatataaagttagaaatatacacagtctcacaggcggagtatttgcatgacctagtgtgagagtttcaaataattttcacc

SEQ ID NO: 39441 - DNA, 2305 bp, Homo sapiens
gtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaagg

SEQ ID NO: 39442 - DNA, 1049 bp, Homo sapiens
aaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccatt

SEQ ID NO: 39443 - DNA, 1045 bp, Homo sapiens
ctaaagtgctgggattacaggcatgagccaccgcacccagccctatctttgttttttgtttgtttgtttgtttttgagacagaatctcgctctgtcgccaggctggagtgcagtggcacaatctcagcttactgcaacctccacctcctgggttcaagcgattctcctgcctcagcctcccgaatagcagggactataggtgcatgccaccatgcccagcttatttttgtatttttagtggagacagggtttcaacatgttggccaggatggtctcgatctctttacctcatgatctgccctcctcagcttcacaaagtgctgggattacaggcatgaggcaccgcgcccggccccatctttgtttttttaatggagttaaactatggtattattaggtcactttgacaactatcctgttgttaataaatgagagagaaaaaggagattttatttacgctgattcttcctcctcctacagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgatt

SEQ ID NO: 39444 - DNA, 1982 bp, Homo sapiens
cggcggcggcggggcttttcctgtccggttacgttaaggtcacatgaccgagagagcggagagactagtgcaaagaggctgcgagcggctcccgccgggggggagaggcggcgagagagcagtggcggcaagagccccctccgccccccccccagccgctcccctccccccgcccgcctccgcctcctgctgctctgccgccgccgccgccgcctgcagcactccactgccgctcccacccaggctccgcgctctgctccagccaaacttctgcagaccatgtgcagccgaggcgaggaaacttctctccacctattggggctggaggcctgagtcacaagccccttgtttacataaagtgtttaggtagcacaagtccttgagatgctcggggtagagatggagagccactgctcgtatccttctgccggcttctgcttgagatctcttggcctttacccttgtcccttgacttttcgtgtttgttttaatctttaagacttgaaatggagtggcctttagaaccggggagatactgtaaaccagcagtatctttgtgtcaccaatggtaactgaaagtcatgctgaagtacagattcctgtagcgtgcacagaggcagaggtgcttcctttaccttgcagatgagttgagcggcgtaagatgtttctgttagggttgaatttcatggttatttcagcaacgattttcgtttttgaagttttggcccccccaaaaatgaaagtctgcaacgcatgtttgttaagagaacagtttattctcctgttaggttttggtctttgaggtatggattccagagttggctattctgttagatttagaggtgtggaaaatcttttaacggggagatcctgaaacacggaaacatggcagggaagttagaatttcctgatggtcatttttaacattttaaagtttactttttggttgttgccatttttctagaatccgtgtcttttttggggaaatacagtcctttgaggactagaatttaatgatttctttacacatctaggattttttgagatttagaaaggatatggctttattcctaaggaagtggaggcagcagtttctaggatactctggtttcaaggcatgctaacttggttgtgatgtctaacccattttggtttacacagtctgaccactagcacaatgcctggcacatagtttacaaatcatttaaggcaagcttaccatcttaagacaatttaatacatagaagtgtccctcctaaaaatctgagtttgatttagaaatccagttatacctgcaggtactgatgactaattccttctttgaagacaaaataagcagctgtgtagcttcagtggctctcaaatggataatagattcagtgtatactcgctttgaactttcctgttttttgatcagctagataaatgactttagtgggtaaatgtctgcctccaaaaccaaattctgaccctgatctaagtattctactgcaccgctgtcactggaatatcaaagttggccttcagactggtgcctggttccttggattggcttgagtattgaggtctgtctcatcttactagggaactaaaatgatgttgattgttttgtagagaattgtaattagagatctgtaggttcttaattcttttggaattccattctgaaaattttcaaccttatggtgttggtggagtgctcatgtgaagagtgaaactgacttaagaataaaagaaaaagtgggcaaaactaatgctaaacttgagaccattgggcagaaatttgcctgtgtgtgtagagtaattggtcttgagtcaaagtaactatgcttatttttaacatcactgaatattttctagcgttacactctatataggcttgtagaaataaacccaggggtaagcccagaaattgaatatcagtcctaaagaaagcctatcaagagcatcctattctctttaagagctgctattcgaattta

SEQ ID NO: 39445 - DNA, 1050 bp, Homo sapiens
ttttacttcaaagaaaatcacagtgcaagcaatctgagtggattcatcaaaagttatacatgaatattctgcagagtctggtgttgctgaaagttttgatttgtgttctgctgagacacaaccatgaaaatatgcacttgcttgtattccgaagaggatagttccagtgagacttggacaatgagcagaaaaaatttttttttgagacgaggtgtcgctgtgtcgcccaggctggagtgcagcggcgcgatatctgctcactgcaacctctgcctcctgggttcaagcgattctcatgcctcagcctcccaagtagctgggactacaggtgcccgccaccacacccggctaattttttgtatttttttttttttagtagagacggggtttcgcagtgttagccaggatggtctcgatctcctgacctcgtgatccacccgcctcggccttccaaagtgctgggattacaggtgtgagccattgtgcccagctcagaaaatttaatagtactagatctcgtgtgtgtgtgtgtgtgtgtgtgcgcgcgcttaggttgaaggtggaatttaacattgatttaaaaaaaataatagtaggaaaaaataaatgcggtttgagtccaaagcagcatttttcactaattttatgaaggaagtccttttgagtaatgtcttaaattaggaaaatggcgtacttttacatgttagacattaaactctagggcagataaccatgccctgtgtgttgtgtatcaagcttagcatatacataggaaaagatgtattgtgagagtgtcttacatttcgttggtttggtcataaagtttatagaaaatgcttgttttatagttggttgttattgagatgagagtccctcaaggaactccctatgctttagggagctttttgttttaaacctactggttagacttgtgggttttaatgttttcagctgtggttgtaagaaacacattttaaattgcacctagtatagacatacatgtaaaacaaacaaaatttttacgaagtagtacttgtattaagagtgatg

SEQ ID NO: 39446 - DNA, 1025 bp, Homo sapiens
gacattggtagtgagcgaaggcaggataaatttctaaagacttccttaaaaatttttttaatccattaggcttttctaaattataggttgggatacaataagttatcttacacctttgcttcacggaatgggctaatggctacttttttttttttttttttttttttttttgagatggagtcttactcccatctcacaggctggagtgtagtggcacaatcttggcttactgcaacctccacctcccgggttcaagtgattctccttcctcagcctcctgagtagctgggattataggcgtgcaccaccacacccggctaatttttgtatttttagtagagatggggtttcaccatgttggccaggctggtctcgaactcctgacctcaggtgtgccacctgccttggcctcccaaagtgctaggattacaggcatgagccactgcgcctggccggataatggctacttaaatcatttttcagttttcccttaccactatgattcctgactgtttctattctgacctaaagtactgtttgtacacaattaattttgattaccctttttgcttgttacttgtctccctatatcttgtatctctcactctcactgtaagctccctgagggcaggtacttctttttatgtacactcctggtactcaattgcttgcagaattgagttgaatttgtagttaaaggatctaagatgatcattttcccactcgaactgagtgaaaaaggtgtttattgttgcagaaaacatctgcgtataggtattggatgctagtggtgcatatatgaatacctatctctgctcttcaggtggtcacagtccactgggggagaaaaacacagatacttagtacaatttattctatactgcagatgtgcagagtgctgtgggtatgtagataactttaagctgaatcttggtcggtgagcaggtgttcagaagatagacttagtggccaagtgcggtggctcacgcctgtaaccccagcactttgggaggccgaggcgggtg

SEQ ID NO: 39447 - DNA, 4586 bp, Homo sapiens
tcaaatagggttaatagtaattatctcataacattgggtgaacataaaaacaggaggggggccgtagcacagtacctcagtaaatgataaaatcggtatatttttgaaatcatcactgatttaaaaaaaaaccttagaattatgtagtaaaagtgacttttttttttcagtataccgttctgtgatttttaacatagtatttatttgttgtaatcaccaacacgagaatataggccaggtctatcactttattttgctgtctttatagacctgtgctgtttccacccctaacccctggctgtcaccgatctgttgtccatcactatagttttaccttttctaggatgttacataaatggaattacacagtatgtcgcctttgcacactggcttcctttacccagccagattgggttgagagcgatttgtccaagttgttacatctatcagtcgttgaaaactgatctttaaagacattttaattttgaatcattatttcctaaacgtgaatctgaattccttaacagttcttcaagtagtgtttggctcaggatttttgtgtttaaaagtaaaataaatggtaaaatatatagggaaaaattactgcttccacctgattggtaaaaaccatgtgtgacattaacatgcttttctttagggaaggttcttgtttttagtagttgatccatattaaagctctgtagagttgccacaaagtccagagttgaaaaaggtggctgttaaaatatcagtttctaaaatgtggccgaagatagcgtgaccagtcctggtttgcccaggactttgccagtattagcagtgaaagtctggccgctctcaggaaaccccttggtcccagtcaaacccagaatgggaccaagcgccgtggctcattcctgtaatcccagcactttggaaggctgaagtgggcagatcacgaggtcaggagtttgagaacagcctggccaaaatggtgaaaccccgtctctaataatagcctgacatggtgatgcacgcctgtaatcccagctgcttgggaggctgaggcaggagaatcgcttgaacccaggaggtagagcttgcagtgagccaagattgtgccaatgcactgcagcctgggtgacagactgagactgtgtctgaaaaacaaacaaacaaacaaaaccccagaatggttggtcaccctatctgaaaagagacacacaaaatcagaggattccagttcatcaggtttcagtagtgaaccatcggccaagtatttcatctaatcttaattgcctttgggtgcttagagtcaaatctctaaggtaaccagaacccaaaccacatgaggttttttagattaagatcagcaccttgaatttaaggttttgtggctagaggtttagatttgattggaattacatcgttaatttttgttaaattgttgaataagcaacttcccaagccttgtgtgtagaagctagattaaaagtcaagtttctacttaaccagaatctctgttttgagtttttaaattcaactggtgatgtctaaatcttaaggatattgtaagttccttaactagtctgttccattttcctgagttttcacatcacctctctacctcttgtgtagattttattttttattttgaaacggattttcgctcttgttgcccaggctggagtgcagtggcaccatctcggctccgcaacctctgcctcctgggttcaagcgattctcctccctcagcctcctgagtagctgggtttacaggcacatgccagcgcacctggctaatttagtatttttagtagagacggggtttctccatgttggtcaggctggtctcaatttccggacctcaggtgatttacccgcctctgcctcccaaagtgctggaattacaggcataagccaccacgcccagccctagatttctttatagagcatctgtctataagcagattacttagttttcctgatgtcttcgttggaatgtaagctttgtgaaagccaggggccctatgtgtcatctttaccactatgtcttagatcttagagcagcccatcataagttctaataagtaattgtggaattggatgagaaaatgaatatgagtcagttttacaatgctgcatgcttcccagattattttaacagtctaggggatgtggaaagattttgttttaaaaacgtttaaaagtccacgttttgtttgatattgttcagaggaagtgaaaatgtggtctttaaaaaattttgttgcccgggtgtggtgactcacgcctgtaatcccagcactttgggaggctgaggcgggtggatcacctgaggtcaggagttcaagaccagcctggccaacatagtgaaaccccgcctctactaaaaatatcaaaaattagctgggcatgggggtgggcacctgtaatcccagctgctcgggaggctgaggcaggagaatcgcttgaacccgggaggcggaggttgcagtgagcggagatcgcgccattgcactccagcctgggccacagagcaaaactctgtcttaaaaaaaaaaaaaaaaggctgggcgcggtggctcacgcctgtaatcctagcactttgggaggccgaggtgggcagatcacgaggtcaggagatcgagaccatcctggctaacacggtgaaaccccgtctctactaaaaatacaaaaaattagctgggtgtggtggcaggcacctgtaatcccagctactcgggaggctgaggcaggagaatggcgtgaacctgggaggcaggcggagcttgcagtgagccgagatcgtgccactgcactccagcctgggtgaaagtgtgagactctcaaaaaaaaaaattgtttcattaaccctctatgagggaagggaatttagaatggtgacattaaaccttcctttaaaatggcaattcagaaccagtggagagagctgaaagtgagagtagatttggatttggaaaaattccctctacttctcatacacatcaccttctcccaacacaggcactttgtaaaggcatagagcagggtctgaggagattgggttggtgaaagagagaactgagtcacttgagattagtacttggtaagcaagagagtgctaatgaattatttaaaatctgtgtaacctgagtgtaaaccaatacatagactaagttagtgcttctcagagcttagggagcataggagtctcctggagaattagaagaaacagattttcctagctccggccccagacgttctgatttagtgtggtgtagaactcaggagttagtaatattaatggacagtcttgagtatttgctgatgcaactggtctgaggaccatactttggaagacctgctttagatagtagacaggacagtaatttaaaataggcaaatatggtttatttttaaaatggtaaaactagaaagatactgattttatgtgtttaaaaaaaaaagtctgcatctgactgctatggttatccaagaaggcaccccagaatacctgttggccaccgctgtttggtatatgcaaaaatgtgtagtttttaaaagagtctttttgggcttgcactgaggagccaccctattttatacagtcaaaatattgctatatttaagttaaccattctgttccagtgcaggattcagtaacatctattctgtaagtttcagttgtgatatttcttaaagattcaaagatggatcctgggaatttgatttagcctccatttcatctgggagttaatcctcacagcaaccctgtgagataggttaataattaaaccctcctattcacacatatttcattaatccttacagcaacctgagagatagtttaataattaaacctactccacagatgaggaaactgaggcccaagaggttcagtgattcgcccaaggttataacagcaagaattggtggtgaaacaagaattcaaatccagattggtcttaatagtgagctctcatgtgtgatagaaattagataccactttgaggactttgggagccagtggtgaatgtacttactttaggctctaaatactctgtgtaatttcttggtcattttgttcttagagaggtggtgatcttaataaagttttgactttattaagtaattaaaagtttttacttatgttacaactaaaacaattctttaaaactttcataacttgaagttttaaatcctaaaattagttgaaaaagatgtaattgccagtgtatcgtaaatactggtattttaaaataaagctgctttatcacttttaaggaaagcccttgtaatttagtgcattgtaatagtgtattgagctgatgtccaccatgatccatgtaaacataggtgaactatgcaaatacaagtttttcttcttgaaaatgttacatttcctctacaacactttatgctaataaatgtttatgaacctcttttgatgatcctttcatttcttgtaaatttttgtatataacttgaaatgtttaatttgctgtaatcataaggcatcaaatgttcatggtttttttctggactattttcacattgttagtactgattagttgaccaaaacagcaaattgcatacattgatac

SEQ ID NO: 39448 - DNA, 1022 bp, Homo sapiens
tggaattgtacctcctaaaaaaaatgggagaaaacataatggcttcaattaaaggaggctgcatttaccaatcttccaaattgtccttttttgtttttgtggcttcccaaaagtgttgacaaataggtttaatgtatttaaaggttattgaatgtagtggaccaaactattgaggataggtgagagacgccgcttctgtaagtgtgataagggaagatgggaagagcaggatacactgcaggtgtgcacacaggtatgttgattttatgaaaattggaacttgatctaggaagcaatttttaaagttattttgagacagggttgctggcctcaagcagtgctcccaccctgacctcccaaagtgctgggattacaggcgtgagccaccatgcacatcctaaaaagcaattcttggactatctgtgcctatatgctccttggagagtttttgtgggtacccttggcatacaggtaggtacctcaaatggaagacagctactgaagaactctcgctggaagacatcagatgtttatcctagcactgttaactgcagataaatatgtccatcagttagtacagatgaatgtattctcttggtataatactgtgtagcagttaagtgagttgcaaaacgaaaggatatgtgtgaaaaaaaagttgacaggtgaggactatagtggggcatcgggttatgcataaaagtaaggcaatgaaggtaaagatttgatttttaaatgttgtcaacccaaggaggtaaatatgtagatgttaaattctttgtgcttggtattttttaaatttccccaaaatatctctggaacaaacatctgtgggaagaatattgtgactaacttggtgaaaggacaaagtattaataaaaggtgccggtgaacagccatactcaaatcatgccatcgaaaataggtatttaagatttcatttctgccaccagaagcctgtcttgttattgtatatattgatttctctcttttttttttttttttttttttttgagacggga

SEQ ID NO: 39449 - DNA, 1022 bp, Homo sapiens
cagagcaattgaatataatatccttaacattttcctgctaaataacaatcatatttgggactacccctcaaacaaagagctagagaaataggggagtttaatgtgagcagaaagagtttcaaacttaagaaggcaatatttttgccaaatgtggtggagtatataactatttaaactggaaagacattttaggagatgatgacacaccaaacacaaaatttatttgaggcatacggacctgattaacatatcacattaaggtttagcaggccaaaatggttcaatctggaagagttcaattttaatgcctatttacggcaatgacatttgactcttacacctgatgcttaagtgctgtcggaaaactgtctaaaaaagtacaaagtgggggaggtgggcttatgatattatgaaatgttagataaaggacagatacagttaaaataaaaatgttcttttgtttataaggtctattttattttctcaaagaaagaactcacaaccctgtactggactgaggttaccagttctcaatagttctgcacacagagaaaatctaacatgtgtgtctgtgtgactgtacacagttgtacacaattttttcttgatcgaacataactgcttgcctagttgatgctaaattttgttggtctaatatccaaggatcttcttcctaccccaatatcagattcttgcctaaatgtcagatctagcaaaggaaattaacccaaagcattattctctgttcctgaaggatgataggaagtctgtttagatttcaactaccttctagtttaatttttgttgttgttgttctagaattgaaacaatgtctctattccattcaaacatatatggaggataaactatagtgcttgccttagaaaaaaacactttctacaaagtattactttgattatttgctttttaaaatagtatttgaagacatagtgcaatacgagggtagatatcccttttttaaatttttctaggtaggattaaaagttattctattttctaca

SEQ ID NO: 39450 - DNA, 1025 bp, Homo sapiens
gattggaactagagtctagaagtaatttaattttaatactatattttatttaacccaatatgctccaaatattatttcaacatgtaattaacataaacatattactttttataccaggtgtttgaaatctatatgtattttacacttacacacctcaattcagactagccacaaattgctcaacagctgtgtggctactggctactatattggacagtgcagctctaaagggtttagaattaggagttactcacaggcaatggtaatatactacttctttaatttctcttgaatattataaatcaacatatgtttactggacacctaccatgtgcctgccttcccctttgcctataaagatgtttatggtttcccattctaaatgggtccttttcttttcaaccctttaagtagctgcttattgtcacccctcttttcccacccagatttctggagataaaatgccatttttataacttttctcctgttaactctaatttacctctcaagctgttacactggattctataatcatatcaagaccatttttattcaagttaccaatgacaaaattgccaaatctaaagacttatttcagtgtgagctgaaaaggttgttttacctttctatgtcaggtactacggattttttttttttttttttttttttgaggcagggtcttgcgctgtcacccaggctggaatgcagtggcaccatcttggctcactgcaacctccacctcccgggttcaagcgattctcccacctcagcctctcaagtagctgggaccacaggcacgcaccaccatgcccagctaattttgcattgtttgtagagacagggttttgccatgttacccaggctggtctcgaactcctgggctcaagtgatcggcccacctgagcctctcaaagtgctggaattagaggcgtgagccaccacgcctggccaaggatctcttacttcttgaaattttctattggcttctacagcttcatttatttatctacttcagggtcacaaag

SEQ ID NO: 39451 - DNA, 1086 bp, Homo sapiens
tttgaggatttaagtggacgctggacatgactctccagaccttcccgggtcctcactgaggctaacaccgattgggggcggtgggggaaatgaacctacggggtgttgatctgtggtcacgttacacgtagtgtttataattgaggcattgttgactaggtaatttgccagctagggacttgagctaattggatggttggtaggcaggcaaaggttattctgcaatatcttttatttttactcgctcctcttctaatccatcacgacataaagacaaatggtagggagagatctgtgcatcgagagatggaagattatgggggaaacatttctcgctggttcattcacgtgtcaaacaagattttaaaaagcagattccattttcactgtgtagttgaatttactagtctggaagaagacaggttttgatgtattcaatttctttttaaactccgacttcaataggccttaatgtaaacatcaaacatagcaagtacacatctgcacagtcagcattagtatccctacccgtacgccttggaaagtgtaattatggccgggaacagtggctcaggcctgtaatcccagcactttgggaggccgaggcgggccaatcacgaggtcaggagttcaagaccagcctggccaacgtggtgaaaccctgtctctactaaaaatacaaaaaattagctgggcgtagtggcaggcacctgtaatcccagctacttaggaggctgaggcaggagaatcgcttgaacctgggaagcggaggttgcagtgagccgagatctgcgccactgcaatccagcccagtgacagagtgagactctgtctacaaaaaaaaaaaaaagaaaaagaaaaagtgtaattatgctggtaactaaattagcataaattttatgaactcttaaagtgccaatactttattcgatactatgattgttaaagagtatctttaatatttacctcttaaaatacgaggctttttgctgtgacggcccaaataggacagtacttttaaatgccgttgcatagttttatcttgttttaatttctttaaaaagaaaaacagtatttgggaatctt

SEQ ID NO: 39452 - DNA, 1056 bp, Homo sapiens
tgccatcaagggctcactgcaacctctgcctctgcctcaagcaattctcccacctcagcctcctgagtagctggaaccacaggcacgcacctccatgcctgggtaattgttgtgttttgaatagagatggggtcttgccatattgcccaggctggtgtagaactcctggtctcaagagacctgcccaccttgacctcccaaagtgctggaattataggcatgtgccaccgtgcctggccgctaagtaaagatttcttgaatgaatggatgcaatcctaggtagctaaatgaccttggccaaggtagttaacatttctgaacatctggttattactttggggaggagagttggagagggaactagtccattgaagatttcagttaggttaagtccattgtgagttttatgttgtctagtaattatgttattttcaagtctgattttgctgtttttctgtttgaaatgacatatagaagtttttttcttacattaaaaatagaatacaaggataattgaaactgataatggttttgagagactgcatgatttgagagtgttaatcacacatcattaaatataaaaaaattttaggcatgatggaaatgcatgtttcgtggagttcaattatttcattctagactagcattgaatttgttatagtaattgtgattaacatttaggggactttatagccccagtgtcccaaagagtcatattctatgatcatttgcttcttttttttttgagatggagtcttgcttcttcgcccgggctggagtgcagaggcatgatcttggctcactgcaacctccgcctcctgggttcaagcaattctcctgcctcagcctccccagtagctggaattacaggcatgtaccaccacacccggctaatttttgtaattttagtagagacggggtttcaccatgttggccaggctgatctcgaactcctgacctcaagtgatccgcccgcctcggcctcccaaagtgctgggattacaggtgtgagccaccgcgcccggcccgtttgcatctttttcagaaggggtatca

SEQ ID NO: 39453 - DNA, 1165 bp, Homo sapiens
cagatactattttaggcactaggattcaacagtacaaaacagaccaaatgaaaaaccaaaacaagcctctgccttcatggagtttacatttcatttctgtgtgtgtgtgtgtgtgtgtgtgtgtgtgtgtgtgtgtgtactagaaatgcatgtttgtttttcctcatttagtgccattttatttattgaaagttgtttacattttaattgcagagaggattcttgttgggaaagttgatttaaaaaattaagcaaaggggacaaaattttaaaaggttagctcattgctttctatctcttccttttttgtgaagtgtaatatttatttgaaagtgattcttagtcattatgatttcaatgtgttactgcactcgctaagggaagacaataaaataaaactgcactaattggcacaaacaacccagacctaatttagtgataagtacatgtgcattatggaacttttaaaaaatattattcacatacataaaaaggctttaatgaataaatgagaaggagaataattactatccaaagttgggagccgctgtggatatagttgcttatgtggttttcttaaaatagggacaaagtttactaataagactagtatttatttactaaatgttaataaaagctcaagaactgtttgcagattatccatcttgtctctggctgaatatgagcacctttgaataaaaattgtcgagatgaatttttaccatgttacttttttttttgctgaaatgacttctataagtggtttttaaatttgcctttgtaaagattattaatatatttggcttttctttaacatcaagaaataaggtttaatttttatagcaatttctgttgaacaagaaattccaaatccttattctcattttatgagataactcagaagtttttagaagcctgtctctgttttggtggtaatttcaagaatgaaagttgtgagcaacttagctgaagagtagtaaaatcctaaaggagttgtttagaggctgcagcatcattcttgtgcaaaatttcctaatcagtactttgatttatttgcaaaagcaaagaattaaatgtctgagttctcttagagctgtaacagtttattaattccaaataatcctatgggtgaaggcctatgaataaaatgtctttttttttgaga

SEQ ID NO: 39454 - DNA, 1072 bp, Homo sapiens
caggcatgagccaccgcacccagcctaaaatctcttattttgctagtcctacacaattgtcctttttttcattttaattacaaaataatttttgagattgctttaatacaataatagcctatgaaggttttaatagtaatagcatctggtggttggaaagagtgcacggaaagttgctggttgtttgagctttgttacttgcttgccatctgtcagccattctgcagggtagtccgcaacattagatacctacacagccttttcctcagcaagctctttctgatggggtggggctgggaatatgatgaaaagtaatatgaggagcattatgatatgaagagtagtgatgtcacctatgtatagtttgtgtacactgtgatgtatacagtagaaagggtggaggcattgtgtgcaaaacgtaaaagctcattgtcaaggaaattgcagctttgggtaggggatagggtagggaggagtgattggataattgagcctgggttttctgatgaagggcctttatatagcatgcataggacctccttctaaatcaaaagggaattgagagtctgaagggctttaaatgaaagcacaagttttaaatttgttttagaaaaatgactagcatctttgtggagcagggaatggcaatggcgggatgagtttgggataggaaggttaaattagtctagagaggatgaggggctcaattaaagtaatactaatagggagaagaggaagggatgactgcagtagaagtttagtaataatagggagctggatatgaggaagatgggtgttgccagggctttggtttaaggttgatttaagagtatggtaccagtcactaagatgggcaaatcagggagagaaagaagattgaggagaatgataatttgggggggatagggtggatgggggattttttttctcaccaagaataaaagaaagatcctcactgtggacggaggcttaaaatcacctttatctcaaccacccaaagactgttatggttactgttttgttaagtacagtagtttgtacatcttgaatatttgttgtctgtggaacatca

SEQ ID NO: 39455 - DNA, 1132 bp, Homo sapiens
agcctagaggaagatcttgtagaatcttttcatcctcaggtttgtcctccctccctccctttcccccatccctatcatgttgggtttgtgagtataagacatttaaaagcaactctgtgtgaagtatgcttgattttaaattctgcctatacaaccagatgttcttgtatgtaattaaaacttaagtagtaaattgaatggcctgtgaataaaattaaggattcaaattttgtttaatgagattttattagaatttcttatcattaagctcactcatattattcagcattttatttactcttagttacataattctttgccttaagtctactgtaagcaatttattgtgtacatggaattgtgcatttaaagactccatcattagatatagaacccatatttatttgggaaattccaactaatacaattctggtattttttttgcaaaaaagctttataaatgaattattctttttcttgttctcattttggccatttcattgttaatagtactatattaaaaggtaacatgttttcattttgatgtttacaaaagacatgggaatgaattgaaattaaaggaaggtggactgtgtggatcccaggaagattaaaatgaagttattttcatttatacaccagtgtatttttgtgttttgttttctcccatggagaattgtttctgttttctttgattttagaatagggtggctaaaggccatcacaaacatgttatgcatttgtagctataggaagagctagttgtggttctgtaactgggttccctgttaactgtcttgcttaaacctgatatctaaaaaccacattttttttttttttgagacggagttttgctcttgttgcccaggctggagtgcaatggtgtgatctccgctcactgcaacctccgcctcccaagttcaagtgattgttctgcctcaaactcccgagtagctgggattacaggcatgcgccaccctgcctggctaattttgtatttttttgttgagacgggtttctccacgttggtcaggctggtctcgaactccctacctcaggtgatccacccaccttggcctgccaaagtgctgagattacaagcatgagccatcgcgcccggccaaaactacga

SEQ ID NO: 39456 - DNA, 1041 bp, Homo sapiens
ttgagcctgggagacggaggttgcagtgagctgaggttgcaccactgcactccagcctgggtgacagagtgaggccctgtctcaataaataaataagttgtctttttttgagtctcactctgttgcctaggctggagtgcggtggtgcaacctctgtcttctgggttcaagcaatcctcctgagcagctaggactacaggtgcacgccactacgcccagctaatttttatttttactagagatggggttttgccatgtttgccagtctagtctcaaactcctggcctcaagtgatctgcctgccttggcctcccaaagtgctgggattataggcatgagccaccgtgcccagccaataaatatactttttatacctatgaatattggcataggattatagatacatgattgcaaaacttgtcaaaagtaaagttctgagggaaaaattaagagaaatttatatcatcagttatggctttggcattctacttttttgagtaaaattaatctgctctgttcaagtgaatttaggtgtgagaaagctggataaactgcttttgctagctcgtatttggttgcctgttacctttgaaaccttatactaaactactgtatgaaagtcaaatcatcacatgcttggatacctaatatgtaacacattgtggaagacatgaaaaaaatacctttattggctgctacttattgaagattatcagttaaagtcagagttttccaaaatgggtggattgatggaaagataggagggatagatggaaagatggatagatctgtgtatctgcatatgtgtgcacacaggcatatacatgtacatatgcctctggatgattataactgctttaaaatgtttgatagctccatcatctgtgtcatcttgggattggcatttgttgattgttttttccctcgagcagtggacagattccctggggtatgtgaagtaagtttcactttttttttttttttttttgagttggagtctcactctgtcatccaggctggagtacagtggcgtaatcttgg

SEQ ID NO: 39457 - DNA, 1025 bp, Homo sapiens
gcatttttcttaaaagattatttcttacatttgatagtgagttattaggtataacatttcagattttatgtgctttgtttgcagttacatgtggtatgtttttttcaaagatgcttttgaaacactttgtttgttgggaggctgagccaagcagatcacctgaggttgggagttcgagaccgcctgggcaacatggtgaaaccccatctctactagaaatacaaaaatttgctgggcatagtggcgggtgcccataatcccagcggctcgggaggctgaggcaggagaattgcttgaatcctggaggtggaggttacagtgagctgagattgcaccagtgcactccatactccagcctgggcaatagagagagaccccttctccaaacaaaacaaaacaaaaccaaaaaatcattttggaagttttcagactggtcctttttttagtataaaagggaggagctttggctttatcaaaaacctgatctgggaggattccctcagtatgtctgtaacatctccttttggcctgtgctgtttatctttaaaaattctgatcactcaagaatattgctgtgtcattagaagttaaccaaagcttatatttaaagttttattttaaatattttttataaataaatttgaaaaccttaggaagataaagttttgaaaggagtttttattttaagggactataaaagtcactatttgtcgtattattttagaacatgcttttcttaatatggaatttgctgctgttatttctaaagtttctgttctttggtcccattttatcagcaaaatcagtttattaatgaaacaaatctgttatttaccttttactcctgtatgcaaaatactgaatttttattttcacttgtaaacttaggaaaaagcagatattgtttttaaatttaatttctactttgagttattaataaaaagtttcacaaaaatatgaaaactttcaagtttatacacatactagaaaataaaagcattcacttatttcttctactgtattag

SEQ ID NO: 39458 - DNA, 2022 bp, Homo sapiens
tacagggtagaagtcttgggggccatcttagaattctgcctgccaaagctattctaaccaaaccaatgataattttgtagtatttccttttaatatttttttgtgagctaccatttttatttataatacaaatattttaccttgaggctttggaagtttcattactatcacttataaatatacccatattatttctgattataaaataagggattttatttgagagttcaagtatctgtagtgtagttttaattcttaacattttagttgtggtggttaccgtcatatcccaaaataataattttatattgctgtttctggaatggtcagttttagacattatttattgattttttgcagcagcaggtgatgcactagttcacttgtgtcattcctgccctgtaatacctctatttggggtggtgagactttggaattctccatgataaagtgttttcctccttggttgtattttcttgtgtgtattataacttatggttttcttcttatttcatcatttaccaatctttttatcacgtttccattttctggaagtttgtcacatctctgctgatttttctcccctcctcattctgcttttcattgtgaatttttatacctttttctttcttgagttctttattgtcctcccagtaagaggaagaaaagaaaaatatctggttagcatgctgtcttgaattcaaagtatgaagattgtgttggctgcagaaactttcatgaagtttctgatttctttgaagatttgggggattctaatcagtactctcaagggcttaaaggaccattgttaagaaagatggactgggttgattacatttagttattttaggttcactcttaaggttaattcctttgatcatagaaccagcaaccttgtacatgagcaaaatgttgatggttctctgggatgtaactcataataagctgtttgttgggccctttaaggtcatagtagaattcatttcatattgctgaaattgggaaaggcacaaaaatgtttgaagtgaatacacttacttgaaataacaagcatgaaggtacaacattttgttaaattttgggttttgggtaatgagtttcatttaatgcatagaggaggggaggacataaatatgctctccaggggtgtgagattgcagtgtttatcaaaaaagaaaaaaaaaacccacatctgtagaatggagaatgttgccgaatccaggggctggcctggttttgtaagtaagttctgttggaacacactgtgctgattcatatacaaattgtttatggctgttttcttgctacaaagggcagagctgaggagttgtgatagagacagtatgacctgcaaaggctagaatggttactatctggccctttgaggaaaaggtttgctgatgctggacctaattgatgagtgcttttgagatcttgattagagataagttttgtgatggagtagccatctcagtttaggtaaaagattccttaaacctcgaggaattagaaattgatttgacttatagaagtcttcagattaaaaatatgcatttgctgtggtgcctacaagtgatagtatagaaacttaaaattttacaagtttaaggaacgttctttaatgtacatgatgggagttgaaacataaagaatgaattaattacactgaaaaccaaggctcttgtttagtatattttctttccttttttttttttttgagacggagtctcgctctgttgtttagtatattttcattgaaatgataagtcttgagtggccaaaggaaaggacaggtgaagactggtaggttatttcaatctctgaggtcagatgagcatagagaatttgcacaagtaaagggtttcgtcatttgacattagataatattagaacatggcatatgtggggaataaacttttcatttaggaagcatttaggaagttcagagagagtaacagcatagcaggcaccagtagccctagaaaaggtagaatttgatggaacaaactaactgggatcagc

SEQ ID NO: 39459 - DNA, 1049 bp, Homo sapiens
aacataaacagttgattaaaacatattttatatgttatatatattatatactgtattcttaaagtaagagaaaagaaaatgttattaagaaaattatcaggaagagaaagtatacttactattcattaagtagaagtaggtcatcataaaaatctttacccttgtcttcatgttgagtaggctgaggaagggaaagaggagtgattggtcttgctgtctcagggatggcagaggcaaaagatgtggaggagagggaaggggaggcaggagaggcagacacactcagtgtaactttacagaaataataatttctgtccaacttttttgctttttcatttctctaaaaatgtttctataccatggcaccaattcttcttccaccgttggctttaattttagtgcctgtgtcataggagggtttgtgtcctaaaaataaatcaaaagcagtcttggataattgtaacccttctgccagattgtctaaagtagatttgttttctggcactgcttcttctgctgcttcctgaccgtctggcactggtttggaagcactcttcttcatcaagttgtcttctgttaattcctctgacgtgtccattagctcttgaatttctccaagattcatatcctgaaacccttcacctccctccagcagcacccccccccctttttttttttttttgctatatccacaattttatgattaccttcattggttctgttataaatcctatgaagtcatgtgcaacatctggacacagttttgcccagcaggaatttattgttttgtgcttcacgggtttcaaagctttttttgtggcagtggtggcatcttcagtggtataatacttccagacttatatgatgttctattggggttctcttccacagcattgacaatcctttttataggctacagtgtataatgagccttaaaggtccttatgacccccagatctagaggctgaattaagagatgtctcgtttggggacatgtagactactttgatgccttcattgttgcatggagttatggttgaccaggggca

SEQ ID NO: 39460 - DNA, 1038 bp, Homo sapiens
taggatgccttgtgtttcccttttatatactctatagtcatactcgactcacctcctcctccccatccctaatccctaatgcctggcagtcattaacctgttctctttctctattttacatttcaaaatgttatataaattgaatcatacaaaatgtagccttttgagattgacttattttgcccagcgtaattcttttgagatctaaccaagttgttgcatgtatcaaatagttccttccttttttttttttttttttaaatttaagttctggtatacaagtgcaaaacacataggtttgttacataggtatacctgtgccatggtggtttgctgtacctatcaacttgtcatctaggttttaagccccacatacattagctatttgtcctaatgctctccctcccctcgtcccccacccccgactggccctgatgtgttttgttcccctccctgtgtccatgtgttgtcattgttcaactcccacttacgagtgagaacatgggatctttggttttctgttcctatgttagtttgctgaggatgatggcttccagcttcatccatgtcactgcaaagtacatgatctcattcctttttatgtctgcatagtattccatggtgtatatgtaccacattttctttatccagtctatcattgatgggcatttgggttgattccatgtctttgctatcgtgaatagtgctgcagtaaacatacgtgtgcatgcgtctttatggtagaatgatttatattcctttgggtatatacccagtaatgggattgctgggtcagatggtgtttctggttctagatccttgaggaattgccacactgtcttccacaatggtttaactaatttacattcccaccaagagtataaaagtgttcctgtttctccacagcctcaccagcatcggttgtttcttgacttttaagtaatcaccattctgactggtgtgagagtttatctcgttgttttgccccaaaaactccttaaactgataagcaacctcagcgaagtctcaggatacaaa

SEQ ID NO: 39461 - DNA, 1967 bp, Homo sapiens
atccatatcattagaagtgacataagagaggaagcctggatgtcatctccgccttcagctaagtggagctttcatttactttgtacctctatccaaattaacatgttttcaagcacgttaagggtagcaaatgcaaaaatgatagaaacatagaattttagggctagaaagtaccattgaagtattttaatttctcctttccatccagggcccagatagcctctatgaaatgactgtactaaggttttgagagtaaaaaccaaaatgtcatgtttctttttttctctagagtaaaatagtgagagtactaaacttatggcagaagaataatgtatttaagagtgagattattcagccccttttggatatggcagccgggattccgcctccagttgtcacacctgttttggccagcactaccactgctatgagcaatactccaggtatgttgctttaatatagatttgttgtctaaatattctactcatactttttggatgactgttcatataaaaaataattcgacagtgcaggaaaatttgtccagcattacataattgaaagaaaatatttgtagagaaaaataaaattagatattatgtttgtgtgtaattatttctaaaatgtagaaaactgattttcatttaatccacagaaacataaatataatgaaccttagaaatttggtgtgtcaattagatttttcctgatttaagttgtctgtaacttcttatacttgcatttgtatcaacttggtatttataggatactagggggacttaatattttttaagaaaccctgaaacaattatttaacaaaaccaaaatttcaaaatcgtgttctcttgaggcatttaaatgactatgataaaaaatttttatcaaagtaatttaaaaattttttgaaatttttatgaaaaaatttttttcataattttttcataattttttaaataattttttcaaaaatttttatgaaaaaatttttatcatagttccagccctgcgcagtgactaacacctgtaatcctagcactttgggaggccgaggcaggcagatcgcctgaggtcaggagttggagagcagcctggccaatatagtgaaaccctgtctacattaaaaataaaaaaatcagctgggtgtggtagtgggtgcctgtaatcccaattactggggaggctgaggcaggagaatcgcttgaacccaggaggcggaggttgcagcgaggcgagatcgcgccgttgcactccagcctgggcaacaagagcaaaactctgtctcaaaaaaaaaaaaaaaaaaaaaaaatttttttaaatcatagttccaagaattaaattggttagcatttcataattttgtatgtattttgtgtgtgtgtgtgtatgaacaaaaattgatgtactgttttttgagaccttgctctgtcacccaggcgggtgtgcagtggtgtgatcatagctcactgcagcctcgacctcctggcttctagtgatcctcccatctcagcctcctaagtaggtgggactacaggcatgcactaccatgcctggctaatttttttttgttgttattgttgttagagacggagtcttgctgtgttgcccaggctggtctcgaactctagggcccaagtagtcctcctgccttgggctctgaaagtgttgggattacaggcatgaaccactgtacctggcccaaacatggttttatattatgtgtacttactataaaatttttttattgaagattgtattttgaatatttcctcatgttactgaatttttgtctctaaagtaagatttttaatggctgttaagtattgtaggctttagaagtacagtagtctccccacatccacagttttgctttccatgattccaattacttgcagtcaaccacagtctgaaaataggtgagtatagtacaataagatattttgacagatagggaaaaagagagagagacc

SEQ ID NO: 39462 - DNA, 1022 bp, Homo sapiens
cagcttctaagtctaatatagtctaacactaaatagctagaccacataaaaagcctttaaattgagcattcagaagaataacagcattctaagatgagaaccatattaggaatagatccattgaatatggccctagatgttttatcaagcttattaccatggaaaaaccacctaattattttaattcttagtcttctgtaaaatttgagtattagtgtttatcctgcctctatcataatttgttttgttatgtaagataatacatatcaaaatgctttaaagaaaagatctactcaaaacactttataatagtataaagtgatacaaaatgtttatttacacattaaatgatagatataacggaatgccattgacatttaaaatagcatttgtaacttgtatttgtgtgaagcactttttaatatgtctgtttctccttctttcccccagaagttgatggataggtttgattttggggaagactctgagcatagtgaagaacccaaaaaggaaattccagcttcacaactgtaagaattttttctttatagccatagtttttttatatttagtgggatgttgccatctgaattactaagtatacttagtaagttgggattattatttcaagctgttgaacctctaacattatacaaaggtggtagagatatgtcttgttgtctctttgtattattttgagtcttttctcagatctttgcaaatagactgtatcaaagttacctataagaacattgatacatattggtaaatctggttgtaatattttccatattaggctttaagttatttaacttaattgtaagagtggttggaatactaggaatgaagcttgcttctagtgcttagaggccacttctagaaagcatatgaaattgtggaaacacatcaacctaatgagaattaaggattggagttatgaggatttttttttttgtaaagaaatgtgttgtatgtttttattaaatcagttacttttttttccctaaacaattctgcagtgc

SEQ ID NO: 39463 - DNA, 1022 bp, Homo sapiens
cagttccaaaatttcacagcttagaataataagatccctttgaaaggaatagaagttctgaaaaacctcattgttcaaaaatgaatctaatgaagaaaagagagtggtaaaactagaactgtttttataaggtagatagtataaaacctatgagagatttagaatgcagatctcggctcactgctacctccgcctctcaggttcaagcagttctctgcctcagcctcctgagtagctgggattacaggcatccgccaccgtgccctgctaatttttctgtattttcagtagagacgggtttcaccatcttggccaggctggtcttgaacttctcacctcgtgatccacccgcctcagcctcccaaagtactgggattactggcgtgagccactgtgcctggcctgttttttctttgtagcattttttattaatgccaattatcagtgaaaatctagattcatttaactgactgccattatgtatttttcatgctataatttatttattagtcctctgtagtttatattttcacaattgaaaatttacttgattttaccattttaatattttagtcccttccttttatggagctgttctctgcttttatataaaaatgagtttatacaaatgtttaattttggattgattactttataaatgatttaacatggaatttcttttatgtatggctcatgtttttaaacatgtaattgtgatgtttgctgtgtttacattttcattcataacaaaaagtatctcccaatctttgtgtgtttgtatatgttctcaataggccactcctcaggatagtcaggaaggaacctttgggtcagagcattcagcgtcaccatcacaagggagtagtcagcagcattttcttgaacctgaagtcaatttggatgattccatagatattcagcaacaggtaaaagtaaatgtttttctgggtcataaatttctaaaagtagctaaagaaatcataaaatattttatactagcagtgccctgaatatatttttcc

SEQ ID NO: 39464 - DNA, 1054 bp, Homo sapiens
tttataaagtcattgttccttattaacttgttgaaaaatcatgtatttttattctttccttatttttagccactttttaaaatgtacaaaaggtatattttattaaaaataaaattaaatatgtgtatcatgtaatttaccacaaaattgagttataattaggattgtgagaggaggaacaaacctcgaataccaaagtagattttatagtttagaattattttagtcactattttctagttgaatgtaatggtagctttatatttcaaaaaatgcaaagaagcaaatttatagtgtggtatttaaaatgattaagaagccgagtgccatagtgtgtgcttctggtcccagctactcgggaggctgaagtagtaggattgtttgagcccaggagtttgagaccagcctgggaaacatagactcggtatctaaaattaataatttaattgaaatcattaaaaagccaatattaaattgaagatttacttcagtgcttaaaacataatatagtgttatccagagttaacggaaatattttgatctagtgagtaaacacacgtatcaaataagtaaaatggcatatataaacagtttacctggctcctattaatttttgattttacagcaccatagagcatgctacgggacttgaatgagtaaataaataggatgttctcataaatcaggacctctttgctttacctagcttattagggatcaaataaggcagcgtatataaaagccatttctaaaatagaaaaaatatatataaatatgaggttgtagtccattttaagaatatgaagtttcatttgtagctgttggaatctttgatttaaaataagtaatttttcttgtgctattttttggggtttttttttctgtctaggtttcatgccgcctccagttcccccacctgttgtgccaccccctacgattccaccagtagtaccaacatgtaagttttctacttttagagttttctttattcatggtagtgttaattttagtgtgtcagttctcattcttgtgaattaccgttaatatttttatt

SEQ ID NO: 39465 - DNA, 1036 bp, Homo sapiens
agagcttaaataatggatttggttttttgcttctttgtggtactgaaattactgtctttgcatttcctgtaaaatggaagttagcaccaaaggcttgcttagattccggttcacctgttttagcaagaatacttgagaagcaaaatgctgtaggattggtattatctatcacatcagaagtcttgcagtgcctttttgtcctcctgccccacaccttttttggggcggggcgggggggggggcggtgtaaaactttattttttagagcagttttttaggttcacagcaaaatggagccaaaagtacagaggattcccataagcccccacccaccacacttgcacaggctctcattatcaacatcctccaccagagtggtacgtatattacaattagccagcctatattgacaaatcattatcacccaaagtccttagtttgcattttgattcactcttggtgttttgttccccttttaatgatgttaagattgatcagaacatttagtggaacagtagaacctggtcattaaaaacatttcctttcatccattgatcattgtttcttagatctactttttattagttgcagagtggtgatctttctaaatgtataattccttccatgtttcttaacttaaatgaagaaaaagttttccttaatcaggtaatggtacttagttaccttgaagtgtggttggtacagcaaagtcagggtagatgctatttttttctttaattgccatttctcagagtcatgagatctataggtatttccagtgatacccagtgaccaaagagagatttctcatttctcttcatcttctcctcccttgtccctctctcccttttttttttctccttcagtttctttagtatttatggattaatggatttttacttctagtcagttgcatttttctttttttgaagtgtagattgtttcatctttggacggtgggagacctgtgttgcctccctgtcacattagttttgagagctacttagctttttggcccagtatatcccagacaaat

SEQ ID NO: 39466 - DNA, 1025 bp, Homo sapiens
ttattttttgcaaaagctttctatcataacaacaatgaactatgtggtggaaaaagcatgtactttgatataaaaatcatgcagcctcctcagtatgtgtataatatctgtgtatgtttattgtggaagtcgtgtagtttttttctgtttctctgtatgtccgtcttcatgcacatacagagaaaatagaaagttgaaaaagtttagataataaaatattcttttaaatctggtagaatattggagaaatctggctaattaacatgggttatagttaaagctcttggtcttgatgaaggtaaaataagagatattataaagagatacactggtagtttggcagttctatttttaatataggtaagcatgaagccagagttagcatggagccaaatttcacataaatgcttgcattgctttgtttcacactatatttgctattctgcgtagatagtactgacactaaagtactcactggtcacgtgcctgaagttaatttcttaattgcacaaaatgtgtagtggtgctggtggacttaaagacattaatgtgtataccaggaacataatacccatcatgtgttttgtagggctctgggtaacactgtagcctgcaaggtaaactgagtagggaaaaaagtaggggttggcttcctgtttgtttttgcttttgcttttaatttttatttgctatttgttctcttttaggttttacttatatacacagatataaaaccattggtgttttttagtttctaatggaaggcttttatttggttctatgagtagtcattttgtttccaatgccttaccagcaatttatcatttgctctgtttatctaaaatttctaagcaaagatagctccaaaaaatgatagaacacaccagacatttaaaattggattggtcttgcctacctctgatgacctagagagctataagaactttaaggttcctcgtcaaaaatgaaagacttcttataagttctgaacagggatagtacagtatttattttgttatttagaa

SEQ ID NO: 39467 - DNA, 1022 bp, Homo sapiens
aaaacaagatatcttgatatccagcaaaactttctaaaactagaacttaaaattaagggcccagattgtttgtttttttttttttttggtggaaaggcatactttaaatatgggcacataaatattgaaagcaatttgagatgtcccctctctctggttcccaggcaggaaatgtataacagaaacacctgtggagctctctgaaaatattttggtgggggtatggggagtagagggtggtcaccacagagttactaatacagaatctcctgagggtgatatatatataaaatatatgcatacatgcaccttcctgtgtatatatggttttttaaatccccacataccaccatttcagatatattaaaatatgtacatctttattataccatactcttgagattcttaagatttttaaaaatccaaatattttagttacatgagattatgtttagtgtttcaacaaagcatgcagttaactgtggcagttggtgttggaggatgattcaaaagtagagaagtcagttatcacagcttaaatttaagcgttaatctaaagatgagttataggaagaaagggatggcaggaagcatatgagatggttttgtagggaagtattttttttttttatgcaagtgaaacttgttcatggattattacctcaaggaaaatttacttgatacatgtaattaagtgttttgattatagaaagaatctctttggaccaatattgtaggtgttcagggtctagaagcaatgttattagtaagactccttagatgtgcatgtcaaaactaatgcaaatcagtgaattatttgtgcatgagctttgcttaggcatttttcatcccctccacttaagttcctcctttttcatcaggctcttttgctcccatatgtatacttagaatgactcgggcttcttgttctaaagtttattcaagatacagaacaaatattctaagtaatttgtaaaatatatattgtatatcaagggatagaattgtgctaatgggctaat

SEQ ID NO: 39468 - DNA, 1082 bp, Homo sapiens
gtttctctcttggctatttacatttttagcttaacatttcaaattagtttctaatattctaatacagctcatagttggaaataacgtgtgtagatacatacacatatatgcatgcgtgcatatgcgtattctataccttaaaagaaccttcaagtaagccttgtagattttcttttgatcttttttttttttttattatggtaccttgagtattctctcaggaattagacaacttaaaaccagtatcttctttctctgcataagtctcacatctgtttaccaaattcttagcatttaggttttttttttttttacttatgtatgcatatattttattctgaatttatgcccctgtcgtaagttttgtttcttcagtttcttctgggatatctttttttttctgtgcagccacagaacaattatggcttaggaataatttctttccagcgaggatcatctccatgtagccgagggagctcacatacaaattaatctgaccatgagctctgaaaggacagtggctagcacatcttgggtgtttgattcacctggatgtgctcagtgaccagagaatttccatctaaacctcgagttcagcgttactccctgtgtatttaaacatgttcaggaagaatttagctttgtttttgggctaccaaccctgtgtctagcccactgtttggcctgggcacacctaccaactccaccctgtaatgtcaaaatggtacacattgtttctgtaaagtgacatctttcggataacttggtgatctttttgtacatgcgtacctttaatggcctgggcattttcacaagtgttcttgagtgaacatgacaacttgaacctcttgatttgcatggttttgtggcattttccggatcaagagactatcaaaccgttttcacctcagtccacttacagggagagcaagaactggatcgttgaagactgatacgttttctcatcaggaacaactcagtcttcattagtataatgacatctgggcagggtggtggctcatgcctgtaatcccaggactttgggaggctgaagtgggcagatcacttgagcttaagagttt

SEQ ID NO: 39469 - DNA, 1020 bp, Homo sapiens
tccaaatatattagactaaaatatcctgtgaacatggaaatcaatgcatatggcctttctgactttttaatattgagcactttcaaagattggatccatattgttaagaaatgtaaaaacagcctgggcacagcggctcacgcctgtaatcctaacactttgagaggccaaggcaggcagatcacttgaggccaggagttcaagaccaggttaggcaacatagtgagaccctgtctctactaaaagcaactttaaaattagccaggagtggtagtgtgcacctatagtaccagctgtttgggaggctgaggtgggaagattgcttaagcacaggagttcaaggctgcagtgagctacgatggcaccactgggctccagcctgagtgacagagtgagaccctgtctcaaaacacaacaaaataaaagaacagtctcataaatattttcactttggaacttgacccagtcagtgatttcaaacctagtattttcaattaattgaagtgtctagtataataaaatctgatttgcttaatgttggctctgaagtaatttgacttaataacttgtaacaatagatacagagttgtttttctgtctgtagcttaagaagtgagctgggtattgaaagccttagatttgctaactataattgaattatttgtgtctagactgctccttggcatgtttccaaatcatttttgtttcctttgggagaatagagacataacagctgtagggatgaccatgattgctgtgtgaacaagtttgtcttcagtaaatgtgtttgcctacttggatgtaggcctgcatattatttttgaagtcagattttgggtaaagctcatggactttttctaaaatgctccctatcttagaccatcaaatgaggcgtcatgtgtgcaggtcaggttgcagttagagatacatttgaatgatgtcgcccacattggtctttggaatgtggaatctttttttttttgtcctttcattagtacatgtagcagatctgaaagagaa

SEQ ID NO: 39470 - DNA, 1140 bp, Homo sapiens
ggatgaccccatttcttaagttgttggaaataatattttgataaggtccttcagttccttcttcatgcctcaggttccttttgtgtactgttttgtggagagcccataaagagacgagacatacacttgccttttaagtctgggaggaggaaaagtatttctgatacccagttttgccttcccgtaggtgaatttcaccaagttacttcaaaacttttctactcaccacaacacatgccacctttaccatcttactcccctcccagcagagaaacttgcctcttttccttatgtaactagtagatgggactatagtaatttgtttcagtaacctctcaactcatttaaatgatctggtctctgcctcaagaccagtggttctcagctagagttgattttgctttttctccgcccaggggacagttagcagtttttggagacactttctggttatcacaacttggtgtggggtactgctggcatccagtgaatattagagattagggtgctgctaaatattctatagcgcatagggtggcaccaccccataacaaagaactgtccccaaatgtccggagtgcccaggctgggaaaccttgctctagttttagacataacacgctgtaggtcctgagcaaatttttaattatcctggttcactcagaacactgcatcatcaaatgtcttctctttcctgtattttttaattttttattattatttttagatggagtttcactctcgttgcccaggctggagtgcaatggtgcatctcagctcactgcaacctccgcctcctgggttcaagtgattctcctgcctcagcctcccgagtagctgggattacaggcatgcgccaccacgcctggctaattttgtgtttttagtagagacggggtttctccatgttggtcaggctggtcttgaactcccgacctcaggtgatccgcctgcctcggccttccaaagtgctgggattacaggcgtgaaccaccgcgcccagccttcctgtatttttttaaaactctctctcttcactgacaccaggtgttgctattaatgtgctcaaatctctcacttataaaaaagaataaaacctctctcttttctagttactggtctgtttattcttttgtagaa

SEQ ID NO: 39471 - DNA, 1177 bp, Homo sapiens
ctcgaactcctgacctcgtgatctgcccaccttggcctcccaaagtgttggattacaggcgtgagccactacgcccggccttgattcagtccttcgttgacagttccagtggcttcaaaactatcttccaggctcaacactgacaaacacaacttctgcaatgcttaccagagtaatttttccagaattttcctaggtgaagagagagcgtagcatctggagcttacgttgccagagtttgaattgagggcaaatcatttttctttttggtgcttcagaattctcagtgggaatgaacatgttagtaccaattttataaggttgatgtagagttaagtgactgagtacatgtaaagctcttgaaacagtttctgggtaaataatgttagctgctattagtttatacgatcattaatgttgtaatacacatctgaacacacctaccaaaagttcttcatttctgtggtaacctaccaaataaaatttaaactgcttattctgacttgctggactcatcatgacctaactctgtttacttttccagtttcttatctgatctctgctgtaaatacgatgtgtttcagcaatttgatacccttagcagttcctccagagtgcttttactgcttgactgtttcttctccctgaaatgctgtccccatctataccgtatagactcctacttgttgacctgtttgcttttttgattttaagcaaatgagctctttgaggacagagatcttattaatgcttatgtctgactcatagtacacatttagtaaaaatttgttgaaagcataaatgaacatttaaaaaacgagaagagactgggcacagtacactcccagcactttgggaggctgaggtaggaagattgcttaagcccaggagatcgagaccagcctgagcaacaacgtaagactccatctctacaaaaaacctaaaaatattagccaggtatggtggtgtgccctggtggttccagctacttgggaagctgaggtaggcagatcacttgaagatcagttgagcccaggaggtcaaggcttcagtgagctatgttcacgcctctgcactgcagcctgggcgacaaaacgagaccctgtctttttttttttctgagacagagtctcgttctgttgcccaagctggagtgcatgatctcacctctctgcaa

SEQ ID NO: 39472 - DNA, 1033 bp, Homo sapiens
agagagactcaaagagggccagttacttcatgtctcattgtctcagttttttttttttttaatgtaaaatgggccaattattgtgttgagcttaagtgtttgttttgaagacctaaagagtaatgcatggtactaacacatgccacagcatggttgaatcttgatgatactgtgctaagtaaaagaagccagacacaggctggacgcggtggctcacgcctgtaatcccagcactttgggaggctgaagtgggtggatcacttgaggtcaggagtttgagaccagcctgaccaacatggtggaaccctgtctttactaaaactacaaaaaaattagctgggcgtggtggtgtgcgcctgtaatcccggctacttgggaggctgaaacaggagaatcgcttgaactttggaggcagaggttgcagtgagccgagatcgtgccattgcactgcagcctgggcgacgagctgaaactccatcacacacacacacacacacacacacacacacacacacacacacacactgaaactccatctcacacacacacacacacagacacaaaagatcacatattacgatttatttatatgaaatgtccagaaaagccaagtcagtagagacagaaaatagataagtggttaccagtggcttaggggtgagggggtgggaaagaatggagagtgactgccgatgggtacagttccctttcagcatgatgacaatgttctgaaattcgtggtggtggtggtggttatacatctttgtcaacatacttagaactactgagttgtacacttgataaaggtgaaatgtatcatatgcgaattgatacctcactaagaagaaaaacagtaatgcatgtaaagtacttagcaggtacctgttacataataagcttttttttttttttttgggacggagtctcattctgtcacccaggctggagtgtggtggtgcaatctcagctcactgcaacctccgcctcccaggttcaaacgatcctcccgcctcagcctcccaagtagttggga

SEQ ID NO: 39473 - DNA, 1028 bp, Homo sapiens
agtaacttttttccactatgataaactcttgtaacttttggaatattaaggttttttattgttgttattgttttagacagggtctttctctgtcgcccagggaggagtgcagtggcatgatcttggctcactgcaacctccacctcccgggttcaagtgattctcctgcctctgcctcccgagtagctgggattacaggcatgcaccaccactcctggctagtttttgtatttttagtagagttggggttttgccatgttggccaggctggtctcgaactcctgacctcaagtgatccacctgcttcgtcctcccaaaatggtgggattacaggtttgagccactatgcccggctggaatatttttactcaatattttccttctttaaaatgcttaaataatacagtaattttattgcatattaatagaagtatttgaaggcaaaaattaatttcttaaatttatgcttggggatgactggcatttcttctgggtatatggaagctctaagcttggaaaatactctgtatcattttaaaattctaaacttttaacctgattaagacttgaatgaatgtatcatccctacactgaatgcattcatttattcagcaaacacataggcaccaggcacacgctaaaagaaagcaaggtctctgcccttgaggaatccacaatgcagtcaggaaggtaattactggacagagtgattggcgccatggcagagatgtggcagcgtgctgtggaaatgcatccatgaaccgtggaaaggggtggagtagggaaggcgattagagaaattggcacttgacgggcgtcctgcagcttgctggaagtgaagtgcatttgcaggggttactggaaggcatgaaagggtatggagtgaatggagggcagggagtagctctgcttggcccctccggttgtgaggggccctcactgcccagctaagagcttgcagtttctcttgtaggcagtaggagtctatcagcagcaggtgccctggttcagattacagatacattctt

SEQ ID NO: 39474 - DNA, 1051 bp, Homo sapiens
tagtgtgatgatacttagaatagaactggcacatggtaagcattttaatacatggtaactatttttttttcatgatctagattctagagaaaaatgaagactacagactttaggagtatcagacccttcttgttgttaatattcattcttaagatttgagtatcctagaagatatatggaaatggaattggggagggaagctttagatttaaaagtctccctctctttttagcagtacttgaatttcaggaaagcatacatttcacaatatgtgtgtattgctaatgggctggatatgggataaaactaatgaaagccacgcctttgccgtcttgcattatttattcaaaaccagacagcagctgggcgcagtagctcatgcatgttattccagcattttgggaggccaaggcaggaagatcgcttgaagccaggagtccaagaccaatgtgggtaacatagcaagaccccatcttttaaaaatacatataaaaattagttgggcatggtggtgcacacctgtagttccagctactcagttggctgagatgggaggatctctggagctcaagagtttgaggctgcagtgagctatgattgccccactgcactccagcccagtgacagagcaagaccccatctctaagaaaaataagcaaaataactggtccaaaaccaggtagaaacatggttctaattttctgtccaggcaccgtggctcatgcctgtaatcccagcactttgggaaactgaggcgggcggatcacctgagaccaggagtttgagaccaacctggccaacatagcaaaaccctgtctctattaaaaatacaaaaattagcggggcatggtggcatatgcctgtgatcccagcactttgggaaactgaggcgagcagatcacctgagaccaggagtttgagaccaacctggccaacatagcaaaaccctgtctctactaaaaatacaaaaattagcggggcatggtggcacatgcctgtgatcccagctacttgggaagctgaggcacaagaatcgcttcaacctgggagg

SEQ ID NO: 39475 - DNA, 1050 bp, Homo sapiens
acacggactgatggctcaatgtcctagaatgtttatggatttcacctgtgccctgggcctcgctggacttttctagatatctacaagtggcggcttgctctctttctcctcatcccagtactgtggagtgtggctacaaaaggtttgaaggcgttactgatcattgtggtggtgtcagtgatattgtataataattgtaataatttctacgtattgagtacttgctatactggatgctttacgtaaattaatttatccttataacaaccacatgagaataggcactattatttcacttcacagatgaggaaacaaccagtttagcccaagttacacagctaatttgggcaaaaggtgggttctaactgaggagtgtctgatggcaactcctgtgttcttaacatccgttctacatggtttggattaagagagtttgtagctgaccctatgatggaaattcattgagggcttgtgtcctttttcttcatgatctgtgatgtgaatttctcttcataaccagactgtgtgttcagatcccaggctctgccatttgtcttttcagattttgagttatttcactttgcctaaaataatacttcatcttgctaatgaagcctgtagatttcagcatgagatgcattcttaataacctggaaaagtatgtagggacgtacaaaatcctatgtgggtctggatccagcatttatctattgactatacacagattttgtaatgagttatatcaaattaaagaatggaaatccttgttgaaaaatattttatcaaccaaattatgtttaaagctatttttatgttctttcagctcactgacatgtaaccaacttctccatctgatttcacttctgccgtgttcttgaagattttaaaaaaggggacagttggttgactataaaacacagaatctatttgtattcaagatcatcgatttaagtttgacaaactaaaagaatgtaatgttctactcatttgtatggccagtgtctacccagtaagctttttcagtctggaacatttttagttttcctagtg

SEQ ID NO: 39476 - DNA, 1030 bp, Homo sapiens
actgaaatttaatgcttattgtagacaaattatctaatttccaagttagtttttatgtgtaaacacaaccagaaattcactttgaatgctgaagcctgactttttttttctggttgattttcaaggaaccaacttatcttttttatgttttagaaatatgagggatatggctatggccttgacttttttgttgcaaacaagttggtgcaaaagtaattgcggcttttgccatttaaaagtaatgacaaaaaccacaattatggctgggcacggtggctcacgcctgtaattccagcactttgggaggccgaggcagacagatcacaaggtcaggagtttgagatcagcctggccaatatggtgaaaccccgtctctactaaaaatacaaaaattagccaggtgtggtggcacgtgcctgtggtcccagctacttgggaagctgaggcacgagaatcgcttgaacccaggaggtggaggttgcagtgagctgagattgcaccactgcataccagcctgggctgaacagagtgagactctatctcaaataaaaaaagaaagaggcaggccagtcgcggtggctcacacctctaatcccagcactttgggaggccaaggtgggcggatcacctaaggtcaggagttcgagaccagtctggtcaacatggtgaaaccccatctctactcaaaatacaaaaaagttagctgggcatggtggcgcatgcctgtagtcccagctacatgggaagctgaggcaggagaatcgcttgaaccccggaggcggaggttgcagtgagccgagattgcgccactgcactccagcttgggtgacagagtgagactccatctcaaaaaaaaaaagataagaaagaggcagtctgatgtcaggtgcaagtatgagcctttaaagttgatctgattaaaatccactttctgccacacaacagcatgagacttcaggggagttacttacttaaattgtctaaacttaaactccctgttataaaacaggaatgctaataccagtgtgtc

SEQ ID NO: 39477 - DNA, 1064 bp, Homo sapiens
tgtagaaaaagagtatctattagtggttcattaatttggatcatgtttggagttctcagtgagcttgttaaaataagacactgttcctttctttttttcttttcttttctttttttttttccagacagagtttcactcttgttgcccaggctggagtgcaatggcgtgatctcggctcactgcaacctccacctccctccattcaggcgattgtcctgcctcagcctcctgagtctctggggttacaggcatgcgtcaccacacccggctaattttgtatttttagtagagacggggtttcgccatttggtcaggctggtctcgaactcctgacctcaggtgatccgcccgctttggcctcccaaagtgctgggattacaggcatgagctaccgcgcccggccaacactgtgcctttctaaaaactattattccactaaagaaaaaatagagagagacatgcaattcaagtatagtctttcactaacgtgattgttaggtatgttagagatagtaggaaccttagctgagtcgtccttgctctgtggttttaagtgtaaaaataaccctaattattgtatttgctaccttgtgcccactttacagacttgaagccctggtttctgtaagtatatgcatacaagtaaagatctagtgaaggcatagctgagtcctcccatcgagggcagctgggcatggtccctgcaagaactttttttggccgtttgtcccctgctaaccttgcaccacccagggctgtgggtaggtgttcctgtcctagatattccaggggtcacttgtcccttgggctgcattttctggcatcccagaaaagtgagtggcttgtcatttccttgactaagtcatgtcaattctctgccactaattcagtttgcaaatgagtttcttcagctatttaaaaaaaaaaaaatagcatctgctcaaatgggcggccatatagtctctcgaattcagttgtggagacagctgaggacaccagattgagtttgtttcggcaaactggatatatgaaaattgaagattttttttaaatgggtgattgtt

SEQ ID NO: 39478 - DNA, 1035 bp, Homo sapiens
gacccactaaatgaatctcaagaccttttaatacgttgaaagctgcactttgaacaacgtagttctagttctgtttcaggatctagaagaatttcctcaaaaaaaagaaaagaaaactgagtttggattaaaatgtctgaatctccttctctcctccctgctagattgtgagctcgctgagggcagacagtgtatctatttctcctttatatactcagcacctaccttggtgtctggcacgtaggagatgcacagataaatattaactgaaccaaagaactcagcctctctgggtcttcgtgcccccatttgtaaagtggagaagtggccatgtgcactcggggggcagttgtgagaataatgagatcatgcacctacagcagcaggcacagagcccagcactaatagctgctcgatgaatctacatttctttctggatttctacacctagctctttcttggattgactgcttgactccactgcagttttttttttaagtgtaatgagaggtttgaactctattagcctcagatcccaacccacttaggtgcgctaaggttttccaggatgctatggagcctggaggcaaattgcccttcaaggacagcaatttcttcttgaaactcagcacacacaggtcaggctctggccaaaaatgtgagaggtcatggggcagagtcctttcatttctccatgaaaaagtgtgacttgagctgattattagcattttattgcaaaaatgtaaattacttccacatctagaaagattataaaataagtttaggccaggcgcagtggctcatgcctgtaatctgagcactttgggaggccaaggcgggcagatcacttgaagttaggagttcgagaccagcctagccaacatggtgaaaccccatctctactaaaaatacaaaaaaaaaaaattagatgggcatggtggagggcacctgtaatcccagctactcgggaggctgaggcaggagaattgcttgaacccgggaggcagaggttgcagtgagccgagattgcgccat

SEQ ID NO: 39479 - DNA, 1092 bp, Homo sapiens
ggccacttggtgacactcctcagcctccttgggtaatggtgagacctttatttactatgcgatgaagggcctgggattctcttctcatggttattcacacattctaccttttgctccccaaatgatgctgaccaccttattttaacagacaacaccggctatctccagttctctttccaatagatttaagccagagtgtctctaaaatcttaccaagtttcgtacaggtgcggatcatatgctataaatgtttcagtcctaggctctggataaaaaagtgtccatggttttataatttgggcttaaccagtagaacttgtgtgtatacactcttagaagtatttcctgatgtgcttaagattgttatgttttaaaaatatagtatcatgattggtgcagttttgtaagcaaacttttgttccaccggattttacctgctcactttataggaaaataaaacttgttgctttagggtgtcagaggtttttgtgttgggtaaatgtaaaagaacatggcaaggtataactgaagaagagtttattatttactgtggcaaaacacgcccctaatgacctcagaatcagctttcaacaccttcacataccatactaagatgcttcataatgtggcacctgcctgcctttccagttccatctactgactttccccaggcctcctggctctcccccgcttgcacactgcctgctctagacacaccaagctactcagaagttgttatttccagaccattgtttggaatgaatgaaattctgcttacactgttcttactcctcttgcccatctgtcaattacccacgcattcttaatgtgtcagtcaaataccttctctaggaagcttttcttccttatccgtaggcgaagttaagctcctcctcctccagtagtcagtgcttctactagaacacatttttgtatatacctctggcactgccaccttgcacagttgttcaggctgttcactacacaaggtcatcttgtccaacaggcaattggaggctgaaatccgattcacactccacttgccaagcctctagtgcgctcctctccattggagaggatacatttggcaat

SEQ ID NO: 39480 - DNA, 1045 bp, Homo sapiens
gcactccagcctgggcaacaagagggaaactgttgcaaaaaaaaaaaaaaaaaaagcatccaaaaaactgttacgctctcaacacgatggtcagtaagagaacttactttaagtagagaacagtaagtgacattaagtgacacaaaagcaaattccttaagttttaggtggaggagtgataggtcagatttgcatttgaaaccagttccgttcaggcaccttggcttacgcctataatcccagtactctgggaggccgacgctggggatcacttgaggttgggagttcaagaccagcctggccaacatggtgaaaccctgtctctactaaaaatacaaaaattagctgggtgtggtggtgcacatctgtagtccgagctactcgggaggttggggcacgagaattgcttgaatccgagaggtggaggttgcagtaaaccaggattgcgtcactgcactccagcctgggcgacagagcgagaccccatctcaaacaaacaaacaaaaaaagaaaccagtttctttttagattgttgtgagtagatttagggaagcaagcctggaagaaagaaagtcagtggtaacagtgtagatcatcaaaggtggtggcagtagaatagtggggacagacatggaagaagattccagaaatataaaggaagtgcagtggacttggtgactgagaaaatggagggcagggagaatcacatccagtaaaggatgacacccaggctgctcacccatatgacaacctagaaggagaaggttggagacctgtgggatcctttacccaagttcacgtagtttgaaattgcacagctgagatttgaatccaggtctgtctgaccacatgatccttccactcttctatcctgacccaatggttagcatgcccttaattgtaaacaaataaaggatcttaataaaaatcatctagcatttgaaagcttttattttttgtgaaatgttttttcataacattaaggaaaaaaaaatgcccacggatggttaccgccagcagacataggctggtgccctgagaaggt

SEQ ID NO: 39481 - DNA, 1048 bp, Homo sapiens
gggcctcagcaagggttattttattttatttatttgtttttttgagacacagtcttgctgtcgcccaggctggagtgcagtggcgcgatctccactcactgcaacctctacttcctgggttcaagtgattctcctgcctcagcctcgcaagtagctgggactacaggcatgtgccaccatagccacctaatacttattttttttgtagacacagggtttcactgtattggccaggctggttttgaacgcctgacctcaagtgatctgcctgacttggactcctgaagtggtgggattacaggtgtgagccactgttcctgccctattttttttaattttaaaaatttatttttattttgtagagatgagatctcactatgttgcccaggctggtcttcagcaatcctcccaccttggcctcccaaaatgttgaaattacaggcgtgagccaccacgcctggccaagggtcattttaaaatatggattgtatgttttgccactgtcctttgtaacaagatattatttggagcagaacatacacagagaagaaaacagcaaacgagtaaacaaggctgcaaggacaagtgtggccgtggaaggaagaggacagagcaagagaagggagaatgggggtcaggggtgtcctgggataaagaagtcgggattcagcctagagtggcaggcctggtggctcgaggatgaggaaggtggagtgaaggagactcgggaggccgcattaggactgtgggagaatttggtttgaaatattccagaataatattttcatagtgtggtcaatggtgcaacaaagaaacaaactcagtgcatgtttgaacagaaggagatcttgaaatcctcaatccactctttgttttttttttttgttttgagatggaatctcactctgtttccctggctggagtgcagtggtgcaatctcggctcactgcaacctttgcctcctgggttcaagcaattctcctgcctcagcctcctgagtagctgggactataggtgcatgccaccatgcacctataatttttgtatt

SEQ ID NO: 39482 - DNA, 1116 bp, Homo sapiens
cttgcccctcctgactctcatttccactccctcctaagcttccctttcccctgttgtctgctttgtgctaacctagttagatgagggttagggatgatgatgatgttgatgatgatgattttgagacagggtctcactttgttgcccaggctggaatgcagtgtcgtcatcatggctcactgcagcctccacctccctggctcaggtggtcctcccacctcttagcctcccaagtactgggactacaggtatgcaccaccacgcctggctaatttttgtattttttgtagtgacgggcttttcccatgttgcctgggctggtctcgaactcctggggtcaagtgatccacccgtctcggtctcccaaagtgctgggaatacaggcgtgcatgaccaagcccgactttttccttgttttttaatttacgtttttcttttccacccaaccacacgtacaagtgttgctatttttattacacttagtcaagtttcaggctaagaattgggagaaggggtgatatgcagcagtgtaacatcttagtatagacagttacacccatcagttgttaaagacctgtggctgttgcagtgctgggaatgtcactgccacaggcgccagagtttccagcctcttgccctattgctgggcccctctcccttcacatttggcgtgtgtgtctcctggccttctgcctttctggagcctctctgcatcaatgaatgctaaaggcaaaaaactctctacccaccctttatgtgcctggaatatctgggagtggaaatttctgccttttcctttctctgtcttttatcaatctctatagatgaaaaggagaagtatacagattctctctccacactgtaaattgtgcttcctcttcaggagacagaagtggttacagttaattttttttttttgagatagagtctcctctgttgcccaggctagagtgcaatggcacgatcttgtcccactgcaacctccagctcactgcaacctctgcctcctgggttcaagcgattcttctacctcagcctccggagtagctgggattacaggcacccgcccccccatcacgtctggctaatttttgtatttttgtagagatcgggttt

SEQ ID NO: 39483 - DNA, 1045 bp, Homo sapiens
cagccaaatatggcttagagtttagccattagagctgcagctctgtgggagttttttattgcctttgaatatgtgagtttgagattctgtgaatcagtcaaccccaaagttgaagggctccccagaacttgaccctcccagctccatgctggacctctcactgtgctccctgaggcagaagaggccaggagctggggtgcacctgacaccagtgccacccagacgcccttcctctgcagggaagtgagtgcccctgctgcagtggcctgaagaaagggtgtttctgtcaccaagacacttacctaagcagagggaatgatcgagctgtaaaggtgtggaatccagctgttgcctgtattgtgatattaaactctttgaattaggtgagcaataatcactacttttggggtcaggaatttcaacaaaggctgggtgtggtggctcacgcctgtaatgctagcactttgggaggccaaggcaggaggatcacctgaggtcaggagttcgagaccagcctgaccaacatggtgaaaccctgcccctactaaaaatacaaaaattagctgagtgtggtggagcacacctgtagtcccagctatgtgggaggctgaggcaggggaatctcttgaacccaggaggcagaggttgcagtgagctgagatcatgccactgcactccagcctgggtgacagagcaagactccgtctcaaaaaaaaaaaaaaaaaaaaaaaaaaaaaaagaatttcaacaaggcataaacttcattatcctgatgggagccttgggagctgctgccaggttgctgctacccaaatctcatgggtattttggagactaaagcgttgaagacactttcttctattttctttcaggatttgagctgcctctttgaattatacttggagccacttcagaatgagacctttcttacccaagatgaggtaaataaaatcaccttccttctgtccagtgatccacaggttagtctctgtttgccttttagcagaactcctatgagagtatctctgttgatcccaaaagaaca

SEQ ID NO: 39484 - DNA, 1017 bp, Homo sapiens
tatgctaattaaatgacacgtcatattgtttacactgattttggctgtctgtaattgatcactgccagtacttgttaatcatgatgaacaaactgtcttcatgtctgaaatatactgaaagttataaaatatatcagttaatgggaagaaaaggattataattggtaagctgaacatagattgacaacaaaggttattcagtcaaagtagaaagaaagagagagggagagagaaaagtgagcaagcagatgctgttagaaaatgttccagcaaccccacacttgaagaatccctaagctgaaaatggtccagaggcagtaatttagcaagctggctggagtccgaaatgctaaaacctaaacttgaaagcagctattacaaaactgtaaacatgtgcttgattttttttctagaaactttaacttttgttctattttggtctaagtttggaaaacagaaaagaaactgtatgatagcaggtgaatcctaggcacactgatgtctacagataagtctgactcttaagaacttaaaatcctagggaaatccttttctaaaatggtaagatttacattttcagattatgaacaaaaacagaacagcacaatccagatagtctaggatctaatgtcttagagaatcaatgtttgtagctatgcaaagtttatactttaaatataggcaatggattagtactatttcaaatatttaaccaaagccaggcatcaatctccttgccgagtcatctgaagctgagccatgtggcctattaacatcctctacagtcctttttttccttggtggggaggggagtgggtgaagtagacagttaatggtgctttttgcctccagatacagtgttttccctggttcccaagggaaacacacagggggagaaagaatttcagcaggaagtgttgtggtaaaaggggaaaggatgcgggatgaccctgtgaggtaggaggggtggagagagatctggacgctgcaggttggctgctgaagactgtatgacat

SEQ ID NO: 39485 - DNA, 1060 bp, Homo sapiens
tctcaccattgggcatttagcactgctgatgtaaatagaagtgctgagcagtacagtcacaaaaattcttgccacaaataataactgagctctattacaagcaaatgtaaggttcagtatttaaagctgaaactattatgaatcatagttattaataagaggatcaaatacagaaaaacagttcgctggtgtccagtattgggcatttacaaaattcagatctttgatgatagtcttagaatatgcacattacatatatcatagactttaattggaggctgaggataaggccattgaaaaataagtaaaccacgaattttaccaatttttggatttgtaaagcctttataaaagtcttccctttacaaattcaactatggaaaaatttgaattctgtcagcacacgcagcttaataaaaccttaaaatttttttaagattttgataggcagcaatatattttggtgatgtgtaattcacctgataaacaagatttaagcttcatttttttgtgatttatcagttctgactgttcaaagatatttgtggatgaggagttttggttagaattgacatatttaaaaaacgaaatgaggaaaccacatatttgtgcagataacaataattaaaaggggaaaaatgagatattcctgtgaaatactaagaatcatttcatatttgcttttgatgtggagaatacagaaatgccccataatcttttttttttcttcattgttttgttagattaggtaatttgagccttgtttgaactgcttacacgatgaattagggaaactatattctaagcaagttgtgctgggtgtctttttttccaaataatttttctttcatgttaatgctatgaaagtttaaaaaatcctaatctgttagagaggaacaacagtcgttgtatgtatatttttatgtaactcatttattttaggaagaggtattttaacaataatcataccttagagacttgtcagagtgaaggaagggctgaatttaacaaataatcttgtgaatcctaggctgaacactgctgtccactgctttcagat

SEQ ID NO: 39486 - DNA, 1069 bp, Homo sapiens
caccacacctggctaatttttgttatttttttgtagagacgggggttttgccatgttgcccaggctggtcttgaattcctgagctcaagtgatccactcaccttggtctcccaaagtctgggattacaggcgtgaagcccttctgcacctggcccacattcttataattcaggagcttttagtgtattttggctctgtagtcattatcagacatagaagaggcaagaatttgggctacaagggctggagggtggcattgggattttctgatcacatcaccagacattaatttacatttgttcttcagggaaactccctaccattatctgggtcgttgctccctaccaccgtctgggtcattgcatagttacccagggtggccgtgaactagtcagcagccatttagaggaaagcctgcttggcttggctggttcaggaggcggaggctgctgcagggcctgggaaggagtaaggcagcacacggtggctgttaggtcatttgtgttggatgaaagagagttggtgcacagactggacggtgtctcagattcgctggggtttacgagtccagaaatccatgagtccgaggaagtgggaagagagaataagggaagggaggccggaaggtaggagagaaggggaaatccaggcagccggatgagagataattttagagtaagaaaccaacaaaatataatattcattatgtacccagattgaagtactatggtgctaaaagttgtcaaccaaacaccaaaattagcatatctaaaaatcatcaagacggtaatgcatagttaaaagaacagatgtaaggcagaaaactcctccagttcttcagtgaggttatttcatgacatagagtcttgattatttctgtctttgtagccacacggtcattttggagccagattcagtggtgttaggaggttgtggaaagcactcagcggacaccttctttccctccctccccaggctgcccaggcctcctcaggtgtgggagggctcccgagaccctctgcgcccttccttctcttccttattattactgtgccttatgggtaaagta

SEQ ID NO: 39487 - DNA, 1028 bp, Homo sapiens
gatgtttatttttaaaggaatacgtaagaatcaaaattccatgtactgaaaggaatgtaaaatattaatacatctggagtggtggctcacgtctgtaattccagcactttgggaggctgaggtaggaggatcacttgagcccagtagttccagaccaacctgggcaacatggcaagaccccgtctctacaaaaaatacaacaaaacttagctgggcatggtggcacgcgcctatggtcctagctactatgggggctgaggtgggaggatcacttgagccgggtaagccatgattgccaccgcactacagtctgggtgacagagtgagaggccctgtctcaaaaacaaaagcaccaatgtaaagtacatctggtctccacaggggacttcttttaagttcaaggtgtcttatttaaaagaggctgtgtttggaattggattgcagcaaatgggggttgttttaagcctgcccgcctctatattctggaagttatattatgcctttgaaaacaaattggcttggcgtggtcaatcctgcttttagttaatgttgaggatgtgggaaatgcaaccatgagcttgcgggagagatggggtcccaagatttagggacctgtgtagaattgggcatctttctgagaaggcagattgatggtaaagaaaagtagaatctttggctagtttgatgtttatgtgggtgcacttgaaataggatgttgtaggcaatgccgtctcacttttgggaggataatactcaataactattaaaaatcccctttcatcccttgttctgtactcctcattttttttttaatacaacaaatgctttttagcctaatctccgttaattgtgatgacaggtttttaggtgaagacccatcaattatcaatagactattaaatattaaatagtgagcaagaaattcaatataaaagtgtgtatgtaacaataatattcaaatattgttgaaagactgcgtgcttacgtgttttgagtatacctaaagtggatatactttgtgtctccat

SEQ ID NO: 39488 - DNA, 1050 bp, Homo sapiens
ctgtttttagaatactagaaatagtgacattatagtatggaaattaaaaaatgcctatgtttggagcattatagtttgaattcagaagtcacttggaataggagatggatgtctttccagcagtcacataccaaacatttattaaatgcctgttataagtcagacagcatatcgattttcataattttattacttatacttgacacagctaggaagacagtacaatattgtttagaaaaggatggcttggagagaggtaagggttaaaagatgcacttgggtttctttaattttgtttttttattaaagaaataatagcaataatggttgtccattgggtgtcagaagttggggctataaggaaaattagggtgaggaaaaaacatatctggccttaaagaacttactgtctgataaaggaggcagagataaacaatgagttgcagttgatggtgataaattgagtatctgttaaataagagagctgtggggaacggtggagccttgtgaaggcaggctgctggactcactggtatttccccaggctggaagtgcgtcttccgtttacagggcagccacagctgtgctgggtacagagtgttctagaaatgggtttggagttgtgtgctcaggcatcggcttggtggtgcataagagggctgtccaggtacagggcgggctgaggcctgataggtcgctgggcctgtcaccttgaggctaaccttgtttgtttgaatttgtccttctggagtttggatttttcggacccctttatgtcctctttcttacttttgatcttcaaggaagtttattgataagatttctgatcaaagaatggggcagaaaggagaagtgtctctaacagtccacattctttttgataccacagcataatcagaaggtctggcagggagggagaagggaagattctagaattatcgcacgttagaacaataaggaacttcatcccatttgccctttaattaaaaaaaaaaaagaaaaaaaaaggccgggcatggtgccttacacctgtaattccagcactttggg

SEQ ID NO: 39489 - DNA, 1085 bp, Homo sapiens
caccaaatctttaaagtgaacaccagagtattgaggaaggcagagaaggggaaggacccgtgcagccttggagtgggagtgccagtggaagagaggactggcagttctcggggtctgtgctcctgccttccatcttcacctcccctccgtccctcctcttccagcctcagccctcacctctgcagcgagactgtccttgccgagcacagcagtggcctccttgtcaagtatagcagaagcctttacccttcacctgactgcattcctgggctgcatttggcacacctgtttcgttgctacacctgactcccttccctcctgtaagagcacactctccagagtgtctacattttctggccattcttccagcttgtctgtgggttcattttcccttttcccttaagcggtgatattctctaggattctgttcgctacccattgttttcctttcatatattcctcctaaataaagttcatgggttttattgcttcctattgattaattcatcaattaatgtgctgggtacactgttcaacttatgccctggagatataatagtgaataaaatagagaaaatccctgccctctgggagtggatgtcctctctgctgacttctctacctatttttccaggtcaggccttactccccaagctgcagctcattatgtctcttccttctgggcattttcacctggatttcatatcagagcctcaagtttcctatgtaaaccactgaaggctcccactcctggggatatggtgattggcttctccctctgcacactccatctcatttggctgctggcttccatcactcatttggtctccaaatcctgccgcatttcccttctaactgtgccttggagctgggcttgcttcctcccaccactgctgccagttcaggacctcagcctcacctgcctgccagggcaacctgacctgcttccagctgggtcaggtgcccaagggagcagtcctgtgttcatctgtcagaggcagcctgagcctgtagaatgccctgcagggctcacccatgttctggcttctgcctgcttcagcatcttcgtaaattcgtgcttcacg

SEQ ID NO: 39490 - DNA, 1025 bp, Homo sapiens
gacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggtttgtgctggtcccccgacccgctgcttttttgtaatagttttgtctttgccttttgctgtccacctaagattgatgttaaagagaattagggggcattgcacggattttctgctttaatttttattgtttctttaatcacaggtataattttttttttcttttaaagatggaaaggtgagcttcttaaagtggacagaatacctgtttggtagaagggcagcaggaccagctgtatttgataggtgcactgtgtcataaatttgcagcaggttataacagatgtaagctctgaagtgaacttggcattccaacatttttgtcagactgtgtcagattttgagctgtgaatagaccatcttaaggtgaattttcaagtcatttaaaggtcttttccatgaggatggcatcaagtttttaaaattgaaaaaaaaaaagtttagtctcccaaagttattttgctttcatttcttaaattatttcttctgtaccttttgaaaaaggtttctgtatttcatataagaggatttgatgtgcatctgttttgttaggtcttgatgggttttgtgtttttacttaaaaaagacttttcctgttcttaagagacccaacattttccttttttttctctggaatcaaatggagtcaccttagatgaccatttaccctctagcagtggtaaacctagtcttttggatacttgaaagaatacccctttatgctggctggagggaggatgaaatttggaaaagactaaattagattcaaacttgttagggtatttagttactaggagcaccagaaaggcttatttataaatcgccataccgtacctaagccgccagggagtgggtcaggctg

SEQ ID NO: 39491 - DNA, 1052 bp, Homo sapiens
ttgttcacaaacagggtcctggcactgtgattggctgctggtcccatccatcttcccctaggattaatgtaattggctaagcattgttgtagttgtggctaataatgttcttcagggaaaaagttgaaagataattatgacattgagtatttattgagtggacatcaccacctaggcatgactttgctttggatggcttccagaacgttctgtgtttggtttgtgaacctctaatgagctgaatccagttcatttaatattgctcgtatatttctgcacaggattaaaatgcaggaattcaagtttgtaaattgagttgcccacttaccagctgagtggtaagttgtctttggctcaggggtcacagtttgattcctggctggcgttctgctcctgtgatatgaattttaaatgagtattttgttagaaagaactgcagtgctgatgtgaaatttaacatggagaggagtatcactgtttattttttgtctctgagagtctgaaggaactggccactgactgtgtttgattttagtattaccctggtgatctttgatttgtatggtgataattttgtttttgagatatactcgtgactggatctttgaagcatgacgtgataatagtacatcattttagtctttattaactggaactagatttgtggtctttcacttgccagttctcccacatcatcaggcaaatacatggctaaacagattagttttgcacggtgccctaaaaactagtctacttgggtttttgttgagttcaggggggaaatgaattttctatgcctctgtggagaatattctgcctccaggcttctggaattcagacatggggttggttaacagaagtacattggttgatttcatctattagacagctacacagaagaggcataatttttaaggttactagaatctgactctgagtttttcagattaaaaaaaaaacaaaccttaaagacaccaagatattctttgctggatcaggaatgcaggttttgtttcatttttcttatccttcgtgatcataaatgtacacct

SEQ ID NO: 39492 - DNA, 1028 bp, Homo sapiens
actttatagcaggaacatagaatatgatcattgttttgaaatagaaaatggcaaaattaaatataaactaattatttttgttaaggtgattcatctgaacttattacttcatattgaagtaaaaacaattcaaaacaggtttccttgaagagggcttgaaaaagatttgtattctaattttgctgcatgttttttgagtaaaatatttatttcagaacataagcattttatttggtaccctcttaacagccaaaacacttcttccaatgcaaatgtttattttggcagcagatgtttctaaaaaggagacaaacattacaattgtttggctaaaataaatgtttcctttggggttattaaggcagccaggcaatttctagggtttccacctgtgttaatttatattgttgatctattctggaaaaaaatgtgtttcttttaaatgtaattaaagccacgttttgatatagtttgcatgagagctctgaaaagtaaggatgaatggggagaggaagactggtttaagacttaaaaattccagagtttttcatcatgaaatgtttattatgattcaatctttgaatcctaaatatgaatccaatagtcagggcttaatttttgttttatttaaaaaagagcctagacttcctatgtttgcgactgtgatggtgtgtccaggatgagaaaggatagataacttgactaagtataatggagaggaatgggtgcctggtgcctgttttacattcagactcttaattttttgagtctctatatttacttaaagatgcccattcatatctgtgtgcacatgtacgctcccacatgtgtgtaaaaaacagaacattcatgtgacaatggcattcttgtgtaatgaaacgtgtatatgtatattaatttatatgttaaacatatttgtagatatacatatataaacacacaaatgaaatgaaggtgaacattttggccagtaaaataatgaaatgctatgaaatttcactatgttgtttacagcattttcatacatt

SEQ ID NO: 39493 - DNA, 1036 bp, Homo sapiens
cttggatagttgtagtagctagtcctcaagagagctggagacaaacgtcttttggaagaaagcttcagtctgagatgcaccacagaaaagacagctgtgcagggatggttttccagcctgagctgccaacgatagcgagagcgtacctgaaagcaagagctcttaaaacgctctaagtcaccgaagcctgtcggtgggaatgggaggatgggggagggatagcattaggagaaatacctaatgtaaatgatgagttgatgggtgcagcaaaccaacatggcacatgtatacctatgtaacaaacctgcatgttgtacacaggtaccctagaacttaaagtataataataataataataataataaacaaaaaaaaccgctctaagtaaggattagatgtttctttataatcagtatcataatcattgtttccaaagagaactgggaaaaggtaaagcccagaataattattggcctatgggatctgtgacctcagatactctcttaaaagggtcagccaacaaggaggcttccctttttttcaattagtatattaccttgagatttccagtaggatcttcaggcatcccaatagtcattttccagacatcttaaggatttacatctctggaggttctcctcagtgtcctgggcttcatggagaaatagggcctgccttcttttcttcctacttgtgggtcctgtgccattcgttaggggtcatggagatgacaaggtcttactcttcagtaattggccaaaatttgatggttagtgtcttagtttcttttctgttgctgtaaaaaaaatcacagactgggtaatttataaagaaaggaaatttatttcttatagttctgaaggctgagaagttcaaaggcatggtgttggcctctggtgagggccttttgctgcttcacaacgtggtggaaggcatcacagggtgagagggtagtagcgtgctggctcagatctctcttcctcttcttataaagccttgagtcccattgtagggaacctcattctgatgaccttat

SEQ ID NO: 39494 - DNA, 1035 bp, Homo sapiens
tgtggaattcagaaaattaaggtttcttatgacccataacctgaggcagttcaggaagccctttggggctgtgaagcaggggtaggggcttgtcctggagcagagcacggaagattcaggtgtctgcttggttcctccaggctctgggatgttaagcttattaaatagcctctctagacccagggaacatgttgggtcagctttcaaaattgacaaaattgtctcaggactgaggaagtgtggcctgttccacagtgcttacagcctgctgctgtaaaccgtcgcggtgtgcccccgcacccatcccggccatcctgccacgcggaattgtgtccacctctagataccagctaacactgtgctatttgcttgttgtgtttgaatatatagggcacagatgaaacagtgaaagatttaggaaggttttattgagagttcatttcttttgcaaaaatgttacagcacattaactgctgtaattaccataaataattaaaacaaaaatatgatcataagaataaatgaacaaaatgtgttaagttgtaacatgggcctctgttgattgttctggcctgtttacttccagtcaattactaggcagtttttgtccacttgggctgtttgataaggcttttgtgataaactatgagttcggggcagttggggttgggatgggtgcttatcatatatcatagaaggcatttcatgaagcataaaattcaaattgtaataatgtcactagtgtctaagttaacacgaagagatgaatgaacataggtcagagagatggggaatgatgtccacttttggaagagcaagtttgtaatactattatctaagttattcttaagaattagtaatagatttttaaggcgtatggatgatattatacatttaaagcccattagcgagcacattgttttttgattttcgaaagtttgggaattagtcagaatttacactgagagtagacttcagctacaaaaatattgtgtgcaagtgtaccttctgcacagggttccggtgtgtctgagg

SEQ ID NO: 39495 - DNA, 1735 bp, Homo sapiens
attattttataatttatacaccagccttttatacagagcaatgcttatggcagcttctttctctgtgttaactggtattaaagcttttctagattaaaagccgtaggttgcaaaacatggttttttgcatgtgcagttatttctttaccactgagttgtccttccaagcctggtctaaatgtgcttgaaaatcaccatctgctccctgcagtttggagagggcacagaaagactaaggtgaaaagctgtcacttctaatgttttcattcagactttcacacccttcttgtctagttacataattgtatgcagcaggagttgtttcaaccatttggtcttgtccttattttgagagagagagagagattaattttaagagagttgggtcacagtactgaggcagatttgagaatctgataaaccatgaaagtgttcagaatggaatcttcctgctcagtcagtttgttagtggataagtccattgcataaatgacatgaatatgaacaaaagcacctatacttatgcatatatctccctttgcagaatatgctttaaattttgcagaatatgcttacaaatttttaatgccgtatgcttagattttactttttgaagtcagtatagcacagagttgatgatataatagtgctttacaattttatttgatgttcagaatttattatagataatatagaggaaggattttgaattgttcacataacttattttttcagtgtcttctttttttttttcttaaaaattgatctattttggttttgattggaatgaatggccacaataggatttgaaaatgaaacaggacagaagcctgttagtgtaaactggcaataatttctaatagtcaggaacaagaagaccattaaatcgtgggatttatgccattgaaaaggtagtaagataaaataagaatattactatactctagaactgtaaattttgatctttctgcgagttaattatctaacatccataccaagctggagacaatagctgactctttcatttacttggaggtgattgtaggagaagaaaaggatttcagtcttcagttggcaaaatgatggttctaacttgcatgtaatggaatctttagtatacccacaaaagattatttcattaagatgttaataatagatttttgaggaacagcgttttatacttttcataattaggacatagaacttaaaacagaaattcttttttttccccctctacttcttttctagcttgagaaaatctggatctctttagaaaaagcctttggtctatttaagcactctgtttgtgccagagttacttgcttttttgtgcaaccaacattttagaatttctctaatgacacaaaaacttggtttggaaaaagatacacattccaggccctcagagaacaatagcagagccacgtagtaggtctgtcagccaccttgtacactgtggtcgttagtagagccgagacggagaggtactggttgtatgaaaggtagacagaggagcctttgcaggaaggataggtgacatttgaaggtgccagtgaaggaacaacaggactctgtgtgtttggtggtggggaggggggacaggcatgttcttgacaggggaaacagtttatccattgctttataatcctagactggcatggtgtgctgacgaagagtaacctggagaatgtgatagaagtctgggttaagaaactagaccaggccaggcgtggtg

SEQ ID NO: 39496 - DNA, 1060 bp, Homo sapiens
aacatgacaccacaagtggaaaattccatatttgacctcatgtgatggatcacagtcagaacacatgtaaaacattgtttcagtcacacaagtattttaaaacattgtataaaattgccttcaggccatatatgtaaggcacgtttgaaacataatgaatttcatgtttagtcttgggttccatctctaagatatctcatttgtgtatatgcaaatatgccaaaatctgaaatacttctttttctaagcatatagttttagtttacatttatcttgttatgagtaatgttgagtgttgtcttgtgtatttaaaggcatttgtgtttcctttttcctgaactataaatttatatatattttgaattttctctcttcagttgttggtctttaaaaattatttttaaaatcctttgtatattagggagactgggcctttgtctgtaatatgagttattaactccagaggactggaatcaatagaatagaataatagaatagaatcaattgtgctcacatatgcacgcacacacacacacacacacacacacacacacagatttattataaggaattggctcatatgcttatggagttttgcatttccgaaacctgcagtatgggctggcaggtggtaagccgatggtctgatgaagtcaaagacagcttgctggagaattccttcttgcttaggtggggctggtcttttgattatagttaggacttcaaactaaatggataaggcccacccacattatggaaaacaatctgttattctcagagtctccgttgaaattgttaattccatttacagtaccttccaagatcacatgtaaaatcaaccattgcagctacctttccctgatgccactaaaatcattaactgaatttccttaggtatatggtgtttggggtcattttgggatttctgttattctccattggctcttctatgaatgcattagtattgtactgtttctctattatcttttagtatctgatggggtagtatatcctcattatccttctttttcagttgttggttttctttttccttttgcta

SEQ ID NO: 39497 - DNA, 1110 bp, Homo sapiens
tgtgagtattgctatatatatattcctatgtataggaatttgtccatttcatataatttttcaactttattaacataaagttcgtaatagcctttattactttaatctctgtaccatccagagttaaggcattttaattcataatggtttttcttcttttattcttgataaaaccatttccaaagtgacttggtctttattgtctgtattgtgtgtccttgtaaacaaacttaatgaaattcttctctcaccttgattacgtcttgctttctactttattgatgtttattttgctgttcttcccccccgcccccactcaagtgaatgcttactttatttgaacattttttgtttgatgaagctaaatatgagactaaaattttttctcttaagtactgctttggctgaatctttcaacttttgatatgtatcatttttgttctcttttagttctaagaaatttcttgtttttctaaattgcttatttttttttgaagacatttttattgaggcctgggtttgcattctgtttcctcagaaggattgattggtctttgcttttgccaggtgcctatgggtaccagttatcttgaacaatgttttgtgtttgattttgtgaaagttttattacaagaagaatatacagatacacagaatgacataatgagcactcctatgccctcacgtagttttaatattaccaatattttcccatgtctgctgccctgtctcatcttttcctcctcttccgactttcttcaaagtattttaagtcacagatacatttcttctcaaaatcattctgtatgtgtgtataaaacgtaagggcacttctttttttttcttttttctttctcttttttttttttttttttttgagacagagcctcgctctgtcgcccaggctggagtgcagtggtgcaatcttggctcactgcggcatctgcctcctgaattcaagcaattctcctgcctcagccctgtgagtagctgggattacaggcgtgcacctccacacctggctaatttttgtatttttagtagaaacggggtttcaccatgttggccaggctggtcttgaactcctgaccttgtgatccacctgcctcg

SEQ ID NO: 39498 - DNA, 1048 bp, Homo sapiens
ccttgcaaaatggagttgggttctagactcagctaaataattagtttttttttttttttttttttgctttgtttttaaatatacccaaactttggcacttttgaaagtagtgtcggctgtggcatggtgatcttttccatcagtcactcttacacattgcaggataatctagcattcctaccctatagccactgtttaaatgcatttctgtgtccttgtgacaactaactactccgttgaaattttgtcactacatgtgttatatatgtccttaattttcctgaaattcatatgtaaagtgagttccctatgtataaaatttcaaacatgagtatgattccctgaatgtaatggaaagaggtaggaaaggacagaaagctgcctataacacatttgtgtttctcttaagtaaatgctcaggcacttctccattagaaggcttgtgagagagtcagaggcttgtgcctgggtctgtgggagccatggactccacaggtgcaaacgaggctgctacagatgtgtgggatgaacagctcaaaaccacgagcaggcatagaatccatgggatcaatgaccacacaacagtaattatagaaatgaaagtatagaagaccactttaaataacatgctcacagagttgttagaaaaggtaagttaccccaaagtctggaaatgttataaatttgtaaataaaatacaaatacatagtaaaaactggtaagaaagtaaagatttcttttcttttgctttatttgtattttctaaattatctacataaacatgtaatgcatatataatattcttaaatgttgtgtaaaggattccacgttacccattatacaatgtaaggaattacccattccggtggcagactaggtgctctcaatgtctctattgatcaaaatatctaaaatgctggctcagttcttcaaactaaatgaaacagtgaatcaaacctcttttttttttttttttttgtttaactgtttcttatgcccctcctgtcatccctttcttccttacccaactaaaattccaagcccatca

SEQ ID NO: 39499 - DNA, 1083 bp, Homo sapiens
tatattattaactacagtcaccatgttgtacaacagatctcttgaacttattcttcccatctaactgaaattttgtatctttgatcgacatcttcccaacttccagcccaccccagcccgtggtgcccccatcccactctctactttccaacaaccagcccgccccagcccgtgagccaccatcctactatccacttcccaactcccagcccatgccagcccatggtacccccattccactctccactccccaacaaccagtccatcccagcccgtgaaccaccatcccactctccacttcccaacaaccagccaaccccagcccatgagccaccatcccactcttcacttcccagcaaccagcccatcccagcccccggtgatcccattccactctccactccccaacgaccagcccatcccagcccatggtgcccccattctactctccactccccaactcccagcccttcccagcccgtggtgcccccattccactctctactcccgaactgccagccccaccccagcctgtggtgcccccattccactctccactccccaactcccagcccatggtgccccctttccactctccactcccgaactgccagcgccaccccagcctgtggtgcccccattccactctactccccagctcccagcccttcccagcccgtggtgcccccattccactctccacttctgagattacctttcctagaggccacatttgagtgagatcatgcggtatgaaacagctcttttcaaagcctccagtgttctgttattcagcctgatgggtgatagtcattccttccatccttcgcctgtcattaggattccatgcagctgacggtatcttcctcctcggagcacctgtcttgcttggttcctgggacgccaccctctcctggctctcttcctactttgtggccgctccttgcctttccttgctagattttctttatctttctggcctccaaatactggcccatgaccagggctcagtgttggcccctctttttttgtggctctacccaccttacctgtatgatttcttttactttcaaagctttacgt

SEQ ID NO: 39500 - DNA, 1052 bp, Homo sapiens
gaaagccactgaagtgttcatttcacttattttaagattttattataagagcaaaaaaacaaggacatatatagtttgttgccattaattgcttagtttttggatattaacacagtctattaactcagtaaaaaccagaatatagttaatgttattctttgttttaaaggatattattagtgaagacttgggttatgtttgaattttgaatctttttctttcttcttgctacagttgtctcaggctttgaaccattgctgagggagatttccttttaagtttgaagagcttgtaagcatccgaggagacaacttctgggtcacttagtggctgagcaaggcctattcctagactctgattgttgacttggggcttctaaccttgtgttggggccggttttgggagcacagaggtggggttagataggctgcaggagccaccagcctgcctgcgctcgctctggcaggatgactgatgccaggaggatgggaatgaggactagtgaccttcctctctctgttccctttttctcccttgggggaaaaactagtatagtaaaagctcagcactcgttttgaatataggtgtaatttgctgcgttaacagtttcagtttattgtgtgttttggtggcgttattcctgaaagcttcttaaaataaaaaaagtagaaaaaaagacccattgaagaatgaagaaaaataacattttgagaatgttagaatgtcttttggtatgaatttggttttcttaattgctgtagaaatcagggtgaatctgtagttagttgcaactatgtctgcctgggcctttgcttttccttaatagtagcagaagaaagcaagagaaaaatcctcagattttatacacatcacttctagtatcgaagcatttttggcttttaatggaaaactttcagtgtttttttaatatgttttgaagtataattgggaatttaattgcattggatcataatttgataatgctatgtattcattttcatatttaacatatattttaagttttttttttctttctagtaccagaattaaaa

SEQ ID NO: 39501 - DNA, 1038 bp, Homo sapiens
ataagctagctctgcaaatgacttcagtttttgtttcctggtaggaaaaaacgaggtaacaatagcaactatcttgtggtggtgtcgttaggatgaaccgtgcacactacctctgtgcacagtacctgtcacaagtcccctcttgcgaatatgagctgtcagtggggctttcctgaggtggcaagggctgagcatgccatccttgatgtgcatgttgtatggatttatatcgctttccttttggaaatgatatttgaaattcatctacacacagaaagtggagggaggtcaataatatgccaaatgtctgaagcctagggatgatttcacgaactgtggcaggctgtgtggccaccaggcatcctctctgtggaagtggtcgcagccacctctcccccaccctcacatgttggggataggcttctgtttcccttttacgatttggaattggtgatagggaatttccaaagcacaaagagaaaaggatcaagaaattattgagactactcaaatcgtcattcattccctcattctgaattattgcaagataataacaatgtggccatcttaactctcttcctagcatatctatacttgatgtgaggattggaaaaacttttcttaaataacatgacagttatcacttattccagatccagacaccatggaggctctgttgcattttgtttctgacctgacgctctttgttggattttgctggcatctagaggcctcctcactgacctcttactaggtgccattgccatttgtttgtcaaggaccaaggtgctcctttccctcctccattcctccatcatctgttagtttatagtctgtatgctcttaaattctttttttttttggttactgtctacctatcttcccactcatcccctgctctggttttgctactttttatgatgtagtttgacacctggagtaagttttgttctattccagaatgatggactgtaagtgtaaattgatacttcctttgttaagaacaatttgccagtatatattaacatttcaaatgta

SEQ ID NO: 39502 - DNA, 1076 bp, Homo sapiens
cgcatgcctgtaatcccagctactcgggaggctgaggcaggagaatcgcttcaacccgggaggtggagattgcggtgagctgagattgcgcgatgcactccagcctgggcaacgagagcaagattccgtcttaaaaaaaaaaaaaaaaaaaaaaaatcagccaggcatagtggtatgtgcctgtagtcctagctactagggaggcatgggtgggctgaggcaggagaattgcttgagcctgggagttagaggctacagtgagctatgattaggctgagccacagatcgagaccttgtttcttaaaaaaaaaaaaaagggggggggcggggtgaagaaataccaaactgaaaatttctgaaacaaatgtgtaattactactacgctaaacttttttcacacctttgtttgtgagtcagtttccctttaacctttgactcgtaacataaagaaggttaaggccagagtccatcaatggttaaaagattgtgagtgagatgtagaaaaacagtactgatgaattctgaaaggggaaacctcatttccattgcctggttcttgtgcattgcagtattaccacaatatggcattctatacagcagataaatgtaattatttatatgtgtatattggtttacacactggtgttcactggctgcttaaacttacaaataaccaaagatggcagtaatgttttaaagtgtaaagctgtgcttctttgtttataaaatatgatgctgaacatattctttattttctgatactgtcattgcctttttactgtgtatttgctcttcttgagatgaaaataagtatgtaccaaaaaataaatatagctttttaagatgaaaaagctcaagtttcttatggaatatttttatatcattattaaaacagccaaacagactttatagtcccactgtaagttatatgtagttgttgattgttctaggtttaaacttggcaccttttctatgtgctcccttattaaattaatacttatgttcaaacataagctgaggcagaacacgtttccttttcaatagttctcactaaattttgttttgattttatttcc

SEQ ID NO: 39503 - DNA, 3158 bp, Homo sapiens
ttttaggacatgtctcaggaaggctatggaactagatctcaacctcctctggcccccggaaaacctaaccatgaagacttgaacttaatacagcaagaaagaccatcaagtttaccagtaagacattattgtgctgatttggaaatgtaatgagttaaagacttttagaaagagctgttgtttttgtttgttctactttatattatgacatgattgagaagtttctagacttcaggtttattttgtggtcaatttttcaaggtttaccttttaggagctctgtagtcctggataagtctatttcatgtgtatatatctctgttgcagagtgtagacatcagttggaaggttttatgcggctggtcgattttgtgtgcaggtggttattgctgttgtacagttgagctttctttaggctgttgctttttggcagcgatacagaacagaggtgtccttagaggagtcaaaacttaaaagaaatttgcactttgcaaaggatacaaatgatgagataaaatacctgatagtaatttgaatttcttctaggactttctatttatgtaatgagaaatcacccaaaagaaggtagtttgaaatttgaggccagacgcggtggctcacgcctgtaatcccagctctttgggaggccaaggtgggcggatcacttgaggtcgggagttcaagaccagcctgaccaacatggagaaaccctatctctactaaaaatacaaaattagccaggtgtggtggtgcctgcctgtaatcccagctactcggaatgctgaggcaggagaatcgcttgaacccaggaggcagaggttgtggtgagccgagatcacgccattgcacttcagcctgggcaacaagagcgaaacttcatctcaaaaaaaaaaaaaaaaaaattgacaaagctgtttatttccaccaataaatagtatatggtgattggggtttctatttataagagtagtggctattatatggggtatcatgttgatgctcataaatagttcatatctacttaatttgccttcttttatagagaacctaatttaaaggaagtcttctttattaactaaaagaataaatctgcaggaggctgaggcaggagaatcacttgaacccaggaggcggaggttgcagtgagccgagattgcaccactgcactccagtctgggaaacagagcgagactccatctcaaaaaaaaaaaaaaaaaaaagaataaatctataccaataaatatttttacatttatttgaagaattgttgtcattgcctagtttctatggagaaggtttgttttaagatgggaattcagtatagccatgattttaattggaatttcaactatgtttgcattaacttagatttattacttctaaacatttgagaacagacatttgtagtgaatgttaaacatgacatttgacatgcgtaccataccatatacattttaatgtatatgcagatttagagaaggtaagtgatgaccacaggatgtctactgtctttgaatctgatggatatatttttgaaactctaatttttataccttttacttttatgtgagagagggtgaaatcttattgtggtgtttttccccccccctttagtagtgttaatgtatttgttgtctaggtatttggttttgaaggagggaaataggtaatggattttgtgttgtatgctgctaaactttctgtagcagatagttcgcagcttggtaagcatgtagtgtgtacgtgtgtgagagagagagaaggagagagacagaggcatgcatgctgtcgataaatactacatttgccaagtatttggaaattagcttttgtggttctatgaaatttaaatagatgcatgggaagcaggtaaacagtgaattccacttttttcagcagttttttagtggttttggagaggttcgaccttgtagatttgtcattggctgatgattttgtactgtgacacaggttggtaaatttgtcataaatggatgcagattttctgcatagctataaaaatagtttgtggtaaactgctttcttcatatctactcagaaacttcagcatcactcactagtgcgtgccttttgccatggatctgtgttggattggatggttgacattcagctaactctacagtgttattagggatggcatgaagtattgtagtttcagataactgactgaagagtttggtctgggataggagcttttaagttgattgctggaagagtggatgaaggcatttaggagatgaacgaatatagtcatcaactgtttaaatgttttctgaattgttctatttctgtcttgttatgtatgtataacagctatcttccttaacctttatcttgcctacttcccaaaagtatttaaagttgtccataatgtaagttttttttttaatgaaataccccaattggtattttctttccgtttttgtaactcacagataaataagatgctggttgactcaatagtacttcaaacacatttcaataatctttagagagcagagtttccaggttttatgttaagtatgtagaagattcagttactgaataaaggacaaactgtaagataacctgctacacctaaaacccccaatctgttaggatgaaatttggctgtagttaaatgaaatttattgcaccacttttttttttttccacgagggctttgcatgtgtaaaaactttctgtatggggcttacaaatattttaatttatgtggatacttataataagttgcacacagctaaggtcattgtggtttcagggaatgatttgttgatactctgttacggctctaatagtctgtattttacaatgttacttttattagatactgtagtcctctaacttggctgggttgattctggagagcccatgaagctgtatttgttatcacatctgaatttgctgttggatcctttgtagatttactgttgtgctatggttttccttttcaggtgtcagggatataaattttgtcttttcacctacagtcaatccatgatatttgaaacctgtagttttgtaatttggaattaagtatattgtgttatctgtaccatttatgaaatgcaacatagtgattctaatgtgtaattattctgttcattttatgtaatgacgatgacaagaatgcctct

SEQ ID NO: 39504 - DNA, 1402 bp, Homo sapiens
ctaccaggtaagaattaggtgtatggctattgaatgaagtattttgaaacctttttatttgaggttgatttaaatggttgtcattaaaaggttaagagtggagctgtcttccgttgattgatccttctcaaatccttatgaacattaaaaaaattataagttaatgaaggaaaacccatatctgtcatcaggcttatctcagtgttcaggcatggatgatgcctgtgtgttgctgaagacttaagctgtttattatcagtattctcaaaatgttattaggctatgttgagttttagagtttcagagaaaatactttataaaatggaagcctcctgtgccagggaggaagaggaggttctctgaaggatggtgccctgtcccccagaacagctacaggcataccttatcatctgcatcgtttcaaaaccaaaggtacagatgcattttgatgtcttggggaagttttaaagggaacatgcaatacttcagcttcttaggattcatcaagttcttgaacataattttcatcactggtctgttctatctggagatatcagttatttttggattaagattaagagcatttcaggaccttgctggaaaacctgaatttagaaaatatgatagtgactctgacagatgtttattttccaaaatggattatttctttaggatgtgatatcctgtgattttattccctaggatattttcatgatattgatagtcattttgaaaatagaggataatgcttgaacttgaacaaggtaggaagcaggaaggtatgtctgtctccttctttcaaaacaatcttccatttaaatatttgttctgtaaatgaaaattcaataaaaccttaacagtttggaattcttccaggaaaaaacaggctaaatataatggaaagtctgaataaattaatattgagaaagaactatagtttgcttttaaataattcagatgtttgtgtgcaaagtgtttctaagttgacatactcagttcccgttaaaataaaattctgaattcgtcatagctgagatatttgcttagtggtaatgttttaattttaagaatttgtttaattttttaaaatacatttcaactaagcatgcccctgaaaactttttcatatagtattctgaagatttccatttaaaatatgggggaaatgaatttcaacccattttataggagtgtcaattagttcctaaaaaattaatgaaggagtatgaaggagtactataaaaaaatagacactagacaaaattggagattaagagaggctgaagcataactgatttgcaggatattggttttgataatagaaggataaggatgatctatagttgataaatgaggctcattaagtaagagatgataaatgcagatattcctggctaataga

SEQ ID NO: 39505 - DNA, 1836 bp, Homo sapiens
atctccctgagtctttcttttccccatgggcatgggtggttgagctgtgcagtgagtcagtccacacctggggaaaatgtgtagttggtcttttggaattatgctgtacccggaaaaagtttggctttagaatggtaatatgacacttcattcattggacactatttttgaaagtctggttgtatataaatgaaaatagtgtctgggcatggtggcccagcactttggaaagccatgagtgggcagatttcttgagcctaggagcttgagaccggcctggccaacatggtgaaaccccatcttcactaaaaatacaaaaattacctgggtgtggtagggcatgcctgtggtctgaactactttgtgaggccgatgtgggaggatggcttgagcctgagagatggaggctgcagtgagcagtgatcacgtcactgtactccagcctgggcaacagagcaagaccctgtctcaacaacgacaaaggtgaaaatattagttaatggacactagaaactgctagtaaaagaagaataatgggccaggcgtggtggctcatgcctttaatcccagcacttcaggaggccaaggcgggcagaccacttgaggtcaggagttcaagaccagcctggccaacatggtgaaaccccgtctctactaaaaatacgaaaaaaaaaaaaaaaaatgttcgccgggcatggcagtgcacgcctgttatcccagctgctcgggaggctgaggcaagagaattgcttgaacctgggaggtggaggttgccgtgagccgagattgtgccattgcactccagtctgggcgacagagtgagactccatctcaaaaaataaaaaataaataataaataaataaataaatatgcccattagtgagtgtccaagatagaggtgtgtgaattttaaagacagggcttcctgacatctatgtgcctgcctaaagcccactccattcttctatagtatttcgaaagtctagagctttcaggttactaagcgcattgtaacgcccttttaacatatgcaaaacttcattttcgaaatgctgtcatgaccctggagcagggacacaacttgagagtgttagctcagcgatgctgtgaaattgtggtggcagtgggagtgcagaggaagaaaattgttggaatagagggagggagggagggaaggaggatagatgcttttgaggtttttaatctgtgtgaccaggatgtgttggtggcgttgctgacaaacacagggaaacggtggtgggaagagaaaggaatgcccagagatttttatgagagtaaagcaagtcctgaataactgctcaaatcctgtaacatctaaaaggaagcaactcactcatctttgctactaaagccttatttcttatatagttctttatagaagtaaaacattgtcataaattagaattgatgttgaaatattgatggcattggctataactttgcatttcatttaaatttttggagatgatttgaagggtattgtagcagactgtgtataaacaactccacacatcatcccagagtgtctctaactgtaactgggactagggcaagagcacagtcccaagataaaaattgaaactctgtagttcagttgggactcaggctagtcttattttctttgcttttaggatagtgcagtaaatttctatccaaataggttcctttccttgggtaaagacaagttactttgtatttctttgtttgatatatacttttgaatgatttgggctacattcttactttagttcattttggaggaatatttcttagtttaatttgtctcattattaattcctccttctctgaaactt

SEQ ID NO: 39506 - DNA, 1028 bp, Homo sapiens
ggaatatatactcttttgaaaatagtgaataatgagtccaaaatatgagtttttaatatagtgctaaaaaagtggtttcatgtttgggaaaattatcaaaggcctaaattaggtgtcatgccacataaatgattgaataattatctgtttttgctgtaacttgcttaactactttgttactctgtccaaagaagtagcttattgaacccatttttatttcacaataatttttaaaaataattattttataagcataaaacgtgtaccagggtggaaacccatttagtcaggaaagagttgaattgtgaagagagtgtttttttatacatgtgtttttctttgttttgagggataggtgtgtgagtgacatttgtaatttagcttgtttttctgggaagaagattgctgatccttgggtttaaagatgagggctcaagattaattgatgagactagtgatggtctaaattttacagaacatgcatgccactaatagcttaatagttaggatgataacagtttgtgagtgaatttatgtgctttatttttctcgaacttactgactttgaatacgttataaaattggagctgtgctcctaaggagtaacatggaactccatcataggtccacctccagcaaaaggctagcaggggtggtggggacactgaggctggcttgatttcccatcctgccccccatggttggtcgtgggaagaaggtcgggctgccgtggctcctgtgcactttggttgctgagagtggttgtgggcagcaggccggtgagcagtgggggcagggatcttgacaccagcccttgttggactccacacccttctgaccattcatccacctttgggagtggggagcagggtctgttgaaagaggcagccgtgtcatgctcctgttagtaagggaactagacttttttgagcctaaaaccatacaagagaattcaacagaaagagaatttaatgtatatattcattcttgtaaaacaataatattgtagtaaaacttacatctgtgtg

SEQ ID NO: 39507 - DNA, 2528 bp, Homo sapiens
tacctctgggaaaattactagctgggcattttgtggcattctcaacctcaactctagggctagtgcttttaaaatctggtcaactgcgtaattgtgaaacagtactgtgtcagctttatgcacttattattatttttttaagacacaaaaacttacaaattggcaaattgtttttcagtgttttccccttcacagggctttaaaaatatcttgagtatgttggggttagattgggtggttggaaagcaaagctccaagtgctagaatggacggctgccctctgcagcttcaacacagggatccactcagcccccttagctgactactggtgcttaaaacggtttttgacaaacgccagagtttcacaaatatagaagtagcagttatagaggtggttttgcaagtcccttggaacattcatgcaggtctgcagtcactcttaatttgaatgagaaagaagatggtagaaactatttttattttctcctgggagcaagagaaaaggaaggctagaactctgtactatgtaattttaaaaaaagaaaaaaatcggactccattgagattctttcttgtttactttttgttttactctctctgtctcctagtatgtttgactaatgtaagtcttcccccaggaatatgagaatatgtggtaccgtccgcctcataaccttcctggatatttttataatttatcatcagctgacactgcttgggtagaatattcttaccactccctctggctgctggaagtctgaaattacatctttgtctttgaagtcaggcatactgttagcgttgctatggtgacagggtgggtaatggcctccgcagacaggagattggtatttagcgtttaaacactgctgtacacaaggccttgatttttagagtggttactgaactatccccttttagtaaatgtttaaaaattacatttttacatggtcttactagattaatagtcatggtttatttcattttaactgcaaggataaaagcattattccattaaatgggcagcttttttttctcttttggtttatgcattattaacacaggctttcctgttttgcttgtaacattttataggctttttcaaacacgcagtcagatttgctctgttgctcctttattttttggacttagcccattatctgcttgatcttggacaatttcagaggagacaaagttctaaggaactaagcttttaaaatattaaaaatgaagttcttttttttttttaatgtatgagtgataatattgatcaagatgtctctttggtttcaagtttctagttagcccctttcctgaactataccctcacatgagatagtaaaggaaggacagtttatggttctggagaactgttggacattttgaaaatgctttagttgatgtaactttcgaagcaatatgctctgacatagtcagcctgtgtggaatgaggccgtttgcacacacatacatatgatttttttttatctgtgagtattttgtctttagaataaagatgaatcttaatagtttgtatggtatatacaagtccctgtctacctgatacataaactgctactaaaacatcatttttaatgtcttgtgatacagaatttattactttatgaggtattttatttgtggtaatttaaattgtttaggaagtttttccttacattagctcgaactgttttttttgtttgtttttttaaatcctggttctacttctgccttcttaaaccacacaaggtaaatctaaatccttcttctatatgacggctgttcacgtatttgaagatagttttcatttactaggatttcttctgggctattaatagttactttaactatttcccccactgtgtggtctcaagttcccctgcaccctattcttaattccttaatgagcttcatttttgtataagcacctctaaatgtgatatccacaaccaaagggcaggctccaaaggcatggctggcggaggccacctggcccgctttgtgttggaccgtcacgctgccgtgtatcggaggcgtcagggtctgcagggctttgcggcagctgcagcccactcttgccactgtgatgggagctgctctgaaggatacgtctcatccatcctgcacctgagctcaagtgctcatcgacccttcctggctgctgttggactgggtcggggctgttgttcaagcttgctaacgtgtgttaggatcctgaatctggcatctgttgtatttagtgtaattcctacctttgtgtcccctctgaatttgtatctcatgatagctcttaatacagaaagttaaataggctaaatccagagctttctgacattctggttattgccattcaaccaggtgtgataaacctagagctactgtatgttccaggccatacattacatattaaccacaatcctgtcctagagactttatctgaggctaggtggggatccagaacaacgctatagtcctttctgtatatgttatagtgctgtcttccagaatgacttattgtggattatata

SEQ ID NO: 39508 - DNA, 1034 bp, Homo sapiens
cctctgctgggtcaccatggaggcttctttaaccagcctgcagtttcagcttgagtttggggtgaagggtggatgacagcttcttagtccactgatatcttaatgagatttccattcagtgtattttgcatctccctccaaaaggaaaaatatatgagtgaattttgtttatagcatgtgtagcaggcaggatgttgcagggactttgggatattctggatcagcactgtccagtagaactttctgcagtgatgaaaacagtccctatctgtgttgtccagtatgtcagccacttgccatatattgttatataccacctgaaatatggctagcagaaggaattttgcgttttagttaaatttaaacaccctcatgtggctagtgccgaccatactggacagtgcagttctagattatggatcccatatggtcaggatcttattacagactgaatttggtgaaaataacaatgttaggttaagactctcaaattcttggcatgtaagttattgatttgtaatgtattctgagctggcatttaaaattacctcatttttacaaggatacaagagattgaaggaacaaatatattttagatgtagagtttatctgttgcagggtttggcatgtaggccaggaaccaagattccaggagtaagaatggcacacttggtgaaagagtgctgtgcacttggatgctgatttacaagtgacagagccactgtgtcccacgtctttctccttgcctgtttctctgggttttcagttatctatgtttattggaaacagttatcacagagttgagtaccttgaagatctcttgtggacatccccacttccttcccacatactcaccagtaccagggtcagcttcaggtaggaggatggcacagactcaaggtcaagcagaggtgtgagccacagaagcagagtagcaggccaagttccagcatcctggctgccaggaccaccgtgcaggcttaagaagctggagctttaggatatggagtgtccatcacttggcatctttctca

SEQ ID NO: 39509 - DNA, 1032 bp, Homo sapiens
catcttgctgccccttccaagccccccaaacaactggagttctgtattctgctagggaatctgttatgtggtgtagccttcctcttagacttaattcattcacttttttagtgctctacatgtttagaattttcataagaactgcattttacattcagtataatgtagttgggtagttagaataatatgttccaagatctctgattcatttgtcacccgccttgcaaactcagctttggcttgttgtccacatccatcccactgcacacggcagtctaccatttgtagtccaatccatgccttctggctccatttcctgacatcaggaggttaaagactaacttgttttctcctagtcacagctccacacctaggaacagctttttcacttttaaacagtttatctctgttccccctaccccctttaaaaagaaagaaaaacactaggaatgagtaatactgatttctcagtatttgtttgattctgtggcatactgtacacttcagcagcaaaagtagatggttgagttatattgctagttcttactcagtctataaacctaattcgttttatttatgatgggagaaggagaatttatgaattcattttgttaagcaattcttgagcctttgtagtgtgctattatgatggatacactcctggtttgaagaaatacagagtccctgagatcgtgaagcacttttcagcaaatacattttgttgcagtatgcatttacccatcttgttgaagggcatttaaatgttgtccaaatgtcttaagtatttcttttgaataatcattatttttaattatagtctggatttctctttcctcttttgtgaaataatcgtcttcctccttccttttggaaaagtcagtaatctgggtaatttctgctaaaaaaaagctctattaaaaccaaggggtgattgtagtccagttaatgaagcaaagcaaaaaaagatgaggccaggaatcatacggagttagtttactaatgaagcaaggtacttttaaaaggtaaggaaaa

SEQ ID NO: 39510 - DNA, 1104 bp, Homo sapiens
gtaaaatgaaatcaccggtcaggctgttaaggaggtggggaaatgccaactttgcctcttccgggcagtgctgtggtgatgcagccttgggccccgccagcagcggcttgctggctggcgcggggtcctctcccgggtccgctgcgttgcgcgggcaggacagtcaggtgagcacaggtggctccgttcacctgatcttcagccctgtctccactcaagtgtcttcttggtggaagcctggtggtccttagcagtactgggagtatttgaagactaggccagaagggcagggtcgctgtgtgagctgcgcttaccacctgttgaatgtgaaattgatacagaggtgggatgtgctggttgtttcttgaagtacaaataaatgggcacacggggctgggagcaactcgtgtctgatcttgtttatgattagtgttttgtttactgaggaatgtatttttaaaaagaaaatttgtattctttgtatttcaaaataaacataatgttggggtggggagcagcctgccacttctaatctcttctaagtcaatttcaccataacactgaccctatttttactagggtcagtaaatggactgatttctctgatagaataattttacatatacacaaatactcttaaaaatactatagaaaggccgggcgcggtggctcacacctgtaatcctagcactttgggaggccgaggtgggtggatcacgaggtcaggagatcgagaccatcctggctaacacggtgaaacctcgtctctactaaaaatacaaaaaattagccgggcgtggtggcgggcgcctgcagtcccagctactcggaaggctgaggcaggagaatggcgtgaacccggcgggcggagcttgcagtgagctgagatcacgccactgcactccagcctgggcgacagggcgaggctctgtctcaaaaaaaactatagaaaggtaaatgataattcagcaatattttcctcttttgcctgtaatgtctttaaacagttatttctaaaaagctgtgttataaaattttattttttaattttagaaaaagttttccagatgtctgtgcctgtgtctatttcttttctcttttggg

SEQ ID NO: 39511 - DNA, 1046 bp, Homo sapiens
tagtaggcgttaactgaataaactaagtctgcacttaatccgtgaatgtgtattaatagttgtagaaagagtagattaaacacatattaagtttcaaataaaaacctagtggtttcaatttagggaaaaatttgttataatacaaatatgtacaaccattagtagcctctttttccagctcttttatatttaatgtggttttgaaattttggaacctaatggagaattgtagtttgctaattattttggggggcagtttgtgaacaataagatttttttattgttagctcgattgtccaaaagtcgtatttaaatatacacttgtactttattgcagactatgaaaaaatttattaatcattaataaattctgagacttttcagattagacttctgaaattttgtctttaagttgtgggcagtgtatacttgttttaattactaagatgtattatttgtgtatttacatacctgctttgcttttattttcttttaatgaagtaccagcacaaccacatgagatctctggcctcatcacagggaccacaagttctcatagagagctaagatatgtaggatgttttgcctattttcttttcaataagtgggactggcctttatctgtatgtactgctaatttatcattcaacaagacaggcccacagccaaacaaattctgattaaccatttcttgcttaacttgaaatttacattaaattcctataagtgtgcagataatacttcaatggtatatcgcagtcctcatatataagatttaagaaggcatactttaaatttttgtttattttctcgttttggtagtgtaaatgcttagaaccagcatttcaatttaagggaaaatcactacaatacagacataaataacttttcttttcttttcttttttttttttttttttttttttgagacagaggtttacccttgttgcccaggctggagtgcagtggtgcgatcttggctcactgcaacctccgcctcccgggttcaagtgattctcctgcttcagccacccaagtaggtggtat

SEQ ID NO: 39512 - DNA, 1045 bp, Homo sapiens
actcctgacctcaggtgatccacccgcctcgtgctcccaaagtgtagggattacaggcatgagccactgcgcctggccataaataactttgtttttttgctttgagacggagtctcgctctgtcgctaggctggagtgcagtggcgcgatctcggctcactgcatcctccgcctttcgggttcaagcgtttctcctgccttagcctctcgagttgctgggattacaggcatgtgccaccatgcttggctaattttatatttttagtagagatggggtttctccgtgttggtcaggctggtctcgaactcctgacctcaggtgatccacctgcctcagcctcccaaagtgctgggattacaggcatgagccaccatgtcctgctataaataacttttaataggctctttttctggctttttcttttagtaactcagcccattttcttcttctcaatctggtctttgttaatgttgataacgctgtcttacttttaaattgccgtgattagaaattactagagatatataaacctagtcttttgggggattttgaaagggtcatagtattcttactgtctttcaaaatgtaccttatatttgaacattggaagatacgtgttgctgaatacaagttagtttcatacacacacatacacatggccacatacatacacatatccacacatacaaattcacatgcagtcttttcagataaaaatatttagcgatattaagacacaaatcaccataggaaatgtcattaaatagatatgaaaaagtcatgaagataaattagctgtcaccaatgaagttaatgattaatttggaaatgggtttttttcctcctgatgcttttgtcttttgactgattttcaatgctctgtaaatgatgagtgagagaagaggaggagggagagaatgtgtgtatgtttgtacatttggtacgtaagatttgtttcagtgcttttaagacagaagaatattaatttgccctatatattcaatttgaaataaaaatttccaatctgttatggtttaccttata

SEQ ID NO: 39513 - DNA, 1004 bp, Homo sapiens
attgaaattggtgataagatttgcaaggaactttggttcattcagtagggagcccagttttaaattttacttttctttcagttaagtgaatttttgtcattgatatatgcaaagttcagatttgtgtagactttcggggtactgaatttgtttcctgttcattcagtcctaggaaggaatgtccttttctcctcttaggtcacacgtgacctttcccggtccctgtctgcagtctctttcctgcagggagctgtctccccttcatgtagccactgtccttgagctttaaccaagcatctgtaagcacctcacctggactcttaacgcctcacctgggaaatgattattgtaaactgttgttttggtaatactgtttggtagccagcattttaattttagtctattgtaaattgacacaaatatttgaatattttgttcattttgccattttacaaaaaatgagaaaggggaaattgagaggaacaatattagtgatgaaaatatctatatctgaaaaatgtaatgtaaagatatgaaacacttggggaagatgaatgcagaaaatctttagtctgaaattgactattcattaccccttagcaagaaagtaaatccccattgagcattatgttttagaatggaaaatgtaaattaagcctttgttttccatcatcattctcatcgtctttttcatgctctctggtggcagaaccccacccagctcccactgatttcagcttttgctctttggttctgtacatgcttttagaaatacccatatgtgaatggagtatcacccggagtctcgacatgctcatcaccttcagtggttataggattgtagtctgctggggttagttggatctgggtttgaattctggtgccaccacttctagctctgtcacctgagcaattcatttgacttttctgtttgttttgctggaaatgggagtcaaggctccttcctcacagggtcattgtcaggatcaccagagatcatgtac

SEQ ID NO: 39514 - DNA, 2570 bp, Homo sapiens
aaaccatatatagtagtttacagagtatagactatgtataacagactaatagtctcacatcatataagcaaaagcctaagactttgtgccgtgcagtacagtaggcactagctacttgtgggtattgtgcactcaaaaactggctagtaattaagggactgaattgtacatttattttattttaacaaattttagaaatctaaatagctacatgtggcagtcatgttggctcatattggacagcacagattatagaacctttttttttattttttggtaacagcgagttctttagaactgtgctggtgtacgcatacgtagtttataagttcctatcatgaagcagtaactgttaataaatgatctttgacagcccttctgattctcaaattctgtgccatatcgtttgctataaattactttttaatgcattttaatagcatatgtagggttattttacttgtgagtttctaagctgctcatcttctgcatgtcttttactgctatgcaatgaaaaacatttttggttattggtttaaacagaacttagtttttaagcatcacagaatttccatatcagatgggagttggaggcaaatgaaataaataaaagaaaattctatattagtttactttttagccctccaaatccttcctgctctcaggagaactgagacttgatttgtttgtcttgaaagatggaaccacaggcaacgcccccactgtgtccctgcccccacttatttttggttcagtttgacttaccaatttatttcaatatttaccgaatttatttaaaaatttcctcaaagacatttattggcatatatcattctgattgtggtttttccttcttcaaaacctcttgattgttcaggttagattttatgtgacctgaatagaagttctctctttgtctgaaaactttttccttgtggaatggttttctacaacattttgctaggctaatttaggtgtgatttcccaaagggcatctgacttgaaaacattattcattcaggtctgacaatgcccaggattttaggagagagaaagagagagactagggaagaaatgaagtgaaaactgtagtttagttttggattttgagtttttactatttatatttcatttatatctgtgtacattttatttttttaatagcctgaataaagatgtgcaatttaaacaagttcagattgcctacagttcaggatttttaaaacacgtagattattttgggagctttatctttataaaccttgtaataacaaaaccacgtgagtaccagaatcatttctcttacttagtttcttgcaagggaagcattattgactcttctttttgcagcaaaccaacatttaaaacacattgaatgataaataagaaataatcttgtttggttaatgtacctgaaaagccaattgtgtagaggtaaagaggaaactgttgtaattttgtttaagattggagaagaagagaaaggttaaattgttccttgaaaacataacgcagaaccaaaaacccccacatgtactctctgacatcttcttcacacaagacatattttatattaatgaaattcagataattaaaaatccaagtgtaggcatagaaaaatctttactttttcttagatactggcagagttgttttaactcagtgagaagcatcacatggaacaatagaatttattagctgtttgttaaattgttttagctgctactaaaatatatgctttcacttatcagaacttactttcaagttccattacatccttcacatgcagtatatgaactttacagcagcacacactgtctctcccttctctgcctttttgctgttgttgtcatacattcagtatctcaatattttataaacaccactacacatatttattttatctaccatttgatggccatttgggttctttccacttttcagctattttgaatagttctgccaggaacagtcatgtgtaggtctttctgtagacatattttcagttctcttcagtagatacttagaagtggaatctgctgggggtgtgtgatttttgtgtaacatttgaagaaactgccacactgttttccaaatgactgaaccattttacattcttataagcggtgttcctctccacacctcaccagcacttatcttttgtcttttgcatcgtggccatttttgtggatgtgactggggttttaatttgcattttcctagtaatcaatgatgtgcatcttttaatgtgtgcattggccatttatacaccctttttggtgaaatgtctattcaaatattttgcccattttaaaattggaggagttttgtcttgagttttaagggttctttatatatcatggatatgcatcttttatcatatatatgatttgcagatattttctcacaggctgtggtttatcttttcacttgcttaaaaggtgtcttttgaagcaaaaaaatacctttaattttgctgaagtccaactttaccatttttaaaaatcacttgtgcttttggtgcgaaactgcctcattttcaaaagacatttttttccaccggatataga

SEQ ID NO: 39515 - DNA, 1066 bp, Homo sapiens
gagttttgttgaataaacatatggaagtccctttatacagtgtagaatccatctcatcaccatgaaaacctttgttcttgtgtgatataaattattagagactgttttgtgtcgttatacagaagttatttttagtatgttgttttgttaggtgggtctttacttaaaatctcatttagtttcatggtagagtatctttgttagtatgattcaaaagagaatataatttggggttttattagtgtaaaaagaattaccataaactttactttccagtagactatatttaaatgtgatatattactttttctagccacatactcttttagccttcaatatagcagaatcaaagtatgttattccatttgttccaaatttctctccattttctatccagatggctgctgactcaaatgtatatgataatacatttacattttttcagttaaggctgataaatccattttaatgctattgaattgcttaatgaataaaagatttaaatgtgtcgtcagtgcttatgtttctgtaaagtgaagtatcctgaaagcgctagtagtgctgataaagtttccagattgtgatttaagaacttttctgttttgcagttctgttattactgtttctatacttaccaggtgacagagtcatttgaaagttctcagttgacaaggatctcaaccttgcaaagaatatatatattgtgcatgtaatacagtacaaatctaaagtaactgctgagatgcctaggtggaaacttacctttctaggtcaggttccagtgaatcttgttttccttattcagaatatggtgttaggtgaactgactcagctttaaactcttcatatcctgccatggggagaaattacctgccccagtgatgagtttgggaggacaggacaatgctgtttatattccttgctgctgtgggagtattggaaattactacttgatctacctgaatttgagcttggcagtggtccagggacattagtgatttgcatgaaatataaacatgaattatttgaatcagctgttgctgttttttttttttgagacaaagtc

SEQ ID NO: 39516 - DNA, 1035 bp, Homo sapiens
gtcctcccttgtctacttctgagggtgagcagtgctggtgtgactgttagaaagcactgacttagtctcttcctctaagattgctccaggtccacatgacctgtgggcaggatggatgattgatgtctttcttttgaggggtggtagtgaagtagagcataggggattattaaccacctaggtagctggatcaggcaatggagagtctctgccgttcttcacatcgagtatatagaattaagcattcagaaacaaaaaggagttaaggcacatatatccttttctcctaggataaactgtaacccaggtcatctaagttttcaaaaatagacaaaatttaggaatgtatgatgaatttatagatgatgaaaatcaaatgaaattgtcttgttacatgtatatttctttagaaatgtacatatacatgcaatcattgctatatattatcttttaaattcctcagtttggcatcatttactggcttcctattagatgaggattgtagcttgctgtacactgtgtctttcccactcttcaatgtcctacccatctaatcccatcaggttttggttaagactgcattactgtttatgttattatgtcttcttaactcttgttcactaagctaaatattgcattatactatacttatactgtaatactataataacttagttttgcttggagttcattacctcgtttttttttcacatgcttttctttgaacatctgactgggccttcctgtgccctccaacaactgggcagtgcagtcttcatgcggtcatacctgccagagaagtttttcagctccagtattttttcttaagagacatcccttctggatttccatagtcttcaccacaatttggagtggttgttaacgcaggagatagatgtgtacagccatctcctgggatgtctctttttttttttttgtgactcttctgtttgcctcatgtgtggatctcccgtttcctagatcacttaccattttgactgcgcacatctttcagtagcttcttgagaaaatgtg

SEQ ID NO: 39517 - DNA, 1046 bp, Homo sapiens
ggtgagggggaggggaggaacggctagtgcatccatggagtccttctctggcttctcctggccactccttccatagtttaaatgggggcagcacatcctcttgcttctactaggaagtgaaaagtcttactagcaaggagttaaggactgccagaggagctttcttacctgccagctctggacatctcatttcctgtttgtctgaatgcatgtgcaagcttaggaacttgcccactgcagcatccaacacagctggtttgcctgtgtttcaggagagtggggaagtgcgcttcaatcacttccgacacacttcagcatgttgagccatctgatagggagggacattggtgcgttttactgccttcttcctatgcacctggagcttttgttatctcaactgaccagttccttacctgtaacctggattagggaatggcagccagtattcatgacagttgcatatgtgcgttcttacaatcagagaaatgtgccataaaaataatttctcattttttgcctctgtgtattctgctcctgtagcttggacccatggccacattaaggccatgttgtcacagggatctaccatactctattgacttttcttgtgttctgccatcctgctcttacaacacagagagctgagagtgttgtgatctcctactcccattctttgagctcccttttggatttaacttcttggccatgtttatcatattttattcgtattactcctgattatttcactccctggttgctttgcgaaacccctctaagtcaggtcagccacactatgtctctactcccacgtcttccatgaaacactgctgggacaaaatttcacaactttggctgttggcatttttgctacaaaggatcgtcttatgtcctggtggtcaaggtgaagtaggattatatctttttgcggttatgaagattccaagcaaaagagaagataatgatgcatttaacagtcacaagataatacatgttaatcttcaaaaagttttgggaattcgtcatagctgtactatacaaagccagtg

SEQ ID NO: 39518 - DNA, 1063 bp, Homo sapiens
gttatttcctattttgcaagatgtgtgtgtaactttatatattagtttacagatagacgtgatgcttggataacaaaatatattagacctttaaggctatgatattatactattttagattctctgaaatactgatttttcagactggccattgaagttatatacctaaggatagtgccaaacaacaatcccaactttcaaaattttttgaatgtagtaggaataatatttattccattgacaagcatgggtagaaccattgctctttagtaaaagccagaaacaaaacagtcttgtttctttttgaagtagcctgttgacttgttgctgttaactcttaaatttctgttgataaatatggataatatgtccaaaaatttataaaaatcaaatggaaattttaagtttatctcttcgtaaaatatatgtctatcaaacattttgctgaataggtaatataaatatcaagtggcacttattcaaattataaaataaatacttattgaatgtgtcaggctcacagatgccattgtaccataacagaaagcattatgtaggaacgtgaagtttgtcaggtatgtagaaattgagatgcacatttttaaacttttggtcattttttttgttcatgatttctgtgcttgctttttccataagtacattttaagaatacttgatgcagtgagggtagaaatagtgactgatttaaaaagttttttgcccttaatgaagggttagaatgggtcacctatttacagtccctgtagatccttgaactctgtttaccgtgtatgtgggtctgcgttctctttcaataacaagccattttcagtcagatctgactgtatacataggtggcagacagtcttaatgcagaaagcgctaatgggttttaaagcttccagcatactctctcagcagtttagattccagagaacgccctctgattgtttccggatctccatagaagaatttacgaggctccgttattgatttacttcctccaaaaggaggaaatgatacttaaaacaaatatacaaaaaaaaatacctttataaaatgc

SEQ ID NO: 39519 - DNA, 1056 bp, Homo sapiens
atttacaattaccaagaggtaaacatggtaggcatgtttatcctctctatgtaagaagtaacagatgtagagaaattcttatttacaaagttcaggtgggaagtagtagagctgagatttaaacacttgcattttaacttgtttttttttttttttgctgttatttccaccataccatactgttttccacaagaaccatcatttctagaactttatatttaagtttacattagcataaaggaatgcatttgaatatctaaagattctcctattaagaattggcgtgaaactctgtatacatatattatttctgaaagatttactggaagactgcaattacacaaaataaactataagcataaagacatcattatcccagggaattgtttatctgcaaatgtgaatactagaaaagtgtttataaatgttagaagaatgggtgcaaataaattcttatgggacaataatatggggtctattttacctctttccgtttaacgcttaagaggaacctcgtcatcgtgactactccagagcatggattatgggtgctgtgcgggcttgcagtccttgcatctgtgcttcttggtatggatagaaagcaactctgaagatgttcgtgatatgacagtagagtgtgcctagatctagcttttctgttttgctcccctctcccaatcttgatctctctctcttttttttttttttttggtgggcgggggtcagagtttccactctgtcacccaggctggagtgcagtggcgcgatcttggctcactgcaacctctgcctcccaggttcaagcgattctcctgcctcagcctcctgagtagctgggactacaggtgtgtgccaccatgcccggctaattttttcttgtatttttagtagagacagggtttcaccgtgttagccaggatggtctggatctcctgacctcgtgatccacccgcctcggcctcccaaagtgctgggattacaggcgtgagccaccgcgcctggctcttgttctcttttgaaagaagttgagaaaagttccaagaggtggaaggggca

SEQ ID NO: 39520 - DNA, 1043 bp, Homo sapiens
cagtacaacctctgtctcccaggttcaaacgattctcgtgcctcagcctcctaagtagctgggattacaggtgtgcgccaccacggccagctacaattttatattttcagtggagatggggtttcactacgttggccaggctggtctcaaactcctgacctcaagtgatccatctgcctcggcctccaaaagggctggtattacagccatgagccactgtgcccggcctaaacactcatttctaataaagcatgcccaggttagaaatgactgttgtggcaacatttcatggcatcttaaatgctctagaatacattttatagctatcaattccttcagaatttgaaacacatttaatctctaaagctgttctcttaaggcatgcagcaaggaaacggggtaggtgaagatgcctggctgagcacatgctgtattctaggttcattttcgaagatatctttgccacagcacccagattgaaatggtctcattttgaaggtgaaggaactgttgctccgagagggatcgctcacgagtagtggagccgagatcgaatctgtgttaattcggagctcagtctctgtcacgtccccctcagtctacctggataaatatgagaagtgcaggctttcatctgaaccgtcctctgaccagctgcagatgacgtgaggttctggttcactttacacatttcgtccgacgtctcctttctaggggagaggagcctgagaccaaccatcgaagcagctacttcatggtctccctgttttaagttattgaaggtcccaaaagaatgcagcagacatttgttattgagcatttaaaatgccaggggaccttgtttgatatattacgcagtactacatctgagctatatgtgggtttttatttatattgacaaaaacagaaaacaaaatgagaaagtggaagtttttgtattcctgggcttataagcatttaagatgcagttgtccccctccttgcccttggccgattgactcattacttcagcttttagattctgagaaggtggagcctatggc

SEQ ID NO: 39521 - DNA, 1040 bp, Homo sapiens
agacagcacatattcttacctcagggaactaagatctagagaccatctggaaccatctctgagctctgtcattgatgggcagtttcacacaatctgttgattgataatgttatatcagagcttcagtgtattgcaagccattttatggaaatactggtgataagagtaacctgatgtgacatggtgcatgtggaatactgtgttaggtcctcccccacctccctcctggggcaacaaaatggccattctgaagagagaaattatattcaaagaattgtagcataaggttgaaattatattgttttataaaatatcactacagtatagagatgtcattagagagcagtaccagttaagcagccatcatttgcatatgcctaggagaacgtttttaataactaacctagttaccagtaaacacacagttttaatttatttcagttattaaccattaggaaacttctttaggttttttatcattggaatgatgtcaacaagaaatgtgtaatcagaaggaagagatactttactttgctgcagatactcagagcagtatgtagtgttttcatagaccagagaggagcctgcactgttatcattttttgtgaagaagctttcagcacacagctgcaatttctaaattgaatatttttatttcagaatggaaaaaggagactttattcacaagaaagtttacttaccagaaattttttgtcttttttcacgtggaagtaatcctaaattactcttccttaaatggaaatgttatcagtttgctaaagaaaaaatgctgtgtattctaggcacatgtgtgtacacacacacacacagacacgcaaagtttatcaggcaccatgatatggtcccatcctttaactttgtaattctgcttttgagaatctttcctaaggaaataatccaaaatgttggggacatgggagaactgtgtgtataaaggcattccttggtatcttatttaggcaactgaaaaattggaaacacccctgaaggactcatggaagggacgtaatttaatgaat

SEQ ID NO: 39522 - DNA, 1023 bp, Homo sapiens
atgaagtttcgctcttgttgcccaggctggagtgcaatggcatgatctcggctcaccgcaacctctgcctcctgggttgaagcaattctcctgcttcagcctctcgagtagctgggattacaggcatgtgccaccatgcctggctaattttgtatttttagtagggacggggtttctccatgttggtcaggctggtcccgaactcctgacctcaggtggtccgcccgcctcggcctcccaaagtgctgggattacaggcgtgagccacggcgccctgccggcatgaagttttgaacttgccattttgccgctctagtgctgcctaaggcactttgaaggcagtaattgcagaggcatttcgtgccttcaaagctcagtcccaacctaagttccttaccctctgagatgatcccaggagtggcctcctctgttgcatgacatttagatccagggctctctgaagcctatggacttagtaccattcatgtgagatggagtgatggcaggaaaagaattctgtgttgcaactgctgtgccctgaagttgagacctcagttgaaggtaatgataaaaaaagaaatgctaggtgcattattactgcttcatctctacttccttgggttagttaaaaggcatttaccagattagttaacactgaaaacaggatctgtcacgagccaagtatttcagtgtgtgttttgtgttttgctcaaaataaccctggtatccaacactcacattaaacaccacaggaagattttggttgaatgtgtactgaaggttgaggggtgcctgcaacgcaatctcatggacttacctttttttctgtactgactagaaactgattgcactatagccaaattacataccagcacaaagggaattcagcggcaggcctgaacagaatagaagtgacaagcaagaatcaattaaaggagtcagccccctgggtctgttcagtaacacaggctagcactgtgggaatcttatactcggtgctttgctcaagatcagtgccttgac

SEQ ID NO: 39523 - DNA, 1031 bp, Homo sapiens
atcttatagaaacatgcaggctaaagtaaaaaacaaataatcagattattataactcagtattttgaagagcagctggctaatctgactcgagggcatcagactgggaaagacgagatgacatttgatgccacgtgtcttttaatccagcatttttcacacaatgccctgcacgtcgtagctactgagaaaatatttggggagtaagtttgaacggaactgtgacttgaagaataaagagttgatgagagcctgatggagatataaagaaacaccagggatatgatttctgattggagcaatacaaggagaaatggataagtcccggagttttgagcttgggcagattgggaaatagtttgtcaataactgacaatacagaagttagttagggatcagcagaatgatgagagaaaattaatttagtttttgacatgttaaattcaaggtttttgaaggacatcctcatgggactgtttagtgtgcagttggagaggtctggtcagtcctggagcttgggtggaggaaactaagacacagatttgggattcaccacaatatttgatatttgaagccatatctgatattctcctgggtgtgaatgagattgctcaagaaaagtgcgaagactgtctctgatagatccatgaggaagataatacttttaaatttgacacttctagagctgatcagagttattctaaaggggacccactgtagttagaacacttctgtagcctgtttctattgggagcagttggttctcctgacttcagagtttcccaggtgctgacttaccgtataaccctgcgtttgctgtcattctgtcttcacttcactgctttcattcctggcacgatagtaaaattgtagatgttctcctgtcctcattgtgccaatcacagcattactccgaccccactgctacatacatcccccaaccctcagaaagaaacacaaagctgtgatgtgaatcctgcatcttcattgccttcaagacagcaaaaattagaccggttcagagcctcttga

SEQ ID NO: 39524 - DNA, 1045 bp, Homo sapiens
ttttaggggtctttcctgagaccagactgcattcatctgaaaacaaacctgtagttaggacaatccatgagtaaagaaggcctcatatttagaatgtcatagcttctcagaatctgctttgaaattgaaagtcaacatagctccttctgctgtggtgcaaatgtctagagcctaaacatctctaaaatggaaactgggctgggtgtggtggctcatgcctgaaatcccagcactttgggaagctgaggcagacagaaggattgcttgagcccaggagttggagaccagcctgggcaacatgagacaccatctctacaaaaaaaaaaaaaaaaaaattagctgggcatggtgtcatgtgcttgtagtcccagttactcaaggggctaaggtgggaggataggttgagcccaggaggttgaggctgcagtgagtcatgatagtgccatggcattccagcctgggcaacagagcaagaccatgtctctaaataaaagtaaagtaataagtaaaatggaaactgacttgtttttagtaggaaagaatgtctaaacaaaaagtagtatgcttttttttttttttttttttttgagatacagtcttgctctgttgcccaggctggagtgcagtggtacaacctcggctcactgcaacctctgcttcccaggttcaagtgattgttctgcctcagcctcccaacagctgggactacaggcatgtgccactacacccagctaatttttgtatttttagtagagacagagtttcaccatattggccaggcaggtctcgaactcctgacctcatgatccttccgccttgccctccaaaagtgctgggattacaggcgtgagccaccgtgcccggcataactatttcctttttatgataaaactctgcttcctggagatacttgtcaaaaattattacccatctacatgtgagaccttcaggtctcagccttactcttcgtttactaatctgaagttttggatttctggcgtatgagaatttctggtttccagcacatctctttcatttctgctta

SEQ ID NO: 39525 - DNA, 1208 bp, Homo sapiens
gactccagtgttggcaacagagtgagattctgtaaaacaaaacaaaaaagaaaaaaaaacccaaaatctggcttttcatccttgagactacatttcaagctttttgctattgagtagaaaggaacttcatggtgtagttccatacatttctgagctataagaaaaaggtatagtgatgatgtgttaagtgccatgcttcagatctgaaggttgtgtaataattttcatgactgcgcttgtacagacgatttcaccattggctgcagttctgattttaagttcatttgctcgttttcatgttgaagttgacatttatatgtagttgtattaaataacaaagaattttagtaaatgattcctttcttactccaaagcaaaaaactcaaaaactttgacctcctccataagaaaaatgtagcaattcccaaattatgcagaaatgtctagaaattatcaaatgtaaaatttaactctatattctagaacactttctcagaacaaaaagatgtgttacacggtggaaactaaaggaattttaagatgagaaactataggatattgtttgaattcatgtctgaatatttggacaagatgaaagttttctgagcattgtggatggattactatgttgagaaatgcataacaatgatgtgtaaggcagaacagtattctagtaggacggtagaacattcttgttaccttaacaagttcccctctatctttatagttagtccctctctgttaacacccaagtcctggctgccacagatctgttttctttctctgtagattggccttttccagaatgtcatatgaatggaatcatacagtgggtggcctcttgagtcaggcttcttagcacagtgcatttgagagtcatccatttccttgtttgtatcagtagttaattccttttcattggtgagtcgttttccattgtttggctatgatcatagttttgtttatccactcatcagttgaagggtatttggattgttttcagtttttgtcaactatgatgaaagcctccctaaacactctcatataggttttcatgttaatatattttcattgctcttgggtgaatacctagaagtagaggattgctggatcatatagcagactgcatttacctttgtaagaaactaccaggcttcttctccaaagtggctgtaacattgtgctggaatagattttttttttttttt

SEQ ID NO: 39526 - DNA, 1052 bp, Homo sapiens
atgagtgatggtctttttgagattagagcagataaatgcagattataggcaaagaattagtattttagcatcaatgctgtgtcttcccagtacagtatccagtctttccattgagaatttcccaaatttttcagttgtatattcttgttttaatcggattaacacagatctacttctaatttatgtataagaatgatgggtggttttgtcttatgaaatatagttattgacttttctgttattgttgttcaaatttatgacaaaaggaacaaaaaagcttagctgatttcggccggtaagtttaatgactactacctggaaattaagtgtgaaagttgaaatactcctttgctcccactagagggggattccttccaacttaggtaaaaatgctcttagactcagcgtgaaaaccttgtgtgacattgatattccctttgtattaaattgaggataacctcatgtttttaaaatcagctgattttctgtagttgctgatattaaaatcttacagaaatagaggatgtaaaggatacttgaactagggtacatatatatgtaaacaatagtgcttttgaacaaaacataaatacttttgtagagttgctgtaattaaattcgtttaaaggtatattaagagtttcaaaacaattcccccagccctcctggagatagaatctggggtgaagggtgccctggtgggatctgactccctcctcccacccacaaggtctgtcactgtctctgtctgctgaaatagccacagggagagttctaaatttcacacgaaagctttgatttgctctcacctcaagttgtcaaatatattaaagccttatctttaaatagagctctatttgctattgaattttcttgttacattgactttttataatatgataaaatatgcagaactcactgaagattttttcttgcaaagttaaactgtaatatattttaaaaataattctatttgtgttaaaaatagcacatcaagggtgaggtatgcagatatgatctatatgtgtaattcacaagcaaatgtcatacga

SEQ ID NO: 39527 - DNA, 1083 bp, Homo sapiens
tgaaaagtggtctttttaagagagcaaggagttatgctggaagcaagcttatttacttgtataatttagagtttgattgactccatgtatctctggggacattattttggcactagtttttgaggacttaattttctagtaataataaaaatgcatatattctcttatccccaccctcaaacacctgttcatttgggacatgcacatgtaattagaggcgtgtttcaggacttgcctgtaaaattcctttgcatgcagttactgtgatcatattagtaatcatcaagctacttgagattttgttgggaagaagcaaagaaaatatcctagggaagatgggggtgattttgattgcgtgtgttttaggttctctgcactgccaagttttaaagcagattctgtttcttcagatggtgaaagccctcctccttccctcctcctgccttaaatttggcttcttcccaagccatgtcaatttttgcaagtcagttgagaatgtcaacgtggctggtgttgaaagagccaatatgttggaatatgcttaaagccaagtagaacatttatgtgaattaaagaatatatcagggatgatttttaaaaatcagatttggattaagaaacctgttgaattaatacttgcataacagatgtatcactgataaatacttgtaaaagatattcccaaataagcaataaaagtaccattttacaaccgaagtaatgcatcctgtgggtccatttgcaaagatatgccaacagaaatgcatgcagagctctggaagtgataatgcaaataaaacatttcacattataacttaaaataacaagtttggaaggaataaaaagtctgggagactatttgttttgtctaaattctgcttttactctggtcttttaacagttggcttttgataatgtattactgccttagtgtgttcctgtgtattgaaggaatacattgtctgacagaattgtggttgaaaatattacaagttctaaataataagagtaataaatatcatatcttgtttgctttgttgtcatagtcgcctgatctcatgcttccctgaattcggctggtgt

SEQ ID NO: 39528 - DNA, 1030 bp, Homo sapiens
tctgggtattaactggttctgtaccataatcgggatatatcattccatatgtgtatgcctgtgaattcgttaatataaatgatgatgatattgtggtttatacttttattttaaattaaaaaaccgtctctaattgatgaaaggtgcctttatggtacagttactttcaaatacatcaagcactgcttgggttgacccttgacttcatgggcatgttggtctttgacccagaactggtaaatgaaccctgcagggaaatcattagagaattggaacaattgtggtagtgggatcaggggtcaaaccattacctacccatagaaacttccgtttcagttggacttcttgcttttctgagagcaggtcatattttcagggagaataccaaagaagaatttagcgtacattagtgctgacctatcaggagaaataagaccgtaaggatttggatgatggctggtttatattctctaatgccatgacaaatgactatgctgtcattgtgtagaagtccattttttaatgtaagtattgtggaggtgtaacataaatacagggacatgcacaaatttaaatgtacaacttgatacattttctcaaaatgaacacacttgtgtaatcagtacttggttcagaaacaccaccaggaccccaaaagccctcttatgcctcttttgaatcattatccatccatccccaacccctaccacactgtctgaataaaagtcagttaaatttccagtccccgatggtcactaatggtaagccatttgtttagtctccccacagaaaacaatcttatttcttcacatgaaaatgtgagagggtttgtgtgaagaaaacacaaaacttattcaaggagtttctgtcaatatcagtttttactgtttcatatagtaactaaaagaaattttagacaagatggatgtcatggaagagaatattctttgctttcaaaatcagttactcaagagttaccctttaaaaattacagaaaggaagaaaaggtgtagttcaattcttttccatt

SEQ ID NO: 39529 - DNA, 3118 bp, Homo sapiens
gagtagaatatagaattaagagactataatctttaagactgtatgttagtcatagtttttagatactgtcaggctgttttaaggttaaggcatatatctttcaactcatgtttttcattgattctcacatggacctgaaatgagtcagatgactatgtcgatccttaaaattattgcaatctagaaaacatgttgctatttaacccagactagagttactcaggcaattttgttgtcattgtgttatttgtttaattctatataatgctaaaaatatacagattttttaaaaagcactttacagatttattcttaaatagtacctgcaattttaattgtgtttaaagtgttcttagtctcttcgttggcacctattgcaaatttttcctcttctaataatattaagactcactttctggacctctgtggctccctggttcctaaaaatgtaggcccctgttccttggcataagcacgtgaggccatgcgcagcctgcctctgccaggctccggagcctcaccctctctcctgggcatcccaagtgccgcctgtgccgaaatgagcatgccctcccctcactcttcctgccctttgtgcctttgtggattgtcccctctgcttcctgtctctttccctgccaagtgccccttcccaccagctgtcctagagtatcctttactcctggtttggaccccagtccctggacatttacccgtcagtctgtcctcttagcacttactaattcaccctccatcatagaattttctgcacttcattgttgtttgtgtggtttgtctctcttcattgagactcaatgatagaaggacattcaagtgtacaagtccacatatgaatataaaatgtcatccacacgtcaacactgccttctccctttttctccacctcctctcacccatcccacagcaccaactacaaaacttagatagggcttgcttaagggtgactctagtacaaaaatacctttcctcacattattcagtatctcacttttttataaagctttaatttcatcagtacactataatttgttttcaaaacatcattgttcctggaataataaagggccagcagttacgcacacgagtctttttcgtgttttagcactgacatggggcttgacttgtgggtaggaagagtcttaagttcgttggacttaagtatgataaaatcagataaaaagcattttaactggtaggaacaatgaaatgccgctaacaagatgctgttattttctcacgtaagaaaatatgcatagtatctggagcacttagacggcccttgatcagtggtggtatcagttgttgctaaagtcagcattctcgtggccataatcatgagcatttctgaggctggtcctgggagtctaaccaagaagggaaacgttacttccagatgaaggtaaatcccagattctatatacccaaaaaaagcttataaatacattttcgtaccaaattatttttgagttctactgcccatactatgttgagaggtctatttgttgttctttctagtctacgtaactcctgagactgttaatagttgaagagtggagaatctcttcaaaagagcttgaaaactgagactattttaggaaccccttgaggcttgtgcagtggggaagaaagatcccttttatgatgcatatttcatacttgcattgtttaccacttctaagtttaggatggcaacatgttccatatcaggagttttaacccaaggacctttgagaacagcttttattttagatgctgatttttaaataccaaagaaaatgtaaccattacaatgatatttatctaaaatggtatgcctaactcagaattttgcttttgtaaagtgtcaatttagctgattatcctacaaatgtcccccttaaaatgagagttacccataatggaatctttgcctgagaaataacacaaacgtatcaggtgaaagtcatgtcacccaaaagtagttcttggccacccctcttaaagtgaattttggctcattagtttttcttgtgttatctctggcttttgatacggatttttggagcttagaactaattttaaattaacatcaacctttttttccagctgacctcgtacatcttaagggtgtgtactgtacatactgtcacataatgagaaaataaatacatatttggacatgattaaataaaaagcgacacatgtataacttggaaagaggatgctcttaaggcctaacaattagtgcttggcagattttttttccagggattctgtttttctggtgcctttgctttattttttaatgtggtctaagataggaagtctgagcttttaactcatttgctgtctagacaaatgaaagcagcagggactttggtaggtatctggacataaacactattacaacacaggttaatgcaagaaaaagcctttaaacatcatggaaattaaacagtcactgtgagaattttccttttgtgtgtatgtgtctgtcaatttattgactcaattctcatatcaatttcaaggtgtattcatatcacgtgaccaaaaatgatagttgtgaaataagggtggaagatgtgaagtaattttacagtgtgtttctaaagaaccaagaatctaatgacactggatacttgacatccaggatgttaattagaaacagagggctgataattcattgctaagttttaatagctaagtcaatagttttcagtagagcatttatggtaaatatttagaaatatttgcatgtgctggattactttctatagtgtttgcagctgtatttttctgtagagcttataaatttagtgatatttaccgatgaacaatcatatccattttgtctttagcaccgcacttggcacaagaagtcactacccttaagaaggtgagggtgtagttgaagagagaaaaagaaaaagaaaaagtacacggttttatttcattttaatattctaaaaaggagaagagacactacttctgctttttaagataattaagagactttttttgaagaccactgaactggcgttttaacctgtgctttaaacccatgggaagtcacagtgagaaatcattaactgtatcctattaaaatccttaaaca

SEQ ID NO: 39530 - DNA, 1008 bp, Homo sapiens
gattttactatgcttgagagcccatgaagtcattgccttgccaatcaccccatcacaaaaagaggactgatttatggaatgccatggggcaggaggactctcctagccccttaaaagagactgcctgcaattacctcacctgccagctttccagcaagataaatggaagcactgtagcttgaaggtgccttgggtagaatgagatgcagtaaggtctctctgttctttacaggcatcatagatctgatagtacttataaaagaagaatagagttggtgccctgctgactaaattgtcctctagaggagtattagttacagagcttctttgttaactaggctgaatacttaaaccactgttgaacttcttttattagcatgttttaagatagctctacatacagataccctaacaatctgcagggcgggaatatttctgtataatttacatataaaagtcgcgtgagtgtgtaacagtaatataataattatatctttttattactcttctgttacactgaggtctagtcagcactgaaattctgatgacacatgaacacgaagaaagccactgtttttatatttttctcttgatacttccttgatcagcttgttgaataacagaaatgtttttgatgcctttgcaacctgagtaaagccctcttaatgcccatccgtgtcactttttaaaccataatatggaattttaagggagaatggggatgaaacttgtaggctgtgcagagaattacaagaacttcaaagtaaaatttcagattttatgatgagagatttgcataaaattatttaactacaatagatgatttttcaaaaattaaatctgatttgtcctttctacgtttaacttcatatatagtatgggattttatatcttgttatctaccaggtttttttttctttagagaaacatgaaaagcctatttcctgcctgatggctgttctctgactgccgcttgtttattggtcattgccgtgtggtgggtactgt

SEQ ID NO: 39531 - DNA, 1060 bp, Homo sapiens
tgaacctctgctcagctgagtgtcactgcgtctggattctgcgtgtgctgcctctgtggaaatgctgttggcattgacccgctgccttctcccttcgctgagaatgaagattcagaatggaggggtacaaaagcttttatgaactaattttagcctagaagtaaaaagtttcaaaaatcacttgagtacattttggaaaatggtgggtaaatgaatagtacttagagtcaagatgctcctaaagttgatttcacaaacttctggtatatcaccatgtttcctaaaagagaataagtaacaattgtggaaggaacaaaaccattttatagagagtgttaggtttatttcccagtcttctgataaccctggagccaggattattatgatgtgttgattgattatagccgttaagactcttactaatcagtttcatcacttattctcaattcacacacttgcatctttgatttctcttccataacagggtgatatgggttgtcattgactaatgaagaacagaattggtttcggcatgagacaaacggaatgccttcactaatcctaaaatgcattaatctttcataatccacatctgcatgtttataaatgatataactaggaattgttaatgttgatattctcccttccaaacagaaagtgacatgggagtttgtacttgcaaactgcattaaatacataaagctgaatgccaagagtgtgaccttgctgaggatgccaaatatattacttcatttgatggttttagaaaagtagcatgttgcactttgagtgttggatataccaggagatatcctgtggaaagccaactatcctaattgttccgtttccttcctgccttattttatcattctattctgtcattaattcagcaaagcactgagtgtgtattatgctgcaggcgtagtaagtggggtaaaggcgctgaacataaactgcaaagggtcctgtcctcgtgaaacttaaagtctagtgggaaagacaggaaatacataaataactacatactttattgtcaggtagtcaaggaaaaaaatcaggt

SEQ ID NO: 39532 - DNA, 1026 bp, Homo sapiens
tgcccaccaccacgcatttttgtagagacagggttttatcatgttggccaggctagtctcgaactcctgacctcaagcaatctgcctgccttggcttcctgaagtgctgggattacaagcgtgagccattgcgctgggccaactccagtttatctttaatcaaagctgtgctgacttaaatagttaagtctagaagtccgtgcatcaccatgtatcctctgacttaacttgtcctttgccttgccagagacttttcagtttctttgccccaagttctctgtgggaaggtatctccccaaaagggatctcatgggtattagtgatcagactattaaaccaacttgcaagggtctgtcttaccctcgcacctgtcacagagttatgaggaggacccatgcgaaaaacattgtgtagttttagtatgtttaattaataaaagaaaagttctggtttgaatctatgatagcaggctgggtgagtaacgttttataagttggtctttaagggcttttatgaggacataattcacatagaccacatcatactcacttctgttttctacctgttggctgatcgtcctttatagctaatctatcttcaagcctaggagtgaggtttagaaaaagacttggaacactcagaccacagtagggaggagagttgaaaagcttaatccggcaggtttttgacagtgtattagtttgtttagaataaaggtatatggccctgtgaacggtgcgtgggagctgtcttgttctctcaagttcgggaattggaagtatccttattcccttcatggctcgggagtatccaagtcagatagcctctgaagtgcccatttatctgtatttttaggacctaatgacacatgaatagtctgtaatattttggataaggatttaggaaagtctagccccgttttgaatgaactttcgagctgtatgacatgaaaaggtttatctctcaaagcaggggcttaactccttcaaggtgaggacaccaaattgctgtggttctgtgttctca

SEQ ID NO: 39533 - DNA, 1034 bp, Homo sapiens
gaaaaccttctaattgaattcccttttaatttcacagtggtgtctagttaaacattcatgttaatgccggtgattttctgaaggtctgaactagatctggattcccaaaatcaacacaggttatttaaccctttttatctagtaagccagcagggactttcctagtgtaatcccatagtatttgaataattagaaggtcataatgaggatttaattagtccttgagatatgctgaagcagaacccctaggaacttcccctttcggacacagatgcaagcagaatggatgctgctccaggactgtgagccacgaggaaatgtattctgttgctggaggcagttctctggcaccattgtgtggccatcagatcggtgctgaaagcatcttaggtgaaatcttccagaattactgaataacagtccccccaaccttcatttctgcccactttccaacctacacaaggactggcttttcctctccactgttgaaaaagaggagttgtagtcaaagcacgctgtacctgattgaaaattggcttttgctttatcagcgacaccaacattaggtgagctgggcgagttgtgtattttctctatagttctatagagaaaatagataacaaaattttgtgttgttctaagcctctggtattttgtccagccaaacatagagatcttgacagctgtttgtcagcagaatcacaaaaatctcatctttggaatctgatgttcacagaggaatatttatcagtagctacatttttgcaaatacagacagtgccattacccagcaaagtgtgtagcagatggggcatgatcaggcatttcaaggttctttttgcgtactactacaaaaaggtgaatcaaaatttctatacttcaaaagtctgaggtttcaaaattacatattttgtttagactgaatagtcttcattattgaatatttcattattcaatatgtcttcattttttatatgctgcttctgttattaaccccgaatgttaactgccttggtataattttattcctacta

SEQ ID NO: 39534 - DNA, 1084 bp, Homo sapiens
aaaggaagacaataattgttgtaacataaatggaaaaaaactaccaaaagtgaaacattgaagtgacactgtaaggtaagataataggtctttctccttcttttacacactttgtgtaatattgtaagttttacattttaaagaattttaaaatgcatattgacctaagagaaatatggtaccttatgtatagttcagaaaacaaattctctctatttattcccacaaataggatttaatgcaacttgcggtaagtcagctttcattttgatgaacctgtatttgtgatcatctacttgatgcatttctctggctgaaagagcagcattgtgtgatagatctaagtagaaagatagaattgaaagaagctgtattgaaatagaactttatttttcacagaaaagatcttacttaaatatgataaccagcaaataaacacatggaaaatcctcaaaatttttttcattagggaaatgaaaactaaagccacgttgatttctattacatactgattcgaatggctaatttttttaagttggaatatcaagtgctggcagttagaactctcacacagtatttgatgggaatatatacaaaatagtacagccacagtttggcagtttcttataaacacgtacttaccatacagccagcaatctaatttctagggttttaccaagaaagatgaaacatattcctaccacacaaagacctgtatacaaatttttagcagctctactcgtaattgccaaaaactggaaaccatatccaagaatggactactactcagcactgaaagggaatgtacagatgcatgcaacggtgtggatggatgtcaaaggcataatgctaagaagccagccacgaaagcctatactgtgtgactccatgtgacgttgtagagaaataaaatgacatgaacggaaatcagatcagtggttgccagggggtggcatggggataaggttgacttatagaaggggaagagggaacttttccctcctttcatttcttgtgagagaaatattctgtaccttgattgtgctgtcgattacaggattatagaattttttatatctcaata

SEQ ID NO: 39535 - DNA, 1052 bp, Homo sapiens
cttcaacttactgcccattttagctcaccaggagtttaaatgggggctgtatatcttcttgtttgcttttaccaaagtcaaagctatactttaaaatggtaaatggagattagaattgagaatattacttttctctgcctgtccccaccctttcgttggaggcattttctgtaccccccacccctcaggcagcggcaggatgcagggtattcaacttgcctccatggtctgtaagccccgcacctatgtgtgggggtgacagatatacagggctcatgcttgtgcatcagaacaaatcccaagaagctgttcttctgttccactttaggccaccatacattaggtcgcctgcttatcccagccagtctggggctggcggacgccccatgttttcttcccagcaccccaactatggcaactctcaggctcccatggtgcaccagcctgaccagtacgggtaggtagcaacacaccccgacttgctgcgggacctgggcgttttctctgaaactgttaacgatcgtgccgtctggccgcgaaaggaacacccaaaccaagaaagcgaaacacctaacagaaaatccatctccaagggggttgtccttctgtccatttttgttggtgtgtttgtttcgttttcctttcgtattaacagtactgtggccgttcggtggaaacccgcatgcgtcctcaggccctgtctgtgcatggctttcggcatggctgctttccttcatgcctgagagggaaatagaaactttgatctgtgtcgaagacatgatgtcaccacctctggcgtcatttcccccattgttgtcattgttttgtctaggaacctgtgttgtgcagcgctgttctcatgactatattatcactcctgctgctacagtgagcggctgccatacccacccccaaattaagagcacagcatctcatttgacaagagactcactgcagttgagctgacaggctattcataggacttaggaggagtttcattatatcaccaccaagcaaatgtctgtgccaaaaacttctattattttttctcc

SEQ ID NO: 39536 - DNA, 1034 bp, Homo sapiens
ttgttactcttgactagaagggaagttttaatactgaatatcacaaatataattctgtagacctgcattttaatactacatcataccaaaaactagggtcactgaaattagctttcaaatgttttgtgttgagtccattaggaaattgggaactttagttaagattattaaatcttagccactcattaacagggtgaataaattccatagggtagctagatcagtggtaaccccaccgtattgctgttggaggagctgaatattttgggagagaatgtgactagctgccttcctctgcttggaagaagctgggtctatttacaaatgcaaatgaattggactggcttgttgggtatacagtggcttgtactgtggctcatgtgcaccccacatagacacatcttccagccactgttctttattgaggtgtatctataattcatatcctgtgttgccatttgccagcaaggcactttttctgtgttattttcctctgaagccagtatgatgcaattctgctgatggacgaagagctgctgatgtggaaatacgttaatggagatagtgcattaaaatgtcaaagagaaggggcaaaaaacttcgaaatgtgtcaagccccagttgtagtggggtccatgtgctaaagagcaggaagtgatttgtattaaccaagaatccagccctttggattttggacaattaggttttaacataatagctatgatttgaaaagtcatgttattgaaagacaaagagaaaagatttcaaagccttaaacagattttttatttctgcaattaaatgtaagcctttgcattatcatctaaatactacgctttaatttttagccccttttttctcttcaaaatttagaatttgaatgaatgttattatgttagtatttaaagattatgatttcaattaaaacttttagaattacagaactattatggaagccataaagtgcatttataaatcatcaaatcaaaaagtagtaaaacactaattctaaaaggatcagagatttatttttt

SEQ ID NO: 39537 - DNA, 1565 bp, Homo sapiens
tattttgcatgttctatctatttcaaaactgcctacctgaaagaagtaaatactcaatttgggtatggtttagtgtaacatcagccctgctttatttttaacccatttgtctgaaattaataaaaacgtacaagttgttagtatgtgaatgaatttttagtttaataatgtgtacctatgttagaatcagttgagatagaacaattgtattctgcacaagactgctgataatcttgaaattaagtgttgatttttgtatgatatataaattataacaaaaatgtcacggatgtatcagggaattttgtaagcctcaatgttcttctgaccctagaagtgggcctttagtttcctactaaagaaattctgtaccattagagagaaaaaaaaaatggtgctgaagcaacctttattttacattcatataaagaatcaaaagatcttaaaaaaaaaaaaacaacatgcaattacttgccaagaaggcttaattaacatgctcatttctgtaaggcgatgtattgacgagcacggctcaggaaggcaagttggaggcaagaagaccctagctgtgcagaatctggcaatctagtcaaaaccccaaaaggaggctgctattaattatccattcactggtttaaacagatagagcctgaaggcttgaagagttggttgttctagtaaatgtttgtaaaattcacatgcagctctaggataaccagcattttccctttcagaggaggaaagggcgatattcgctcttaccttctctgtagctacgtttcgattttgcagcacccgtgatgaaagagaaagcgcttctaggatgggtatagcagacagtgcgcttctaggaggggtgcatccgaactcgcaggaaggggcgcaactcctgcattttgatgtctttgtgttatttgctttgagtctcagaaggcagccgacattgtgtttttccctcatagtctgccctggttttttgttttgttttctttttttaataggaaaagcattcctgaatcagtaatgctctcaagttaacaggtagaattcagataacttctcaaaagtatttgtgtgttggcccagagggagaatttcagaggttaaaaataataatctttaaaacttaagataataattaagggccgggtgcggtggctcacgcctataatcccagcactttgggaggacgaggcgagtggatcacctgagctcaggagttcaagaccagcctggccaacatggtgaaaccttgtctctactaaaaatacaaaaatgagccaggcatggtgatgggtgcctgtaatcccagctactcgggaggctgaggcaggaaaatcacttgaacccgagaggcggaggttgcagtgagccgagatcgcgccactgcactccagcctgggcgacagagtgagactccatttcaaaaaaaagataataagaatgagcacttattaaaaagaaagactaacaatagaccatattatattgtttaaaacttttcatcttgctaatttcattgacttataaagaaggcttgagatagtcacaatattttaattcac

SEQ ID NO: 39538 - DNA, 1030 bp, Homo sapiens
ctccgcgggcttataatgagggttgctggaatgtagctgggttgcatctttgtccccaccccatcatgctgtgtaccttgtgggcatcagatgtggttgggagcaggtgctgccaccacacaaagctcagctcccagccttccttcttaggtcacactgagcagcgcccagcttgccatttctgaagtaacctgaagacccacagtttgcagccctgcattcagtgccaaaagagggcggtgggcatctccgggagcatccacaatttattatacaccaccgagtactaagtaaatggacagaagagccgtgtgagaaagtttgaacccagaaatttaatatttcattaaaaaccactgtccccttacctcctcccttgccacacaacgcaggagacatcaaaaggcaaaaccttccccaagttatttgcaaatcctcatgtttcatccatgtgtttaaccgtttaacctttcataacctgttcccaagtgggaatcaaaaggttaaaataatgcctcggatcttgacgtcacatttcaggagttctctttctttctcctccttttgcgactgtgttgtctccagccctttaagcctccttgagtaagagcaccgcacaggaaggtgtgcacctgccccgtcagcagggctggtggccagtggcatcgcatcatgctttttaagttgggggccgttggtccaggggctcatttgcctttgcacgaggtgctgcttttgcttttgcctgacaccccaagcagtcttggggtgaggggatgggtacggcccagaatcacaggcccacttctgagggcttgcagctgctggaatgagcactttcacatcagtgcccaaaaacctaacttggaaaatagtgccgttgttgctttttaaatgttttgagatgccctttttccttaattggaggtgcagtgggatgagcgtgaggcgttgggagatgtggcgggcagaaggacctccgagcagtgctttttctgttgccatcagcaggttccctaatggttttata

SEQ ID NO: 39539 - DNA, 1050 bp, Homo sapiens
ttcagcaaatggaccttcggaagattgctgagagttacagaaaactgagaaactaatcaaaattgtgttctttgatgacttagtattcaccaggtactattctaaaggctttataagtgataatgccattcaatccctgcaggaaggtattattagccagattttagagatgattaaaccagtcatcagagagggtaagtgacttgcctaaggtcacacagctagttggcggtagagctgggattcaaatccaggtttgtgtgatatcagtgactgacttttccatcccatcattgccattaccagtaagcaaataaacagtcctacctgggcaggtttgcgtcctgtctctatcctatgtgtcctttatgtttacatagtggtaccagatgtgcatccacggctctgtaatttccaaggacctgcctgtcctccccctcccaatctgctggcagtttacaaatgcttcccaggcaccacacaggggcgttatctctcctctctcgctgcgactgcaccttggcctgtgccctgactctagacagaagcctaataaatggttagtaatgactccagccccacacaaggaaagctgccctggcccaagccccctaaaggcctaagcggattaataccacctcggaaaacctgcagaccgcccaggattgggggcacgcgtgtgcttcaaaatttcttctcgatcgtctgtgaaaatgagtccgtgtccaacaaacagcattgttccatgtgagcagccatcaatgcacttggcaagaataaggacttggaacacgctggtgattatttttaattggatgggcctcgtggctgtaacaaaaatcgatgtatttctgacgcggctgcggatacactgatccatcttggccctgcggcgctccggcggccaaaggaggccagcactccagagagcagcccccttttggctttggggccctgaggaccagaggctcagggcttccccgcaacaaggccacaggaccccgctggtgggagggccggggccccgcgctgaccagacccaatagaggc

SEQ ID NO: 39540 - DNA, 1067 bp, Homo sapiens
aattaaataaccaatttgaccaaattaatttgctagagaccaaagaacaagttaaccccatacagaggaagaaaataccaacaggccaatccctaagcgagatccagaggaaatgccagtactgcctgcccctggcctgcctttctcctgccttcctctagttatgtggtcctctattttgattgtttaatttcatgtctagatagcttttttaaaaatttatttttaattttttatagagatggagtctgcctatgttccccaggctggtcttgaacttctggcctcaagtgatcctcccgccttggcctcccaaagtgctgggattataggtgtgagccactgcacctggccatcatgtctagatagctttttattggagacagagtctcactgtgttgtccaggctggagtgcagtggcacaatcatggctcactgtagccttgaccgccgaggctcaagcaatcctcccttctcagtctccttagtaactggaactgtaggcatgcaccaccacacccagccaagttttgtattttttgtagagacataggggtctcactatgttgctcactatgatcctgggctcaagcgatctcctgctttggcctcccaaagtgctgagattataggcatgagccaccgcacctggctatcatgtctagatagcttttaatattagtaaacttcattgtcaaacattagaattgcgtttccccagttacacaaaagcaaataaaatgtgtgacaaaaagagtgaataacttagtcatttagttttagccctcccctgtctgcaattcttctctcatcccagctctcattcctgaccttgaacagatggacaagaaagtttgtccaagagaaatgaacttactagaactcagcaacaggtgttgatacagtctttagcccctggagaaaggcagggtagaaatgattattcccacatcaaagacgaagtgacagaggcttggtgaggttagtcacctagggttgcacagctaattagtgggaaggcttctggctgcaaagccagtgctctttctgactaattgtgctgctc

SEQ ID NO: 39541 - DNA, 1032 bp, Homo sapiens
tctatgcgatgtcgtcattctcacattcccagaagtagaatttgaaaagatcagtgaacattaacaatttcttcttctccctgacatatgcacacatacagcctgcttttgtttacagttgtaatttttaaaataaaaaatctttggtcctgaaatattaaactttcatagtcttgctcactggggcagaatgaaggaaacaaactgagaggctgggtgaggtttgtgttttcagcagcatcatatgaggtgaggaatgtctgcttagatctggggcttgactgggtctccgcattctacactgccaccacagacaagtttggaggtgttcctggggctcagacacttgaaaacgtggggacattctcaaatttctcatcactataagtccattgaagggtttttaaaaaatctttctttctctcttttcctccctccttccttcccttcttctttttacatttagctaattcctctgaaaaaaaaaaacagtgaataattggaagtcagtagaactgggatcatgtttgccttgaagatggaacttggggctatcccctgcaaataaaagtgtcatttccaagaacgacgtctctgttatagatgggtaacttattttctagtagagggtgctgcctttataatatataataaccccatattttcttaccaccccctggccatgcagaactgcatcaacctctccaccatctcagaaaatatctgcatagggtctcatcggtttttttctaagtgctgtgcctcatagaacaccatggggttgatacagacaatacgtgaccctcaggaccttaccagaggacagtgcctaggaacatagtacatggagccaaggatgtttataacccactgtggttccacaagaactttaggtgacttgaaaaccttatgatccattgacatgaaagcactaacccattcatttgtgtacatgatcaacacatgtcagttccttgaggatggggactcgccttgttcactgctgtatccccagggcttagaatagtacct

SEQ ID NO: 39542 - DNA, 1034 bp, Homo sapiens
tcggattcatttatgtttttgcatatatatgtaattcatttttactgctgtaggatttgatttgtgtaaatatgcccagtttattcgtctctttttaatctttctttctttgacttcttactgattcttggcatttgctgtcattttgtatgtaatgcggaatctgcaagacttccattttacagattttgatcctcttaaatctgtcctgccaatgactatgacatctagacccaaatgcttaggtctggataagtgagagagaatttagcatgggattcattggcttttatgtgatattaaaatatttattacaatgataaatcctagctatcaactaatcattgaagttatatacaattaagagcatggtttatagaaacatatatccttatgatgagtgaggtactttatcatagatcttcatctcctagcttaatttgatgctgatttttcttgattttaaaagaaagttaattttttttctttttctttatcctttgtaatactttgtgctttgaagctcttctctgatctcatacctaatgtgtatacagccccccgtgtgttggggggttgtctcttagaccgtattcttcctctctgtgtcatgtggccagctttctttggaagccttgatagcaagggtttctgattgaaccagccaggcctctgctcttgtagactttctagtcttcggtgcttacctgagagaaaaaattgtttcctctgccatgactggatccataattaagagaaagatgtgtgtgtgtgtgtgtgtgtgtgtgtgttcatcccccttgactccaatccttctatctgtagaagttagctgatctttaatttaggtctgtttttgcctttacctccttgtcacttcatagctggagctaacataccattacagtagacctccctgtctccctctagagactttggaggtagacttgctttcaactgcaatggcactttttttattttataacaattttttttaattattttttttgagatggagttgcccaggctgttgt

SEQ ID NO: 39543 - DNA, 1412 bp, Homo sapiens
ttagtagagacagggtttctccatgttggtcaggctggtcttgaactcccaccctcaggtgattcgcctgcctcggcctctcaaagtgctggaattacaggcgtgagccaccgcacccagcctattttagaacaacttaagcacactttagcacactatttaaaaacagcagtataatcatttctgtacatcttcaaactagattttaaaaactgctgacttccatgctgttgagagccatgggaatgaggtggggcccagcaaggcagctgatagaggagggtgtagccaacggccctgcctgtgacttgccctgagataatcttatcagcggaggaatggcgatctaacccacttgggaaggaatttgagctcaataagtctgctatcttttggtggttttcaggcgtggctcatgaatacaaggcaacagcttattttaacactaaataccagcgtctattggagatgttacttctacttgctgagaaatgattgcccttcttgtactgatcatagaaataagtctctaaaatgtgtgttcctggcaacttccttgacataatctggtatttttctcagtcttcacttttccctttctctcataagatctctcctaagtgcaccatctctggtggtataagatactgtgtctactttttcttgttttgaaactttttcttcctttaacttctaggatgttcctctcccacttacctttaattatttcctattctcctgcatcttgtatctcttctttctttcttgcctttaagtaactttgttcctctctctcctgcctgtcttaactttcctaagcaagattgcacggtcatggtggttgctctggcctttgcaaatgtgaccttcatctctgtgtctctgtcccctgcttagagcacctgccccctgacctggcatttcctcttgcctgtagagatctctgccgaggtgtcctctgactcccagaaagcaagtcattgaaagctgaatggcctgcagtttcttctcaatagacagtctcagggccccaccactctcaggaaagaacatttcctgggttgcagaactgtggcctgggaacattctcacttccacccttcccgcctacccaccgccatcaggctgtacgcctcctttccttccttgtctcttagactgcattcttcctctctgtgtctgtactgaaggttctggttcacagtcatttcacggattctttgacacttttcccatgaaaaggtggagtctgattcctctcctctggaatatgggccagcccacatatgaaggacagaatgtgtcagaaatgatgctgtgtgatttccaaggtgaggttagaaaacatggcaaggtttccacctgcttctctctctctctctcacttgggacgtgcacctttggagccctga

SEQ ID NO: 39544 - DNA, 1041 bp, Homo sapiens
atttgtctttttaagcaggaagaagaattcttgacttaaattatctcacacttacaaacttgatgcagattttcctgcctctctttaagattgaaacctatgcaagttaaatttcagcgtggtcctaacacacacagtcaaatggtgattatggctctatttgggaaacacactgagtttgtgtttgtgttcttattccattagctataagcaaattttgcacagatatttcaagaggtatgctcttgtcttcttaaaagtagatagatactaaatgttggagaagcctactcttcccatcataacattattacttaggattaacagtgttttatatagaaactgtatttcttctttggctagaaaaaaataaagataggaagtattgcttttaaactgtatgcctttattgagctgggaaactactaacattctattttttaatttagaagttgaagtggcaatgaagtagagttccacttatttctatctaagttctctgcctcttggcttcggatggtgagacaagaatgatctatcaggacaatgtcatcaccttgaacctgagataaagattattcttgactcttatgtgaaattgttgattttggaaggttgtatgggtttgtggaccatagctggtattgtcaagacagatctcaagcttccctgaatgggagccccagtcaagcgtaaagggggagacttaagtatggaaataaatggagagttgttctccttacttcccattctctcttccctcagatttagttttcttttgctgctgtaatgaattgttacaaacggagtgacttgaaacaacacagattgattatcttacagtctgtacatcagaagtctagtctaatcctgctctccctgggctacaatcagggtgtcagcagggctgtgttccttctggcagctgtaggggaaattctctttccttgcctttttcggcttctggagctatcttgcagtcccctccctccatcctcaaagccagcgaggctccgtgtcttccttccatcatcacacctc

SEQ ID NO: 39545 - DNA, 1073 bp, Homo sapiens
tgtctgacagtaaacattaagtggggatttagcttgctcatttccacgacatccacagttaggttaattcagtctccaaagaaaaatgattttacttgaaatgtctggtcgtatacatggatcaaaataattaagacgtttatgaagctctgcaattttctggaggggacctgcatgactgttttccagaaagttatcagatcttgctttcctgattagcagcagttagcggggtggataaaagcaccccttcagagcaatctcatttccatttctttcaggccacttattttttccaactttttttccgtatcttcataaatgtttcactcttcttttgttagtatttcttagtctcttgagtcaagaaatatttactgagtatgattgcatgcataagtagtgtgcgttagagatacgatacctgtaagacaccacagtgctgggtagatccgggtgccattgtctgttgccagggccgaagttggcattttgtaagtgttcgaataagcaccatgccgtgggataagaaataaaagtgtgtgcctcatctgtcatctgtagttgtgtatatatgccctgtcttcgggcgggcttaggtctcttctcataatttgtgcctttttgctcataacagtctggtttcaaagacacaaaaacagttgttgttattgtacttagatgaagaatacagagctcctagaaggttgatgagttcatgaagaagaaggctctggaaccaggatccctcaccttggtggacttcccaccactggagcggcttccctgccggaccagggttgaccccggcaagggctctcccaggcgcacattcctttgcacattgcagctgttgggagaccgtacgtgatctcaccattctccatggcccctttccatagaccaggctggctgggtggctctgatcctgatgccccacatggcactttctgcaggtgcaggtccaaggtgggcctgcagcaaggactggtcagattactttgaaaggggacagggaggatgacatttggggcaaggagagttttactcagaaccatttgtgttgtcaccat

SEQ ID NO: 39546 - DNA, 1136 bp, Homo sapiens
acaactgcagtagtgaaatgcgcacctgctgaggtctcagctgcagtagtgagatgcacacctgctgattgctagtctggggcttcctccacttcatcctcccttcttaatggggtgaagatgaagtgggatatgatggtccctatcatcgtgtcaacaaaatatctcttcagtgtgagattttttggacaatttcttgttttacactttaattccttttttgagaaaagtgatgggcaggccactacttcagccctcatttgaagatattaatattctcagactggcgatgtacctcctccttttctttttccagacaaaagtctcactctattgcccaggctggagtgcagtgggatgatctcggctcattccaacctccgcctcctgggttcaagcaattctcctgcctcagcctcccaagtagctgagattacaggtgtgcaccagcacacctggctagtttttaaatttttttatttttagtatagatggcatttcaccattctggccaggctggtctcgaactggccacctcaggtgatccgcccgcatctgcctcccaaagtgctgggattacaggcatgagccaccatgcccagcctggcgatataccttctgttgccttctgaactggacttgttgcattgtacaataaaaaaattatgctaattttcaccagagttcatggatttggctttattttagagcacctgctctcattaaagatgttagcacatcagagaaaatgtaaattgaatttctaacaagcactcttggatgggaaaggggttttaaacagaatttctttgttttgtccctttcagcaaatactattgtcatgctccacaagctggaacaataacctacgaaataacctgctaggttatgaatgaaagcatatattttgtgaaatttgtggtcatttagttgggttgaaatgaaatagtcactgatgtttattttctttattattttcttcaatgttttacccttactcaacctatgcacctgggaaaggggaaggctgccagttgctttcttcctgtaccctaccatggacccacagcccctaaactccagtacaattattccctgcactattgttctctgccttaagcattagaaaagggttt

SEQ ID NO: 39547 - DNA, 1081 bp, Homo sapiens
ggaaaaatttcaaactaaggatctaattccatgaggtctacagtgtaaatggtgccgttacttgtaaagcccttgttcagtgaacaaaccgcgcagctgaacatgcagccttgcttcctttttctccagtcctctcttctccatttcttcagcaatgctgagtcctcactgagctaattgcctgacatgcagaagagcctctctttgtctgcgggtcagagaggcagtgagaagggggatagagtcttgcttgtcaggctccagctacgaggcattaagacatgcaccggcttttattttagcattgccgttctcaaccttggattagaagtgccctggatgtataaaagaatttctataaatgtaatggacacacattatgggctaggaattttatacgtctcactagtccttacaacaaatgaccctataatgtaggtggtttcgtggctcaaagagggtgggtgaccagtccacagccgcccacctagtaagcagcagaactgagatacggacttgggctgctgggttgcagagctgctggcgtccctggtgggtttccacaccaggccaccctgtagccccgcccctgggaagggagtgagtgggaccctgccgtcccctttcctacatggccgctgtgtataggcagcagcgcagaggtggtctctgggtagggaaccctctgcctcctaggattcattggggatgaaagtcgcagctgttttatactcttcttaaattttgctttcctgttaagccaagatttactggacacaagaaaacttcccagcagtcccctagaaggaaaactaactcttggtagtcttcccattagcaaataaaagtccccaaatcatttttgtagactgcccaaaccaaggcacttttcatctgagaagacacagcaattgtctcagctgtaaagtaaaagagaattaaaaaaaggtggtctcttttgaaaattcctgttggtgctttggccatgtgattacaatgaaattggtgtgccttcatcttcaaagggcagaactcggtgcttatatgttcatttcattgtagtctgatgggacagacactt

SEQ ID NO: 39548 - DNA, 1034 bp, Homo sapiens
ctctccaaatgcttattgaggaaagaatagaaattgggtaatattagggcttttatagaacaggtgggatgtgctccatgagagcaaagcttttcagcaaagaacttgtcagaaataagatgatgtccattttttttctatcctgaatgctttagaagggtggattaaaagttggtggcaaggccaggtacggtgacttacacctgtaatcccagcacttggggaggccaaggtgggcggatcacttgaggtcaggagtttgagaccagcctggccaacatggtgaaaccccgtctctactaaaaatacaaaaattagccttcatggtagcatgtgcctgtaatcccagccacttgggaggctgaggcaggagaatggcttgaacctgggaggcagagattgccgtgagccgagatggtgccattgcactccagcatgggtgacagagtaagactttgtctcaaaaaaaaaaaaaagaaaaagttgttggcaaaaataactccaagggaggtataattttcgaacttgaagaaataccaaagacagcatattcactcagtaattctgatgaagtgccccacatgcaagctgggctttaaaagtaaacctgggaggccaagcagaacctggatcttcccaaagttattctccaagcatcacgggcaactctcatccctggcaggtaacagccatgtggatcactggaaaaagctatttggctttggagagcacatgtgtgcatttggattgtatcttttaaaatttattttacttaggctatattaatattaatgtgtagtcccctaattcatatcactatcagtagctagaaagattgtagatgatttgaatgaatttctaggcagtgatttttctatatatatttgccatttgaatttctgtgaagtgttataattgaatcctttgaacattttgaaagtatttttcatcttgatttaagaaattataggctggatgcagtgtctcacgcctgtaatcccagcacattaggaggccaagtcaagaggattgct

SEQ ID NO: 39549 - DNA, 1131 bp, Homo sapiens
attattaactaaagtctacagtttagggtttactctttgtgttgtatattctatggatttatgtcatgcctaatgtcatgtgcccatcattacagtttcatacaaaatagttttttcatatcagaaaggctattttgtatgatactgtatcaaacaaaaaagccttctaaattccctgtatggtacagtatcatacaaaatagccttgtaaattccccatacaccctccccatcctctgcccgaagtctggcaaccactagtctttttactgtttctatagttttgtcttttcccgactgtcgtagagttgggatcatgcaagatgttgccttttcatttggcttctttcacttaaccatgtgcatccaaggttcctttgtatctttttgtggcttgatagctcatttctttgtattgctgagtaatattccattgtatggatataccaccatttgtttttctatacctaacgaaggacatcttggttgcttacaatttttggcaattatgaatgaagtttccataaacattcctgggtaggtttgtgtgtggacataagttttcaggggacgtgattgctggatatatggtaagactgtgtttagctgtgtaggaaaccactacattgtgttctaaagtggctacaccatttttcatttccataggcagtgaatgagagttcctgctgctccacatccttgtcagcatttggtgttgtcagtgttgtggattttagccatgctagtaaatgtgtagtagtatcttactgttgttttaatttgcaatttcctaatgacgtgagacatggagcatcttttcatgtgcttatttgccatctccccaggttattttaaggtctctagcatggaatgaaaaccctcacagtgggaaagcagaatcgaggcactgatgagagagaaggtatagtcattgaaggggtgggctgaatcaaggcactgatgagaggagagaaggtatagtcattgaaggggtgggctgaatcgaggcactgatgagaggagagaaggtatagtcattgaaggggtgggctgaatcaaggcactgatgagaggagagaaggtatagtcattgaaggggtgggctgagtcaaggcactgatgagaggagag

SEQ ID NO: 39550 - DNA, 1035 bp, Homo sapiens
cccaaagtgctgggattacaggtatgagccatcatgcctggcctcctcatctctttcttcactgtatcccaagggcctggcagcgtggcagaaagcctggcacatagcaggcaagtgcttgctgtatgctgtttggatagagggctggggtgggtaggggcatggaggatatttcaggcagagagagcagcatgggtgtgaagaattagggcaggttgtagtttattttgactggtgacttgggcaaggagagggcactgagtagctgatgagggaaggcaagtaggtggaggtcacactgtgggggattttggaggccaggctagagagtccatagagaggccagttcccagagtcctgccaggtgtcagtttcagaaccttggataacttaatgtttccgatcctcctttttttccttatttgtaaaatggagataatgaagatgcaaatggagataatgaaggtgcaaatggagatacgaggttgtttggaagattaaataacataagatctgtcaaatgcttgccactgagtccacacgcagtgaagcatgtgcttggtaacagttggctattgttgttatcctgaattcaccagacaatgggagagcatgactttcctgtagggaagcgatacgattgggtctgggcttttaggtcagtgaatctggcagcagtaggatggattggagcagaggcaatgaccctgaaggagatgcagtagtgagttaataagcatgagagtcgcccaggtgagaagtcatgaggacttgaactgctgggggagggggggcgggtaaaggggggttgcaggaataatgtgatgatgggcacaggcgtcagagccctcagagaggtctgcgggacttggcagtgaactaacggagagggacgaaggcttgaatctgagcccctagaggcatagtggtgctattcatgggaagagggaagccaggcacgtttgcttcaggaagatgatgagttcagtttgggtcatgttggctgcatagtgcctgtggaatttccagatgtgg

SEQ ID NO: 39551 - DNA, 1631 bp, Homo sapiens
gatgcttccttccataaggaggccactttccctccagaggacacctagattctctttatagtagtgtcgtgaagatgaatggcggtgctgagctgtgctcccgagtgtcccgggcaggctgtcgccctgttctgtctccagccttgaacaggtttgtctctgtagtgatactggagttcttaatccttttagaaggaagcagtgagtgctcttcccagaagaattcctgcatatgcctgtatacaatacttggatcaattcactgggctcacaggtccctggaagaccccaattaaagaatccttctctcacaggctcagtctctgcatttcttactcgtaaaacgacctttcctgtcagggtaaaatagattcaaataggtatgactaaaggctactaactcttctctgcaacagtgttagttgattgctacgggataataaattcatatatttaaaaccaaaaaatatagctctatgtgtgctgtgattcattcttccccatattaaattaggtgattatataggtcagatttttacagaagaaggacaagtacaagttggttaaatttatgaccttagtatttacatgggatggtagagttaaaaaaaaaaatccaggtttactttctttttattttataatttacttggttttctaaataggtataaagctaattaaaagttaggtgtactgaactatcatgttttttttattgaggtaaaatatacataacataaaatttacaattttaatcattttaactgtacagttcagtagcatttattatatcatgtagttttaattaatcctattgtgaataatttctaaatcttcaaaaaaaatgagaaagtagaaaagagtgtaatttacccagaaaaaaatatacttcttgaacaggttgctaaggtgtcacaaatttgggctttcctggcaagaagaatgcaagcatttaaggtaagaatgctttatggaaagttcttgtagattctagaaataggattgtttttcaaatggagtgattaattttattttgcagggagaggaaggaaatctctaaggtagccatattaagataattttaaagattgtaaggttaaaatctggactttgagttgcatttggaagtacagaaaatcagcaagactcttgaagacaaatgccacgtgcagacatctctagttttcatcagctgaagttcacaaattaccttcacagttatctcaaagtacagcacaatgctgaaacccccctgtgaatttgcaaatgtgaggatcaccatagtaacaaccatattaaactttacattttaacattgttcgtacaagacgcttgtgtctttgtaagactttctcagggaataaaaagtttttccttccactgtaccacaagatatttcctgcttatctcaggcattgtttttgaaatccgaaagtctggatgtcatattaaaagcagccaaaatattcgtgttggtgtcaggatgttagagtactatttccaatagcagttggagctagagctgtggaatttatggatgtgtttggctgtggaggattgcagagaaagctgtggacaaatatattttataagtgataaattcagagtattgtctgggcggtagagagtgc

SEQ ID NO: 39552 - DNA, 2109 bp, Homo sapiens
ccaggaaaccactagacctgttctttgaatgactcacagtggctgccatcactggtggtgaaaccaatctatgtggtgaggtttagcacatgtccagctttaaaatgaatggccaagggtattttcccacccaaagctaagatgaactagctgcacatggatattcatggctcttattgatctgatacactctggcccaattgatcgactcatgtttgaatcccagttctgcctcttactagctgcatgactttgggtagtgccttaccttctctggaactcagttttcctcctctgtagagtggagatgtctgccttctagggttctgcttcagattaaatgccataacccagataacacacttcagaacagagcctagtgtaccgtaagcactagtaaatgaatatggtattgttatcttattatttttcagagtcagctagcatttaataaatgttctatgtgtgctcagcattgcactaagtctttatgtaatattttgtttattcctcacaatgatctcatgagcaggaggttaaggaacttgcccaaagtcaaacagtaatcgtgatagagctaacaatcttaatataaattaaactgactccaaattattatacagccttctgcaatattattagatggtctctacacccgcaatgaagcctacagttagtgagcatatcatacttaatgacagaatcccagggtacacattgcagtctctgccttttgtgattggatgggctgtttggtagcggacaccacggaatacacattgaggcagggagctctgagactggggagaggctccaagagaacactcagtaagaggatatactaggctgggcatggtggctcacgcctgtaatccaagcaatttgggaaggtgaggcgggtggatcacctgaggtcaggagtttgagaccagcctgacgaacatggtgaaaccctatctctactaaaaatagaaaatttagccgggcatggtggtgcacacctgtaatctcatctactcaggagactgagggaggagaatcacttgaacccaggaggtggaagttgcagtgagccaagattgcaccattgcaccccagcctgggcgaccgagagagactccgtcaaaaaaaaaaaaaaagggatatactttgcccctacatccaggaaagtcagtaacacttttcccacctcagttgcagaagacattctgtgggcatctttggtagaaacagcattcacattccccactgagggccgagtggaggggccttccatggtctagtcagctgctcaaggatgagaccaaagtgggtacgggaggggtcactagtcattgaaaggtcaggcaggagcatcaatgtactgatcaaggcaaagcccagaagtgggcatgtggccagaagctgggctcaaaacataacagggatcccagtgtgaggaggccagagttgagggcagcaattctgaccatgtagacagagtccaggctggggaagggaccacaagggaaacacctggtgactctggcatgggtcttagcactgccagatattacacacacacacacacacacacacacacacacacacacactcttcatatctatctatctatcatcatcatcatcatcatcatcattttatatatataaaaacctgttgaaaataatagctctgaattattggagataaatgaatgtttccaaaagagatggaaagattcaaagagttaatttcacctctgtcttctgccagcttcttatagcagttttgattagacaagagccatcacggtttattaaaaataaacaaagccaagatgcgccagaaatagatgaaaacctggttcatttgtcttgcctccgtctcattcctgttacatctccatgtcatgcagttagttgtctgtccaaaacagtttctatttttaaagcaacagaggatacttttcaggcttgggttagagaggcctctctttggaccaatggtccctcacggtgtgtggcaagccccctctgcccccttgggttggtgagcggagagttcttttaagcctaatgtcctgcagaaattatctgggaaatctgttaaaacagagtctggtctgaa

SEQ ID NO: 39553 - DNA, 1049 bp, Homo sapiens
cattcccagaggcaaaggcatttggattagtgaaatgcagcctccctagtcctgcccctgagttcctagttatctctgtaacagcagctacaccttgggttagggtcttgaagttagcagcctccgccccaccctgatagacagacatattctccttctagataggaaataaaaagcagaggatgcctgttggagaacagagctgggcagcagagggtgggcaggtggcaatgtggtgataccctctccaccctgtgggggacgccagttcctgcacttcccatccagccgctgggtgcactgccacagtcacggcttgcagaatgaaggatttattagtcatggaaactggcctcggagcaccgtgcccccactagaggcacagcggttctgggtcttgagatcctcatacactaaaggtctgccacaaatttaggatcatcttcatgctttgtaaaaaaattttttaaacccctgttgggtcagatcctggtctatcatgcgacggtggcaccagagggggctctgcagggggcatcagacaacctcatttcccttaatacaactcactatagatctgtgagttcacatagtttctgagcttatttatagtttcagcctcttcagtgtcctctgtgttgtcatgaattttccaccatcgtgtaaagttagctctttttcttacttaccctgaatctgcctccttcagttcaaagtggtctccttagctctggggtttcagagttgacggacatgcctgttcaccctttctattcttttccagtatattttctagtgagattcactgtaggtttccacaagatgaacactaactggagcgatgagtgccttgtggatccttcaaggatttcaacagcaaagttacctcgagccataagcctgcattatgttctgacttataagaaaagcgatttttctttctctttgttgtcatggggctgtcttccaccacattaggcaaaaaaagtagtgcagtgccttgttttcagagcttctgctgacaaatgaagattccgaggacttttggg

SEQ ID NO: 39554 - DNA, 1046 bp, Homo sapiens
ttcccatctctaatttggaaacaccatccgagtttttaaatttattttgaaggaggtcataaaattctcgcattgcaagatttttttacagcacctttattgagatgtaactcacatgccgtgagatttgcccttttaaggtacacaattcagtggcttttagtatactcagagttgtacaactatcactcttctctagttttagaaccttttcattgccctaaaaagaaacccatacccaccaacagttgctccccctgtcctaccccaccacccctgcctggcctaggcaaccactaatctattttctgtctctatagatttgtctattctggacgtttcagataaatggagtcatgtattatgtggccttttgtgcctggcttctctcactcagcatagtgtgttcagggtttatccatgttgtagtatctatgagttcttcattcctcattttatttatttatttatttatttatttatttatttatttatttatttattttgagatggagcctcactctattgcctaggctggagtacagtgacatgatcttggctcactgcaacctccatctcccgggttcaagcgattctcctgcctcagactcgcaagtagctggaattacaggcgcctgccaacacgtctggctaatttttgtgtttttagtagagatggtgtttcaccattttggccaggctgatctggaaatcctgacctcaggtaatccgcccatcccggcctcccaaagtgctgggattacaggtgtgattcatccctcattatggcggtataatattctgttgtatgagtagaccgcatcatatttatacatatatcggtcgatggatatttgagttggttccactttggggttcctatgaatacttcctggaagactttaaatcctattaaataattgtgtgtgttatgtagcactttaggcataagagaaaaagcatcacatcagaaaaacaaggataggttgtcaacattccaaaaagtttggaaaaatcactactataagaagaaaactataacctaa

SEQ ID NO: 39555 - DNA, 1016 bp, Homo sapiens
gactaccatgagcaattggataaactagaagatatgggtcaattcctagacacatacaacctatcaagacaatcatgaagacttagaaaacctgaacaaaccaataatgagtaaaaacattgaatcagtattaaaaagtctgccatcaaagaaaagcccggaacttgatagcttcactgctgaattctacctaacatttaaagacaacccaatactaatccttctaaaactcttccaaacaactgaagaggaaggaatacttccaaactcattttatgaggccagcatgtcctgagagcaaagccagacaaagcccctacaagaaaagaaaattacagaccaatattcttgatgaacatagatgcaaaaattatcaacaaaatattagcaaactgaatttaacaacacatcaaaaggatcattcaccatgatcaagtgggatttatccctgggatccaaggatggttcaacatatgcaagtcaataaatataatacaccacattaacagaataaaggacaaaaatcatcatcgcaatagatgtagaagaggtatttgacaaacctcaacatcctttcatgataaaaactctcaacaaattaggtgtagaaggaatgtacctcaacacagtaaaggtcatatataacaaacccacactgacatcatactcagtggagaaaggttgaaagcttttcctctaatatcaggaacaagacaaagatgcccactctcagccacttcttttcaacatagtactggaagtcctagccaaaataactaggtgagagagagaaataacaggcatccaaataggaaaataaggctgggcgcagtgactcatgccttaatcccagcactttggtaggctgaggggggtggtcacctgaggtcaggagttcgaggccagcctgaccaacatggtgaaaccccgtctctactaaaaatacaaaaattagctgggcgtggtggtgtgcacctgtaatcgcagctactcgagaggcagaggcaggagaattg

SEQ ID NO: 39556 - DNA, 1068 bp, Homo sapiens
attaacaactattcctgaaaactcacagggaatctcagcttgctcatttgagttttattcccacttttctcacataggaatatttagaattgaaatttttagaaaatgaaaacattactggaggcttaaattgtaatgtgaacccgatacatagaacaaactcatgcgcaatcacttccttcgtaaacgttgtagtagcatttatgctgcaccagagaaaatcccgacaagaagtgttggttttgaaatctgcaagaaaaatggacaggttttttaaaacacctttttattctttcagttgtttttttttttgaatgtttttattgttgtttttattgaatgtttaaaaaacgttgttctcatttcttagaagttttaaattttagaatgctctttgttgaggcactgggtgtaggtgcagtctcgattctgaattggagggtggtggttattcatagggagaggctgaattagatatgtttagaacccaagatgtgacccagccgctctccaccaggcacaccgtgtggcagatctgcagatgtctgagataagaaccgcaatgcgtggcctcttacagcagtggggaggggagaaacctgggttttcctcccaggatgcggggaagctactgcagggtttgtgtttgtttgagacagggtctcactctgtcacccaggctggagtgcagtggcgtgatcatggctcactgctatgggagtggggaagattgggtgtgtggcattagaagctcgctctggctgctgagagaagaaaggattagctgggaagagtggcagaaggagacaagttagggactgctaccgtaactggagagagaggacagtcatggggaaatgagggatgtggacagacctgggaggtggaatcttctgatgttggtgggatgggatggtggagtgggagaaagggagagatcaagggtgacccccctcagtttctagatagagaaacacggtggacgctcatgccatttaccggaatggggaagctggttgggcgaggggggaacaggtcttttatgggcagaggaagagaatgcgtgaa

SEQ ID NO: 39557 - DNA, 1321 bp, Homo sapiens
gccctgcagggccctggcttggctctggcttttgagcaaccttagccattttgcttcctcagcttaagcctttattgcttcaactctaaaatgagcgggttggacttgatcacctctgagttccctttaaagtccctacattctgaaatgctgaggccagagcccctgggatgtcactaacatgcagttgactgtgaagtgctgggccctccctgggaactgtttgacacaaagatgggagatcagccgtccttggatgcctgtccctcctccgaccttcccctgcaccctctgacactcttctctgccaccaccctccctgcgggctctgcatgctttctgcctagacatccaaatggcgggatagtaatgatctctggtctggagaggtagacagggcatttgttctgatttccacttgaaagatggtgaatctgaggtttagaaagggcagccaggaaacaacatgtggcctggactgcagggctctggaagctctttccaaattatgcaagatgccgaggactgtgagcagatttttataaagggggacatgacttactttccttgtagatcatggccactttgagagcacccattcttttaaaatcttttgttccagtgcaggtcactttgtttcattaaggaagcttacaaggaaataagtttttaaaaatccaataaatacaaagggagacaatgataaattgcattttatgggctctaaggtctcaaaaccatttcatttcctgaatgcataattccaaatccgtttcatatcctgaattcatagtctacatttaaaaagtgccagggacagtcaaaccaacaggcaaataatgctcatcgataccttgaaagtctcttcttgtctcaacccctaaagactgcgttttcctctcccatggttccctagaaatcatgtagcttagatttggtatctcagcttttcttgacagctgtgttatgccactacatgggactacagcctcccatggtgcctttttgggatttttttttttattttttcatttcaaaatggatgcagaaaagtataccccaaggagatttatagtgtttttttgcaaactccttcccctcaaagcttccatctgtagattcctcactaagcactgatgagatgcaaacttctattttttggagaatttaaataagctataattttgttgtcctatgtaactatgagatttttttttaaagcagtctaaaatgggagtttctagaatacaagccttctgcctttcctgtttcattcatttaacaaatatttctgctgtacgtgcactgggtgagcactatg

SEQ ID NO: 39558 - DNA, 1045 bp, Homo sapiens
gagggagccagccccaggctcttcctcttcttctaaggacactaatcccatcatggggccccacacttatgatctcatttaacttgtgtcacctctcaaagccccccaccccgatatcatcccattggaagttagggtttcaacatatatatgaattttggggaacccattcgctccatagcaaacagcatttggtttgagaccgtcagtccagaacctgcctcaccaaaagggttttgttactgccattccccatggacttctttacaagggatgctcctgggatgacagcaacatgacgatggtgttccatgtcacaggatgagcaagtttttgctacttggatcaccctatgcatataagcaaccacctgcttatcataatggtctaaaatatttcacttgaagaagtagggatgtgtttgaattttataactcttaggtcttcagctcacaggagacaaatcgattgattgattcattcattcattcaacgaatatttgctgaggactgaggaatattctaggtgctaaataatttagccatgaatgagacaaaatccctgccttcaaggggcttatgttctagtagggatgtctgacaatgaggaagtccacaaatatatgtataacataatatcagattattatgactgatagaagaaaattaagaagggtgaagcagtagaccatgacttgaggagatgaggctgtgttagattagttagtcagggaaggcatatatttgaagaggtgacactgagcagaaatctgaaagaagggattgagacttgaatatatgagggaagagcattccagggagagggaacagctagtgcaaaggccctgaggtggggatgaactttgcatgtttgaggcatgggaagaagatcaacgtcactggagtgcagtggagaacaagagagtgagtgggaggaagaggatgccactgagagagctaggggccagatcaggtagggccttaaagaccatggtggggacattaggttttgttcttagtataactggaagtcatttttaaaaga

SEQ ID NO: 39559 - DNA, 1040 bp, Homo sapiens
tttcatttcatttcatttcatttcatgtttttgagacagggtctggctctgttgcccaggctggagtgcggtggcatgatcttggctcactgcagcctcagcctcccagggtcaagccagcctcccacctcagcctcccaagtggttgggactacagtcacacactaccacagccagctggtttttgtattttttttgtagagacggggtttcgccatgttgcccaggctggtctcaaactcctgagctcaagcaatctgcccacctcagcctcccaaagtgttgggattataggcactcccggcctcttcctggaattttaaatgcaactcagaatcacttggcaaaaatgttgatgcaccacaatattcactagtaagctcttgtacattctcaatagtagatgagtaaattgggctgtttacacactatgatttgaagcctgtattataaagctacagattcccaggtcctgtatcttaagtagacctctctgggtggtctgggaggccctgagttaagagtaaggacactaactctgtcttgcatgcttggagggtgtttgggccccacgggcagaagagagcactctccttgtctcccctcctccgctctctgttcacgcaagtgcttgaagcctggagcccctctcctcactcatgaactctgcaggttcaaggcaagactgtgctgtgtttggagacatccctgtttaactctgcatctagccagaagtcctgtagggaaaaaccagatttcctaagtgacattcctcgactcggtagggtgaccttcaccttcctcctcccttagcaagcctgaaagctacagttctcacccgacaaaggtagacagagagacgcgtgtgaaaaagagctgttgagctttgatgaaactgaacatcaagtttgtagtctacaaatgggtatgtggagttctactgtcacctccatgctctctgggtttgagcttttccttccagcttgctttgctcatattttccacgttagtccctgggctcattgatttaaattccctcc

SEQ ID NO: 39560 - DNA, 1027 bp, Homo sapiens
ttaaagttcttatcctacaaatgccttcttcttgacaaagttctctcctcaagagatcatcccacatgccctttgatgaccaagtctgggaaaagcccaaatcctttgtgttttctaacgaaattaccccctacaactcaaaaccagcttcctgttccgagaaaggcaaggattgtctgcactcgccatccccctttctttcggccccactcccctttcatctttcccaccacttacaccctcttgccagctgttgaggagctctggggactcctctgcaagtcagagcgcggtcagggctctccaacccttgcaccgggtgcaccctgtgctccctcccagagctggaaagcatccacgccggttccatctcattccatgggaccagcatgtacccagtggcaggcctttcatgtcctgctcacctcacgagggcaagcccgacagaatggtttgagcctaagtagaaaaaaatttgcccagcctcctggccctgcatgcctccagcaagggcagagagacgaaccatctctatgcgggacatgccccagggccccttctagatccccatccctgtcatgtggggtaggccccctgctgcccaccctggctccctcctacgcccttcatgaaggatccctctccaagcccatgcagccttaaattattccagctttggtctctcacagtgcttaaccccatgcccttcccatctttgtgcacgtggtccaagcattctgggcatgatgggttaatccttcctgccagctgcgcatcctggctgagctttgtttccagtactctccatccagcccagaggaagcgcagctcagccatggtgctctactcccaaggaagccccaggatgtccctgccagggtccaccctcccacatcagcattccccgtgcccatgggccttggtggggagatgcacggatgctatggggtctgtgctcaagcatgctggggaacgctactctgtgagaaacctcggggtcgggggggaagttctttgctcttaggtt

SEQ ID NO: 39561 - DNA, 1040 bp, Homo sapiens
gggccagggagccacctcttctctctcggatcctcatatccctcaaatcattaaagcgagagaaactgaaggagctgaagaggcaaagcatgggcctgtgagaccctctcgggctcactatgtatgttttaaagccccaggtgcatgctgccctcgtttttctgatggggtaggccctatgagggatgtctgtcgtttggtgggccctagtccagcgtcggaattgccagcagctttcgctggaatgcgtatttttagtacagcctaaacctgtaataaaaagggatttacatgtactagattttaatcacatactgtggacaaactaataagaaagtttgctagacagtaagatgaaacactgccagcatttttgcaaaccggttatacaagagtctgcctaactctggccagacccaggcagcttagtctagaggttcagaggtggcctctggaggcagctgcagcctgggtcccagccctgctgtcctgtgtgggcactgggactgtctctgcacctgagatgccacatctggaagggctgtgaagacgaaggaagtagtacatggagccctcaggccatgccagcccctggggggcaccgagcagaccagcctcctcccacatccaggacatggcctggtcccttgttttctgtcctgtcatttttggtgtgggtgccacaaagaacctccaggcgccctctgcagggactcagtgtccagtcgcttttatttctggcagggctttcccctgcctcttttaaatccttacaggctctctttctcattccctcgcctctttttggctgtgctcttcctctcccgggcacttgactgcatcttactgcacactctgccttctgtcccacagtgtctgccccttgttgctctcactgcttcctctgtgtgtgagtctgaactcagactgcagataccttgtgtgttgcatacactctgctgtgcgctgccctcaggaacccagccactgcttcacagttgtacattaagagtttggacatggcagagattcggccctgc

SEQ ID NO: 39562 - DNA, 1125 bp, Homo sapiens
cagtgagccgagatcaggccactgcactccagcctgggtgacagagcaagactccgtctcaaaaaaataaaaataaaaaagaatctacacctgaagtagaaactaactacccttctgccatgaagttctgcagagcctccttttatctcaacaggctccacatttcaggttcctgtcggtcactcctgagagtctcaacagcccctggaggtcaggatggagggaggggctacacattccaagaaggagaggcagcgttggcccacagagcggccttggtctcaatgttggacttggaggactggagcttgtggacagacccatgttgtccgagctctcatcctgaatgcagaaagccagaatgcagatttgttcattttcaacagatgactgcaggaccaacgttgtcacaggggccagcattctctcaccaggcaaagccagccgcttctctgcctggtatcaagctgcctgggcagccaattcgtaatcagagtgccaatttataagtgtagaatgagaaatagaactgccacaggaagcagaatcactgcctggtcggccctgtgggactttctggagacttctgtcaaatatgctcgtgtaagactgggagccatgaataaatgcacatttttgtttgtttttgtttttgttttgttttttgagacagggtcctgctctgtctgctggagtgctgtgatgcaatctccacctcccgggttcaagccatccttctgcctcagcctccccgagtagctggggctataggcacgcgccaccatgcccagctaatttttgtatttttagtagagacagggtttcaccatattggccaggttggtctcaaactcctgacctcaggtgatctgcccacctcggcctcccaaagtgctgggattacagtcatgagcccccgcgcctggccaatatgtgtacttttaaaaagtgctttgatagaggattctgatgtaaaataatgcgtctaacgtaaattttttaaggtatcacgtcttttttattctgtgcatttatttagaaactgtttatgacaaaagagtgagattacatgtctaatacagttttttggagagagcatccctggccaataggaaagcttcaaca

SEQ ID NO: 39563 - DNA, 1035 bp, Homo sapiens
ctcttcatgttttttttttgttttttttttgagacagagtctcactgtgtcacccacgctggagtgcaatggtgcaatcttggctcactgtaacctctgcttcccaggttcaagcgattctcatgcctcagcctcccagctagctgggattacaggtgcccgccaccacacctggctaatttttgtaattttagtaggtgggatttcactatgttgaccaagctcgtctcaaactcctgacctcaggggatccacccacctccgcctcccaaagtgctggaattacaggcatgagccactgtgcccggccaattcttaatgatttttaagcagctgccccaaattttcattttgccacgggcccccgacattccatagccggtcctaactggtagaactttgcctgttcttttgagtgcctttgttgagaaaagtaattaaggacctgctgactggactgcagtgactcagtgaagtgcttgcagctttatgtgaacaacaagaaacaaaaacagcacactgtatttagagctccagacgtctgtgcggacccaagtctgctggcaggggtattgatgtcgtacttcgtcatttctgagtgccattagagccaccaacctgttctgggcctaggctgggtctgtaagcgcccctgttctcgtaaatactttatttgtagagttcctgctgctgggctggccagcacttcctcattgtgtgaaatgtgtagacacaattgacttcagttcttgaaaagttttatttagctatggaatcgtagtatttgagttggaaataaccttttatagcatatccgacttgctgaggcccagaaactgtgcacatcatatcactaggcaaaaggccaggacccaagttcaagtcctctgccgtagagtcctacatcctgccagcagtgcccatcatgtggtgtttcataagggggcagcatcgcaccctaggaacttcactcagagctgctcacaataattacagtcaacatttgccacatttactagctgactgcatttttgt

SEQ ID NO: 39564 - DNA, 1050 bp, Homo sapiens
acattgggcagggtgcccgctttggctgagcatcaaaaggaggcagggctccccatcaacatgtggtctgccctgcatcgtgtgagcacacaggtgcacttacacacccaagtgtgcgacagaaaactgggaggggctgtgatagctaaaccccgatggggtgggggcaggcttgacaatgttgaagactaagggggtgaggtcccttcatcccctgcatgctggcaggtaaatgacatcatcagtgctgggttttgatgcttgttttaaagaacatttttttcttttgttgttgttgttgagatggcgtctcactcttttgcccaggctggaatgcagtggcgagacctcggctcactgcaacctccgcctcccaggtgcaagctattctcctgcctctgcctcccaagtaactgggattacaggcgctcgccaccaagcccggctaattttttatatttttagtagagatggggtttcaccatgttggccaggctagtcttgaactcctgacctcaagtgatccacctcggcctcccaaagtgctgggattacaggcgtgagccactgcacccggcaagaacatttatcttgcatcaggggacacaacagagtggaacagatgtttgcagaggaaaggcccccacgggggaaatcggtggcagagggacagctcagtagggagaagcagggcagtgggatccgtgcctggggaggggtgagggcggaggagtaggagcgttctgccaagagtgcctgggggaaagggttgcgctggaagggggatacagctagtgccaatttggggagccgtggtgagttctgtctaagatatgtttacaaaaagaatctaaaagataacacacatgagtctccccattggcctagagtgacctgaaggtcctttctttagttgcctgcatgtaatgtggaaggagggaaaaatcagctgcttatcaatgagaatgtcgcagcctcataggaaatgttacctgtcaggtgcctgtccgggaagccatgtggtgatgccgccttggcttctccgattcg

SEQ ID NO: 39565 - DNA, 1053 bp, Homo sapiens
cagatggtcttagagtttgaatacatccgtgtgcatcatacacatatgctgatacgggggtgggaggactttacctaaaaaggactcttttttttgcatggttccacaatttgactttttaaaatatttcctggagatgtttccatgatgatacatagatctacctcatttttttaactatttcgtagaattccacagtgtagatgaactatagtttagtcttctgttgatggatattagatttaattttttttactgttcaagaaatgaagtagtgaattttcttctgtgtatctctatgtgcacatattactgtgtctctagggttgacaatgggtgtgccatctctgagttgaagggaagcacatttaaatgtcgatagggatgccaaatgctcctcttaagacactggacaagtctgtgctcctgtgtccccacacctttatggcactggctgtgaacagtcttgtcattttggccaattcgatgaaaagaaaaatattacactgttttaatttccattttctggataatagattgtacctctctttatgttcatgggccttattttttcttatcacaatgtatgccagtacatgtccatgtatcagttgagttatttgttctttttctacgaacatgtaggggttctttatgtttctcaaaaataataataataataatctcttaagcatcctttgccaatctccaaatccaacatttaccttttaactttacttttttacacggaagtgtttattaatgaacacaatctgtcaatctcatactacgtggctcctcggtttgtgtcttatatccttaccccaaagttacatgaatgttgccttaatcttcctcaaatacctttatattgtgtttcttacgtttggtgcagtaatttatctatcagataattttgtggatgtggtgcaagctgaagttctagctttatttttttctaaatgtttaatgaagtgtcccaactccacttactatttcattattctgttccagcaagtctcaaactttttggtctcaagactcctttacaca

SEQ ID NO: 39566 - DNA, 1047 bp, Homo sapiens
tcaggcaatggcttgatttgtcacagcgtccatggtgcttcccgctggcttgtttgtgactagcagggcaggtcaggaaacagtaagagccagggagagctggcctctttcccccacctgcagtgcgtgtgtgggtctaagagaggatgccgaggcctcagttctgtccaaatctcccttcttgttcctgagtccttcatctgcatatggcacggctttatgttgtttagagaccacaaactgtcacaaccaaaattatttccaccactgggttaaatgtgctgttttggctggattggggctgtatcttttccaaaatccatgttcctttgggtggggcatttcttgaggatggtcctaccctgagaagtgtttgaatcgtttgttaaaaggtaaactgaaggacattaaaatagtgaagagtgtatttgaacagacggcgattcatgaatctggcagctccagacttgaagcggtgtggggcagcactgaaggggctccgggggaggcttttattgggtgaaggcagagcaagacaaataagacatttgctttgttaaagtggggccgtagctttccttgggtcattctggagcttgggcagggacataggccactcataggcttccgggctggccccaggcagatgtgagggggtgatgcctacctttgcccctccctctcgtcccctcttgccttgcccttccgctgtgccacctcgacccagcccctgtgcccttaagtgggccagggccttcccgggcatcccggccaggcctacccactgagagtgtccccttcctcggacccctgggcccagacccctgtgcttgagttgcccctcctgggttcttaaatggtgctgtgccatgcaaataaggcagagagagttcttgtgttcccctctgggagtctgcttaccaagagttcagagacccacattcggttcctgcagtgttcccagaggcagggatggcagctggctgggtatggccaggtttggaggaaggagtcctcatataagcctggcgggaggaatggaaaatt

SEQ ID NO: 39567 - DNA, 1117 bp, Homo sapiens
ttcatttgcctattcctttaggagtcaccttccaaataactagtaccgctgaaggcaccgggctgtgatggaagggttgttggaagaggacactgcaaaggttaagaagcctgtcgcagtgcagcagctgcctgttggtcaccccttgtcactcaattcagtgtaaggctacttttcttttcttttttttgaaacagtgtctcgctctgccacccaggctggaatgcagtggcatgatctccactcactgtaacctccgtctcccaggttcaagccattctcctgcctcagcttcccgagtagatgggattacaggcgcccgccaccacacccagctaatttttgtattttttagtagagagggggtttcaccatgttggccaggctggtctgaagctcctggcctcaagtgatccaccagcctctgcctcccaaagtgataggattacaggcatgagtcaccgcgcccagcctggaaagctacttattaaggcatctgttaatctgtgggcttgagcactgtgtcaggaagcttgaagataccaaaaaaaaaaaacaaaaaaaaaaaaaacaagactccttgccctcctgttctctgctgtgactgaggatgagacagtctgaacaccccaggaaagagctgcatgcgacatcaccatgccactgagcaccaggcagatcaggaggagctctggacctggaagcagagcctcttcactgctggcctcaggctgatggcatacagaatcatggtgggattgagtaaggacctgcggccctggtcacctgcccagggtgacagtgcactctctgccatgcatacctgagtgtaggtggcttcacatctcctgtagcatcttcttgccatccgtacacacaaagggtatttgtattttttttttttaagacagggtctcactctgtcgcccaggctgaagtgcagtggtgaaatctcagctcactgcaaccttcacctcctggtctcaaggtgatcctcctacctcagcctcctgagtagctgggaccacaggcatgtgccaccatgcccagctaatttttgcattttttgtagagacagttttgccatgttgcccaggctggtctcgaactcctgacc

SEQ ID NO: 39568 - DNA, 1050 bp, Homo sapiens
gacaggagtccccacccagagatgtcagacttgggacagggagcatctcctagcaatgctggacagaggacttcagcattggtggcaagggccgaacatcgaccttcagggtcctgcccagtggaggtcccctccagcagactcttctctgtcatcagggctttgagcccattgtgtctcatcaacaggccaatatcaccagcagataatgttccactggactgtacatttaccggccattcaggcacctggcgaacaggcctttctgttgctttggttctttatgggcttctgtggtttagggaccgtgctcacaggactgtggaaagcacgcaagcagagctggcgctaaacggaacatgaggcccgatgctctttcccgactctcctctttgcagttcatccaccttcacaccgacacggggctcaccacttcccagactataccacatggacataccacatgctgttccaagccttccacgtacataacttctgctaacccctcacagcacccctctgagcctgctactaatattatctccattttatagattaacaaaaccggaggagggagagcttaagtacaattttctaacagaaacgtcctaatttgaccccagagcccatgcttttaaccctatgctatgcacatcaataaagaaacatctacaggggtgactgtgtgtaaagtgattttcagccacaccctttcagtccccacaacccattatccttacccacgctcccctgtgaaaatctgcccagaggataggtccctgaggctctgtgctttttccttcaatatctctctctcagctcttcagactggataatttctttggatctctcttcatgttcactgattcttctgccatatccaatctactgctaacttcatccagataatttttcattttgcttattgtgctttttagttgtaaaattttgatttggttctatcatattttcccatttctttgtatgtctattaatattttattgactacaggacattttagatatgtggtatagagactctggattttg

SEQ ID NO: 39569 - DNA, 1027 bp, Homo sapiens
agaaggttctcgtgggtgtgcaggagctctttgcaggcttaggtggcagagaggtgatcaggggagaggaaaagggccagcagctgatggagtagtgcaaagtagaagaatgcacaagagaggggtggtggggggggaagacagagagtggaggagagcccacctctccccagagaggaaagttgaaagaaacagagggttgaggcgagcccacctcttcccacagggaaggtgaaagagacagagagggttggaaggagaggagcccgcctctgccctcaggctcctactgtgtgaccttgactgtctcctccagctccaccctcgaacatatttttctgtgagtctgtgagagtcagtcagaagtacttgggctgaaccctaaaacagaatttgccaattagtcttcagtagagaaggctttcttcaggtcaacagagacaagcaaatctaatttgccatttccttgttccttagagccagggggtattgtgtggacagaaagcattaggatgagtgagggctccagaggggaagcttgaaaacaagatgccttggtccagcaagggcgctggcttgccagctgagctctctgaagcggcagctccgccctgggctcattcccaggcccggcctgctggaggctgtgcggagttacaggaaatgggagtgccgctgcggctcagctgcctctgtcagtaagaatacgaaacggtgatgttcataaaacattctttgcaaagcacagtccgtccaaaccctggtatagtttccagaagacgaatgtttaatcaatgaggctgctctgcctctgcctctgccctgtcaagactgagcccatgtcctgagcagagctgacagcatgggagagcgcccgcagcctacacaggccacagctgtctgcagcctgctcagtagcccccaccggaagggacctgcaccctgagctgaaattccctgcaagagcagagaaagctactctgttgcccacctgacagcttggagaagcaccgccgtggcacaaatg

SEQ ID NO: 39570 - DNA, 1023 bp, Homo sapiens
gcgggtccgcggcccagccagtcccttctgggcatgggtgcggcgggcagtgcagacagaccaccaggatcgcaccgggggacggcgtcgggtctgggcgcgggttgggaccccgggcgcagcgaggtttgggaagtttgcacctgagcgtgggctgcggcgggctcgccgggaggggccgcgggacggaaacttcccgcagcccggggaggcccccgaggcgactggcgctctgtggcgtccggcgtccccgccgcccccacgtcccctcccgctgccgcctgggggaccctcgcccccgcggggcgggtgggggtcgagacctcggcggagaggacgcggcgcttcccgtcccggcctgcgggggctcgcggccggggagggaccgaggctgggacgccccgcgcccctttgccttcgctgctgttatttttttcttttgttttgctaccttttcattgtgaatggcattgccggcatgaataaaatatcaagagggaaatgactgtgctttcgattacgtgtttgcctgaaaaaaggcccaggcccgaattacgtggtggaactttgactcctgcttcgtcattggctaggagcggtggtttgcttgttttacgttattgtttatgaaattagcagtcactcttggctacctgaattttcaaaagccaccctcccccgctccttttccttgggcgttttcagtagttacttgatgtagaatagccactggggaagtcacggtcacggaagggaggacctgggggaggaggctctatacctgagccattaactgatctgtgatacactgtgaggagtgggtttacttttgcacttagtttttgtaatgtcactttgttagcatcagcacccctttgtctatttgtttttgagatctctgagctacttttgggttgctagaaacgttattttttatttttcgataggtgtttgctttttttgtggagtgttaaggtagaaaatggtaagaaatgtgaaatctctttgaaagatcagcattgc

SEQ ID NO: 39571 - DNA, 1026 bp, Homo sapiens
tgttattgttttaaaagtcagttatcttcttagttttctttcagaaaaattaaatggtgagtttttttgtttgtttgtttgtttgttttgcatggcccatgtatttaccattcctggtgctcttccttcttttgtgtggattcagttttccatctagtatcattttcgttctggtaaaagcatgtttgacatttcctgtagtattgctttgctggtgacacattcttcctcagcttttgtctgaaatgcctttatttcaccatcatttttgaaggatgtttttgctgggtatagaattctaggttggtagtttttgttatttttcagcatttttaaggtgacatttggcttgtacatgttgttcttgagaattctgcagttattctttgttccactgtatgtaataatatatgtttttctcctttctctgattttaaggtttttctctttgttgctgatattctgaaacttgactatgatgtgtctttgtgtggttttctttgtggtttttttcctgtggaatttattcaacttctgggatctgtaggttatagttttcacaaattggaaatttttgacattacttcttcagacactttttctgtcttcccctccatcattctgggatttgaattacatgtatacagtaactgttgttgtttcataggtgactaactgggtaggggaatgtctggttcccttactatccggtgaagtagcagaaccaccttttgtaggaatcagttatcaggccctttactttcccttgaactctaggctagttccagaacctttggtggactggaaagaggaaatagttatgccacaatttttagtacatgcaaatgtacatgtaatgtttaaaaaaaaaaaacaacaaaggtggtgatagcctgcatttactgggccatatgtgccggtccctattctatgggctttatttttattacttcatttctcctttgtgtcacaaggcacaggcagtttgagaccaagactttaaggaattggtccaagttttcaaga

SEQ ID NO: 39572 - DNA, 1022 bp, Homo sapiens
tacactcatcttcagatgtgtgtctctgcttatataactgggtttattatgccctcccagagaagcatctatgtgatctcttatctcaggttctttctcctggagattgggtacattttgtttcataaagtcaaatctttgtagactattggatttctgttatggtctgtgttgtcaggaagcttagaggcaaacataatattcatttgtgtccaatcttctttgcccaagattctgttacagttttttccattatttctgtgtgatacttgtctcattacatttaattgtcctttttacatgtaactttattgtaactgttcttaaaatatgtagcaaaattatgagatgaacatcatttgaaataatgtaacaaaaattgtatcaattaatagtatttcattgcaggcttatatagatggagaaggaacaaaagcagatagggagaatttgtctttgtaaactgagtaaaacttgaacccatcgttacctgctttcttcacctggctgatttcgtgacactgccctgtgcatgcctgtccttggtccacgcctccgcctctgggccccacactgcaacgtgtctcttctgtgtcctctccctcgtgaccgtcactcatacttaatgtgtgtgcagtcttgggagaggtaccctggagatacaaagacaggaaacctggcccttgccctgtgctccttgttttccagagaggtctgcatgccagtgtttcttactgaatgtttccagaagggaacttgttgtgtctgtgctgtagaacatgttggatcccacacacctctccccggcctcactggctgtcctcttgtgtccctcccctctctgcctcacgagtgttggggttcccacgtcattccaccttcagcccatttctttacactatgcggtctcagatttttgtattgccgtctctgtggtgatgactttaaacctgtatctgcagcttcctcctgtggctccagcctcagaggaggccagacaccttcacctagttttttcacaa

SEQ ID NO: 39573 - DNA, 1118 bp, Homo sapiens
gtgtctctttactcatcttagcatcagtaagtttaaatttgactctcctcccacacaagcaagttgaagccccacattcagttggttatccaacttcctgagtgtcgtatttttctttaagtatatctttttaaagatctctttgaataacttatttcgagcctgctactctttccttgactttgtattcttaatctgtgctgcatttcagagtaactagttcataaatgtataacctactatgtaagatagcactttcttttggtttttcttaaaactcctaatttcaggttgcttgggggaccctttggttctagattcttactgagtagtctcaggtgagcagagttgctggtgtcaaggcagtgttgctgcatccaggtccctggcccactgtgattgctttcctcttttggtggtgagaaaacgctttatcagccaaaacgcagttcagcttggctgcagtttagactagaattgtcagtgtgaaaggaatatgatgagttgttctttaaatggactgaaacagtttgatttggaaaattataaagctgtttattaaactacttggagaaaataatagacagcattttttttatgatcttggaatatggaagcccaccattttttttttttttttgagacggagtctcgctcagtcgctcaggctggagtgcagtggcgtgatgtcagctcactgcaacctctgcctcctcctgggttcaaatgattctcctgcgtcaatctcctgagtagctgggactacaggtgcccgccactacgcccaggtaatttttgtatttttggtagagatggggtttcaccatattggccaggctggtctcaaactcctgaccttgtgatccgcccacttcagcctcccaattgcatccggcctatggaagccctttctgagactgacagcacaaagtctagtggccattaaggatataattgatacatttaagtaaacaagtaatattaaattagcaaaaatacttctgacttatgacggatacaggctaattccattcatatacatacactcttgctaatctgtaagaaaaagatgaagaattcagaaaaataggtaaagtgtataaacaggctgtcctttg

SEQ ID NO: 39574 - DNA, 1053 bp, Homo sapiens
gtctaactggaaacaaactattaaagcaaagtctttttttttaaccttaaaactgcagtgatgaaggaccagccagcattgttatacgtacatcctgtcatcagcacagtgtaaaagcttatttcacatggacttctcttaggtctgtctggaagcaaattatttgctgattgtagcgccatcctattctgtactcaaagctacctattttaggactttgagctatctgagtaagtagactctctaagctaatacaaacattatccatttaccttaagtaaatttttagtgttttaattatctttatttaaaaaataaacacctgaaattgacatctgtaggttcagaatatgacttaacaaaggatttgttaaataatttcacctcttttggtaattcccaatcagtaatgttgatatgactggctataaatagattgagtctgctgtgatctaccttcatttttagaagaatgtacaagttttatgttccaccagtggttttctaacgtcagtacagattcatctgtagaattaggtcatgtcctttgagccaaagatctgtaaagaacaaaacaggaaacttgtcaaattcttccgtattttgagctaaagtggttagatttttttatataagagaatattataacctcttcagtcccttttgaggaaaagagttaaatttttgtcagaaattctggtttagatgttctctggtttaagaatcagatattatttgctttctattcctacttcctaacacagttgcacgtggtatagtcgtaagatgggccgtggcatgataggccagatgacatcatcacaggtggtgtggaaggatgtgacaggcacagtgaggagttccttatgtggtgataggcggacccctgaatgcctacagggccccatcccaagataataacatagaaagtagttagcctgcgattgggaactcctcttaactggtggacttaccagatgggatgatctgtactgacctgaagtggacgtttggtgtctgctggaaggaattaggtggcccataagagctgcg

SEQ ID NO: 39575 - DNA, 1032 bp, Homo sapiens
ttaattaaatatgttaccattttcattaattcttaaacctagccctccttcgaggcctgatgtagttacgatggagacagacagacgtcgtggtgccattgctcatctctgccacgccacagttgctgttctcatggtctgtgcagtgagaactcttcctcttgggccatgtcttagctgcttactaggaaaccagtgaactgagtcaggtctaaccatgtcatccaaacaagcgcttgccctgcttactgcatttttttgttgtcagaagtaggggtttatttcttactggtcccagttccccaaggatgtcatatgaggagcaagaatacaacataaaaaaaaaataacaaaaccagaaactactatttttgtggtcagcagttgctaattagcattattactgtctttaaaaacaattagtaaagtaaccttttattttattgttacagaagcagtacatatgcattgtagaaaattcagactagaaaaagaaaagtatcccatttccacaatcactactctttacactaggtgtcttattttctctctgtgaacgtgggtatacacacaaacatacagatataaattgtatataaatggtaatggtttaccaccagttggtaatccttgccagaatcagaaatgttattccttccacgcttagctggtttcatctagaaagcagcactttcctgtatcagctggagctagttaattatgtcgaattccaatttggaattcaggatagatggctaattccacctctccttaattgccatgtttcaaagtaagaagttattttatagctactacaaatagtgaccaatgaagaaagcattcctgtctttttttctgacagtagcatggatgtatggatttacattgatttcataatgtgttttgttttttttttctttgtgcttaaagttatcaccttttggaagcccattcaagctgagtcttctacctcattaatatttgaaacctctcttgctcttaaatagtgctaagtctttcatctctgtcagt

SEQ ID NO: 39576 - DNA, 1027 bp, Homo sapiens
tgtctttccctgaccttgggtagacccctcacgtgatgggctgatcagtgcagatctgcagtgtcctctgcagtctccagagctctctctctgcgtctctgtcttccccagactctgtatcctcccaccacagagaccgccgagctttgtgtgggttttccatgcctgctccgtgtcctggagagtctctccacgcagtgaatgggcacttgtgggcttactctgtctgtctcccgtatctcaggatcacttcttcactgtctggtgtccagtgatttgaacacggtttcctatatttcatcatattttttgttttcattgggagcataaactgggtccctgttactccatctttgttgtctgctttgcgtattaactgattttcaactccaagtttattttcatctctcaggtgagaataataccaccgcttatttcacaggagagttgcgcctgaaaaggatgctgtcgtccactatataaatgtttgtagtactgacttccctacaggacagttgtggaaccgggatttgaagcctggaagctgggctccagaatggtcctcttaacacatctgctgcagtttacccatcaattggcttcttggaagcgcatcagtcagttacctcttctcacaagatgctgtattgtaggccagttagaccctaagagcacacaccgggagacattgtgttcacagaccagctgggctgttgtgtcattcacagctgcgattggtaggactcactgtggctctgtggttagcttcaagttgaccaggtggctttgctgattttgtctggactctctcacatacatgtctaatgcctctgaaagcaaaaggttcagaatattaacattttttttaacttggctatttctgttttttcctctggagtttgtttctctggctgtatgacttgcatgatacttaatccattctttctgtgctgcttatagttatttttagggtttcattaatactgtatcatgatgccaaacaacagactttagaaaatataatgca

SEQ ID NO: 39577 - DNA, 1066 bp, Homo sapiens
agcaaaaataatacaatttaggccaacttagtgtttaaaaacaaaaaggatctatctctgtccatgggatgtttgagtaagtatatacaaggaatttgttagtagcatgaaacaaaaattatagtaggccattgtttcagagttcctgcactaggccccagcagaccaggccaaaccagaatggagttccttgtgctagatgctccatagtcaaactgaaacttgaaggaagcagataggtcccaaaacaaactgattttttctcgagaacaggagatcccagtctacctgagttagcataataaggagtcccctctgctttaacccttacgaaaaagtaacctgaagtaaactgatgttaaccatcaactttttttctgttgttctatttccttattaacccatccttaaaaaccaagtgttctgttaatgcccagtgggagtgctcgttctagattgtaggaaggaggctgcccagattcatgaatctcaagtaaaggccaagtcgatctgtaactgaatttgttgtaattttgtgtcttttgacagtagtagttccttagaatgactagcatctcaggatgttaggcgtatttctcaaattgcatatacttttattgtttgaattttttttattatacatgtattccatttcaaattaaaaagcctacttaaaaatacaacagatcgctataaagcagttagaaataggtcctcatgttgagtgggaaaaagaaaacttgcaaagagatacatacagtatgacatcctttaggtcaattttaaaaatataaagcagttgtttgtgaatgtgtacatgtgcagctgaagtatgaaaacacacataggaatggatacaggttcagaaaagtagtggttacttctggagagaaagaaagagagggctgtagctgcatctaatagtttctttgttgctgttttcaaagttcctaagcaaatacggtaaaatgtgttcacatcagtaaaattagattgatgctaccttttgtgctttcctacatgtttggaaattaaaatattatgtatgtaaaattgttttgaatac

SEQ ID NO: 39578 - DNA, 1034 bp, Homo sapiens
gagttctcttttgactgcacacttttgctgcctcttacccagtttcttccattatatattttcctgctcaattgcatgcataataaagtgaataattctctgtcttgttagtcaactgtgtcttgtttcagagtcaaatttgaagttttcagtcatggtcagtagtgatgtgcatcattgtcagctgttctttaaatgtgaatataaagtatattgaaaattcatataaattagccccattttgaaaacgaaggaagcagagactgagaaaaatgagtggccacgttttcatggctgatgagtgaggttccagctcatgcctgggggtctctgactctggtttttggtgctctcctctgctccacacttgctctctgatttgcttataaccttaaggcaagtttcgtgacctgttggaacctcagtttcttcatctcgaaagcaaggaggttggctttaagaattctttctgctctaaaatatcattccaggctgaaaccacattaaagcagtcctaacttgaacctgtgcctctgaggcatctctgtctctctgtagtgctgtgaacgatttaacaccctgtgtatttgtatttaactaaactgtataaatgagtcacttaaacttaaaacaattataaaaaatgtttttaagtattaacactttttcagcaattaatccattttatatgacagctgtattctagtcatggaacataaatcttatactagaaaaagagatctgaaattaaatatacttgagcactataagaattcaccttgggccaggtgcagtgcctcatgtctgtaatcctagcactttgggaggccgaggcaggcagatcacgaggtcaggaattcgagaccagcctggccaacatggtgaaacctcaatctgtaccaaaaatataaaaaagtagctgggcgtggtggcacgcctgtaatcctagctacttggaaggctcaggcaggagaatcgcttgaacccgggagacggaggttgcagtgagccgagatggcaccactgcactccag

SEQ ID NO: 39579 - DNA, 1119 bp, Homo sapiens
caaactattagtctgtgatagattcgaaatttttaaaaactagtccttcatcacgtgtagcttgagacagctagactagaaagaaacattgtcttgtaaccagcactgtccttgggagagggaagctggtgtctcctctccatgggctgagctactcacgtgggagcagaagggtttcccacaggtgtgttctttaaacataatatctaacaggaacagaaaccattgaaccatttatgtacctttcaaagaggaacaagaatgaccctccaaaggacttctcattctgaaaagaattacttgctgattcacatcaattgtatttattatttttccatgtaacaaaattacttctttctggaacattggcataggttggagattatggcccaatgtgggtttatcctacctctacttttgactgtgtggtagcagatcccaggaaaggctccaaaatgtatggtctaaagagctacatcgaatatcagctaacacctactgtaagtatccacgttatcaaaagcagaatcatgtttggatcactgattgcagcttgcttttttcttcattttctagagttggcattggtaaccttttctctttcccttattttgtagaacactaatcgatctgtaaaccacaggtataagcactttgactggttatatgagcgtctcctggttaagtttgggtcagccattccaatcccttctcttccagacaaacaagtcacaggtgagtgtgtgtaatgctaaacccaggatgacaaatagaaagactccagtcagattatcttcctgtaagtcagtgatggcattttccatcctgtagagcagcaggatgcaggagttggaaacagtaattaaatacagctatgaagagagaaccattgcatgttgtacatctatctggaagttgcctaaacgtctcacaagaacgtttaatgtgcaaatcacaggttttggtatgtgtctggaattccagcagtcattgtcttcattgctgtaccttttctacaaaagaaatgtgtacatttaaaatatgtgaaaaatgacacctgaaaaaatagaaataattcaaatagcctaaaatggaaataaaaatgtatgacccacatga

SEQ ID NO: 39580 - DNA, 1052 bp, Homo sapiens
aactcataactgtttcagcttatcctataaatgtgtatcttacccagggatccctttgtggtttacattggcagcacttatgagagcaagttagctctttttctttattaaaagggaaaggaacccaggcaacataaggagaccccatctctacaaaaaaataataaaataaaaattagccaggcatggtgtcacacacctgtagtctcagctgttctggaggctgaagcagaaggatcgcttgagcccaggaggtcgaggctatagtgtgccatgatcacaccactgcactccaatatgggcaacagagtgagaccccatctcaagaaaaaaagaagaaaaagcatttgtcagctaggtggcacctattaaatctgttatctcctgtcacttatagaagtggtagaattggtacaggtgttgatcctgatactcaaggcagacagtgctttggatgtcggtttctgaatattttaataataaactaataagaagtttctcaccaaaatgtaagatttagggctcccacatggcaatagttctcattgccctggccttaccatgtcttacagttgacacttttagaccagaagcgggctttgaggtctagactgggaactcaaggccagaacagagaagcatcttggcccaggtaacaagtgggtgatggaagagctgagagcaagccacgcccattgcttagggaggaggcagaggtcttggagcccttttagcatggtggctctgtgatgtctcaacagggtgagaagatttgtcctagagatgctggaattttggccatcatgatggcccggctccacaggcatccatgggttccccactgggagctgcttcgtgattctttaacattttctggactgtgattatcaatacataattaaatgttccatattgcaaatagcactttttcaagtattaaaaatactcagtgtatgttttatgttgaatatcattctacttaagataatattttaaggaagcattcaagttcctgttgactggcttttctcccattacaaaggacagtgaag

SEQ ID NO: 39581 - DNA, 1050 bp, Homo sapiens
aaagaaagtgacaaactagttgcaacaagtaaaatcaccctacaagacaaacagaacatggtgaagagagtcagcatcatgtcttacgcgttgcaaggtaagatgaaagggtccttatgaggtgctggtggaagtttttttttccccagcaaagtttcccttgatagagagaaatccagatgtgagcagcagttaagtaagtgagaccttttaagcccctcgtttgcaggatcccggtgctgatgaaaatctgtaatatttatttaatttttcacctgtccaccttatctggctatagatgacagcttgattaaaactgtacattttattatttctgagagacatttaagattccttttgtaatctgtggtatcataatgctctattaaatgccagagcccagcttttagcagtctgtaacctgcgtgccttgggatcatggaatgtgaaggggtttgggtgtgtcattttaggcacaatttttttgtgtcaagaaaaaaaaaagatgaatttctataggtttgagtgtttttgagcagatgagggcagcaagtggatttttcctgttggcggatgggtggatggcacttggatgggcagagaatggagagcgtgttctgttaggaacaaaagccacaaaattgtggtgctagattgtgtcatgggcatgaaagagtaaaacatacttagaggttattgggaaataaattttgattgtgaaggaacttgaaagctctagacttgatgcaggcattaagaagccattaaaagggagtaaaaaaaaatcaatcctcaagggagaaggatttgctggttatggaggggagattggaagatgcagacactgtccaagagcccagccagaagaccatctcactgttgtagtctgagctttgagggcctaaagatgtggtactggggagaagagaatgaagcacatttgcaggcttttccaaggaacagctttcaagactggggcattcatgggagaaagagaaggatgagggaggtgtccagagccaggccactacggcaaaaacgaggaaccct

SEQ ID NO: 39582 - DNA, 1035 bp, Homo sapiens
taatgggagtgatatctcaacgttgttttgttttgctttcttgtcagattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttg

SEQ ID NO: 39583 - DNA, 1058 bp, Homo sapiens
aggcttctcaaggaacatgaggcctggcaaacccagaacgttagactgggtcggctccaagatgcccctgggtttgagctggagaagtgtctgcgggagggtgctggggctcctgcagagcgtgtcttcctgaccctgtgggcttttctggggggggctaggaggctctgccaagttggtggatggaactgtgccttgccctggggggcactgggcaggagccagcctcggagcgtgagtctggtgctgcgccaggaggctagatgccccggccaggtcctgtgggctgcgccgtctgtgcccttggcccgcgaggctggcaggctgccactgcttgtaaagcctcctggttgaaaaggtgactcggagcagcggattcactgggagcctgtcagccacagaggcagcttgtgcttgtgccccaggcccaggccgcaggaggtgggatcaagttccacggctccagtgtgaaggtctgagcttcattctaaggcaggtttttgaggacatggggctctcgggcacctggttgtattcctgcatcctgcattcctgcccactctctcatgccttcttctccttctccttggcgtgccccaagccagccttccatctcagatggagttgtatgtttctagtgagcccacacaccccctgaggacagggcctcacccccgcacgcctgcttcttcatcacagctgctaggaaatgaagatgcatgtccccaggggcctttgaagtaggatgtggtctccctgagcagaactctgactctaaattctctcctggctctggcgttggtgtgggacttgggttgcgggagggggcaggttgttagcggctgctgctcagacccagcggaggaccgggctgctccaggctcccggcaagatgtagcaaaatggccaaatttaaggtgagcacgggctcccgtgcagtttctcacccctgctgctggctgcctgtctgtgaatgctaaggcgaggggtggttctacattgacttcttactgactggtgggagtaacccggaagaggcaaatgacttccttcccttt

SEQ ID NO: 39584 - DNA, 1037 bp, Homo sapiens
ttcccaccaactgtgtacaagggtttccttttctccacatccttgccagcatttgttattgcctgacttttggatgtaagccattgtaattggggtaagatgatctctcagtgtagttttgatttgcctttttctgacgatcagtgatgttgggcaccttttcatatgcctgtttaccatttgtatttcttcttttgagaaatgtacattcaaatcttttgctcattttttggatcggattattagatttttttcctgtagaattgtttgagctccttatatattctggttattagtcccttgtcagatgagtagtttgcaaatatttcctcccattctgtgggctgtctcttcactttgttgattgtttcctttgctgtgcaaaagctttttaacttaatatgatctcttttgttcatttttgctttggttgcctgtgcttgtggggtattgctcaatacatttttgcccaggtcaatgtcctggaggtctttcccaatgttttactgtagtagcttcatagtttgagggccatggcattcttaaaaacataactttcattcttgcatagctttttttttttttttttttttttttaagtaacctggactgtcatttggctagggaggcgggagtttgtgtgtctggaaatgtgtgggtttttttttttttttttttttttttttttttttttgggacggagtctcgctctgtctcccaggctagagggcagtgcagctacctcggctcactgcaagctccgcctccctggttcacaccattctcctgcctcagcctcccgagtagctgggactacaggcgcccgccaccacccctggctaattttttgtattttttagtagagacggggtttcaccatgttagtcaggatggtctcgatctcctgacctcttgatccacctgcctcggacttcaaaagtgctgggattacattacaggtgtgagccaccacacccagccagtgtgtggtcttttttatctgtctgtttaaactgtctgttttatatgttgcatga

SEQ ID NO: 39585 - DNA, 1051 bp, Homo sapiens
cttcatctttcttggaccacatgtcctggtgttcagaggctcctgagagcctggggctcagtaggccgtctcatagcccctctaacccaggtgagaaaacaggtcccagtgggtccctaacccatgctcattttctcaccaaacaacaacaaataaatcagaaagtcctgaaaaatgaattctggcctgttttctggattctggattgaaatatggagtaggagctgacttttagtaagttgatcaactctccccgccgaccccctagccttctggaactgtcttcagtaaacacaacccccgccacccctgacctacccgcaccgcactgtggtcggcctcttctttgaacacttcccttacagcacgcactccccccaagctgggccttctcttgagaccactctgctgtccttgggagtgatggtggaggcggggtagacaccctgtccctgtctcgtggtgctcctttgggccacagctcctcttccctccgtaggaggaaccatctggaatccatcttcctccttgaccacacctctccattcattaaggagcagagttccctgctcactgggtctctctacccctcctctgtccctgtctgggtgaggtcacagagagcctcacccgcctgctctgttggcctctcacttgccgtcctctctgccccgttccctctcctgcacacctgtccgcggtatccccagctcttagtgactctagccctctcccgccctcctctgcaccctgcatgcacttgtgttgctgaatgtggccggagaaaaacacagccatcttgactgttctgtgagacttcatagatttccagggctgtgtggaatcaaaaaatcttcctgcatttccccagccatctggcctccaggatgactatttcacatctcctcaagcctttcacatctcatccccctcacacctgatgattttgcttcctatttcactgggaaaatgaaggtaactgagaactttcttttttttttttttttttttttgagatggagcctggctcttgttccccaggctggagtgc

SEQ ID NO: 39586 - DNA, 1072 bp, Homo sapiens
ttctccactttcaccttgtcactcatcctgcaattcccagtcccagtgactattttttttttttttttttgagacagtcttgctctgtcgcccaggctggagtgcagtggcgcgatctcggctcactgcaagctccgcctcccaggttcacgccattctcctgcctcagcctccctagtagctgggactacaggtgcccgcaacgacgcccggctaattttttgtatttttaatagagatggggtttcaccatgttagccaggatggtctcaatctcctgacctcgtgatccacccaccttggccttccaaagtgctgggattagaggcgtgagccaccacgcccggcccccagtgatctttgaccccactgggatggcgacccttagaacccatggccttctcatagcccctcgtctgtctcacaccttccctctttgccatgtcagtgaccagccctgccttgcactcaccctccccacccgcccttctcttgctgggtcctccccacctggtgaaacctcagccctggttacatcctgcactccacgcctgcaccagccgctgtgcagtagaagtttctggagatgccccactaccacacgggcagagcgtaccatcaggtcacaacccctgagccaaggtgggcctttcacttgcgtttctgtgctctgtccactcccccaccctcccagatggcaactccaccctcccctttcctcagctctgctgtgcctcctccccatcctcactttcagctgatggcctcgtcctctcattccaccccaaaatttgaagccactggaagagaattcccgctggctccctgcaccaccactacccgcccaccatgtctgtcccccttcccacctgctccccgcagtgcactgtctacgtttcaggccagtgctacctgtgtgcagatgcccatggcctgctccagggcatggctttcggagctccctgctcctgccacatccgtcctgacctctctcttggctgcattggtcctgacctctctctcagctgcatcaatcctcgcctctctcctggctcatttctgccagcacaaa

SEQ ID NO: 39587 - DNA, 1687 bp, Homo sapiens
ccacagaagggaatgaggcttcttgtggaccatgcgagaccagccctgctccgaggctttgggtgcccccaacccctgcccacctgtgagagtcaccccccggagtgggttggagtttctctgagtgtggtgtgtatgagtttgactttggcgatgtcaggataatttggtctgttttcaacacattctggaaagcaccctgagcatctgaaggatggaaggattgggctttaaatcaagttttttcagtccccattggttatcttaaggggcgtttgactttaacttgattttctttttcccctgtaagtccctgacccagaactgtgatctattttcttttgtgttttcagctgttgagcatgttgggcagcacggagtgtagctacaactgtgtgaccccacctgtgtgactgactccacctgtgtgactccagtcgtgtgaccaactacaactgtgtaactgactccaattgtgtgactaactccacctgtgtgactctgcgtgactccaactgtgactccatctgtatgactccaattgtgtgacccccacctgtgtgactctgactgtgtgacccccacctgcgtgactctgactgtgtgacccccacctgcgtgactctgactgtgtgacccccacctgcgtgactccgactgtgtgacccccacctgtgtgactccaactgtggactgactctaactatgtgactgactccaactgtgtgactaactccacctgtatgactccaactatatgattgacttcaaccgtgtgaccccacctgtgtgactccaattgtatgactgactctaactgtgtgactccaactgtgactccatctgtatgactgacctcaactgtgtgaccccacctgtgtgactccaactgtgtactgactctgtgtgactgactccacctgtatgactccaactatatgactgacttcaaccgtgtgaccccacctgtgtgactccagttgtgtgactgatttcactgcgtggctaactccactgttgcctgactccagctgcgtgacttcagctgtgtgactccatgtatgtgaccctagctgtgtgactccaactttcagttgccacgaagacaaccagctgagtcaggagtgggcctccctttcaatgtttttagctaagcatctctgcgcaaagaaagaggcttccccacaggctcttaatttgggacaagttttcccttagtttgggaaaaatttcaatctacctaaattagccttttacattagaaatcgagaaatatgcacaaaaattcataaaagcctttttccaggttccaaggtttttgtagaaagcccaaagttcccctttccttcctgaaatgccagcaggaaggggttggagctcccgtgattagccagggagtcaggcttcctgaagtttacacaatacaaagcatattaagtgagaatgtagcagaaaaaagaacttatcccaatgattatagcaatttaaattctcttgaacccaagctctcaaggcctacctgttttatagcctcaagggactctactcctatcccagactataatgaattgtgtctcctggagttgtgcagtacgcaacctgtgaagctgtacacgacagccctataaattctctagcagacagccctcctagattctagttcccacttcacagctgaactgcattt

SEQ ID NO: 39588 - DNA, 1056 bp, Homo sapiens
tttataataattatgcggaggctctgttaccccattttacaggtagagagactgaggcacgaatagtcgagggaattttgccaaactccacacacttactaagtggcagagccaggatttgaacccaggctttctgggtccaggtcccaagctggtaatcacagtgctaaaccagtcccatcaatggggaagctgagtcaccctgcccaaagggacttgtagcaatgcactaagactagtcccggagcccaggcagaggcggctggatttctgtatgtttaagatctcctggtgctttttcactccacagcaggacagagacaagagtggacaaccctgtaaatacataaattatctattgccctttctggacataatgctgtttctgtcagattcgcactgatgcctagagatgccaggtagaagcaaaagtgaggaaagtcctgccatgggagtcgttccaatgaacctcatctaatgtaatgttttagaatccagtgtctgccttttgaagctatatcagttttcccagctctgagacgggactcgtgaggtttatttctgacctgtttgtgcctctctccctttgccagaggcagccacaggttttcatctggccttggtgctttggattccccagaagtgaattcctgatttctgccggaagaaggggaccctccccacatccctgtgtccatcccaacgctccccacccccacatcctctttggttctctggtattgtggatatttgggggcagtaatgtgcccagacttcaaaatgcacgtgaatcaaggctgggcatggtagctcacgcctgcaatcccagcactttgggaggccaaggcaggcggatcacctgaggtcagcagtttgagaccagcctggccaacatggtgaaaccctgtctctactaaagatacaaagaaaattagccaggtgtggtggcgcacacctgtaatcccagctacatgggaggctgaggcagaagaatcgtttgaacccaggaggctgagattgcagtgagccgagatcgcaccattgcactccagcctg

SEQ ID NO: 39589 - DNA, 1118 bp, Homo sapiens
gctggcccatccatcggagaccccggacagcctggctacccaggaaggggagctgtcacttcccagcgctgagtccagggctgtccacgtgggccttcagcaaagcctgactgagcctgccaggtcccaggctctgctcccaggtgggtgggcatggggggcagtggtggtgtgatgggggcgcagcaggagtggggcaggtgaagctggtcctgccaggtgctgccgcccttccaggtggtacttccgataggtggtgttcggctggtgacccctgcctggaggtcgaggggaagcacagcagagccagggcagggagaagcgtgtgctgcgcgcagcccaggaaggaggggcatggagcagaaagaaacacaggtgaactggaagagcagagagggttcatgcttcctgcacacatgggaccagggcatgggcctggtggggggtcagcattcctccaagccaaaaaacacaggtgtgacagccctttttctaaaacattacagaggcagcaggagcagagatggctgcagggaagtgactgttccccaaaagcaagaaactcctgttgcctcacttgtataagccaagggaacccctcgctttctgtctctggagtcactgaatatttttgtttatgtcactttatagcagtactgatgcttaggttgatctaagttcgtttttaaaacacaaaacacgtctttaagtggaatgcacagttagtatgctcctgcgaagcggcagccccgctgccctccctggctctgcggccacctgctgaggatggttcttctaggatgagtcaggagagtggagcaaggctcagcctgcaggtccttgctgagctcagggaagcagccccgtgaggatcgggctgcgtggtctgcaggggaacctgcctgggaccctgtgagatttacctgtttcaggtgccagtgatctgctgggattctggagaggtccctcaggggagcctggcacttcctacccccttgagtttgcaaagtcacaactgagggcctgggttgggacggtgtcatgagctctccataagctttgcttatggtacaggagcagactgtctggcgcttctggagacctttaacgtgctcctg

SEQ ID NO: 39590 - DNA, 1065 bp, Homo sapiens
acctctgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttata

SEQ ID NO: 39591 - DNA, 1049 bp, Homo sapiens
caccgcacccggcctatcatggaaattttaaaacattgctaacagtggagactggtgtaataaagcactgtatcttgcccagctttggcaattttaaaacgttaccagttttgtttgagcaatacctctcacgtccctccacttggattattttaaagcaaatcaagctgtcatataattttgtctgtaaatattttagtacatgtctccaaaagaaaaagaccccttaaaataattacaatactattatcttaccttaaaaattttttcttagtatcatcagatatccaatcaatactccttgactgcagtatatatttgtgtgtatgtatgtgtgtgtatgggcgtgtacgtgtgtgtgtgtgtgtttatatcatatcatatatatatatatgattgtttgaattaagatgcaaataaggtccatacattgcagttggatggtttaaagtctcttttaacctataggttctctatctttttttttctttgcaactctttattgaagaaactgaattttattctttgcatccttgtaatgtaaaatatgttattttatttcttgtgtttcctgtacattggtagttcattgtagaggctaaatcaaaagaatccaattttatttttttgtgagggcaggattattttcatcaggaagtcttctttctttctttttgtgatactagcaaccattcttgaatgttaacttggtctatgagttcaggagggattacaatatggttacatcctgtcatttagttattagctgaaataggtgtgtgtgtgtgtgtgtgtgtgtgtgtgtgtgtgtgtgtagaaattctcctttgtcaattatttggttaccttgaggtatagagtgtataggaagggtttgaaaagtgtctgattatttcccttgatttaccagttttcaaagttatgatttggtcccctagcatcctccagtggtgatggttgagggttttaaattttttcgcataacattatgaacgcctattttagcatacgtggtgtgtttcagtccattgcagttactgtcctttcga

SEQ ID NO: 39592 - DNA, 1036 bp, Homo sapiens
agtttgtaatgggcatattagatcccctgggataaagtgcttgtagagtctaatctattaatgtctggttaagtctaagaatttgatcctttaagtcaatcatggtttatgaaacattttttaagatttttatgaaagaaagctatgaagtcttacagcttttatttgtatgtttcagctattgatccagctagttactagttggaacactacattctaaagactcattcgtatctgctttccaaaactgttgctcagcaattttgaattctacttaaatgttatagagtgttgtcactaggttcagaattttttcatcctactggatgtttcttttattagtttcttgtcaaggacaaaaggaagattagtttaaacttcttgagtcagttatacctctgatttgtgtgtgtgaatgtttttcagtcccagttagggaagtcaagagttttgtgtaggaagctcttacaggaccatgttgttctcccctgcaactgtgcctttccactatctttggctattaagagtgtgtttacctccatggggaaatgcacatcattgttacgaacagctatggcaaaatggtagtgtcagagatcctcagacaacaaaccgagctgttagtgccggggcagttttaatattcatgaaaagttgatcagcagtgatgttaccataggctgagaaaatatacaggattatctttacacgtaatcagtttcttaagcttcaaatgaccctcttagccacaaaaccggaggcacaaattcagctccagtggttagaatatcaagacctatatcataagaagttaggcttctgctgtgcgcacaaaacccatcagccaaagctgacattttcggcagagttactgtttagagttgttaaataatcagagaatttaactgttaactgtatgttaacagattagagaatgccattaaaatgtgatgcctggccgtgcatggtggctcatgcctgtaatcccagcattttgggaggctgagttgggtggatcatttgaatgcaggagttg

SEQ ID NO: 39593 - DNA, 1032 bp, Homo sapiens
gagttcaagcgattattctgtctcagcctcccgagcagctgggactacaggcgcctgccaccacacccagctaatttttgtagttttagtagagactggatttcaccatgttggccaggatgatctcgatctcttgacctcgtgatctgcctgccttggcctcccaaagtgctgggattacaggcatgagccactatacctggcgccaaaatgcttttctttagagagagatatagaagcaataatgtttatgaggtgctttggaatcagctttctataaatttattgtaaaatagagaagtctcaaggttgaccatatggttcagaaatggtaggagtattgttcttaattctgagagccttgggataccacattttttcttccctttcttagctttgttttctgtgtttcgcaaatacctcttgtctccttggctgactgatggtcatataaatggaatctccttggctgtccttcacccatgtttagttggtgaagttctttctcccccacatgactgagaaaaatggcatgtgattttactaatagggaattgatctgttactctgatgtatacaagacagccaaaacttgatgtatacaaggaagcactatcaggtgagtgataccagtgatctatggaggtcagtttaagccaatgacttcccccttttaattttcatcacttattcattatttattaccaaacctttcactagattgttaatgactagcagaattggtttcgctcctttggtgttgagtggtagagtggaccccagatgagatgtcccaagaaggaggcagacaggggaggctgggcgcattcacaaattagatcacaaaagagccctgagaagttaagatttggttaattcctttctcttcattttgtgtccgcctggccttaagtactgtctgttaccacataatattattttgagaagcagattattaatattttatagcatgggtttatctaatgttattgaaagattgttaatcagctgggatgcataccttcagctact

SEQ ID NO: 39594 - DNA, 1053 bp, Homo sapiens
cctcacccccaccctgtggcctccctctgcatggatcctgtcatgtttatgaatccccctgcaggtgttgctggagggggctttctcttggcagttgtagacactgttggggaccagagcatgtaccctaaattgataaccggcagaccctgtcgagtgcatatctaatgttctttcttcccttctttctaagtagaattggaattttgtttagagagcctcttgtctcctgtgtgactctggggaaggtgatcttatccctagcactggggtaaatcctgactggtttcagctagtcacatgggtcccattctccgtaggtgatgactgtaggggtgagccagagacctagttctggtcagtgagattagtgggaggtctgtccagaggttctggaaaactcagccttacagcaacaactctaagaatggtggccttttcttcctctgaaagttgtcatgtctgggtgtggtgcctggaactgttacaattgttttgctactggtctgagcatgaagccaacatcaggttaaggactgagccaagccaacagcagagagaactctgcagagccccagtgcaccatgcttggcacccactaaccttggacttgttctgtgaaataaattttcttattgtttacaccaatttaagttagggttatctgttatttgcaaccgaagatgtgctaactgatgcaatagctgtcattctttccctcattgcatgaagaagtacagggtataaaggcagaattgatctagtcagaaggtcagaggtggcttccctggggaaatgcagaggccttggtgggagagatcccttttcttgctgggcctcgtgtgccacatttaaggattttggtctttatcgcaagagcagagcctgttataggtttaagtactgggctatggcatgaatgcagtgaactcttactatttaaagtaactctctagttacttaagctactcctcctgaagaacaccttggcttaacattccagagttgagtttgatttgctgagcaggcaaggagcagtcagtggttaaggct

SEQ ID NO: 39595 - DNA, 1031 bp, Homo sapiens
ccacgggagcaggttccaaggggtggctgatctctttttggctctaggactctgctgggttcagtcaaccacctgtaggtttctatcttgcctctttcaaaacaatcagcggaaaggactgtagaaccctctattagtcaggggattcttggttactggtgaaagagacctaactcaactaacacaaaaaaagggaattcgttggaaggattctgggctgtctacggaatccaggtcaggagccagggattgggctaggatgctgcatggatggggccaggaggacactctttctttctctcttttgtcttctgcctcttttccagctgtccactccctcagtgtttctgagttattccttttctgtcatggaccagcagtctctgctgtttggtccaggtggcacaacatggctgccagccccatgtttttcatattatgacccaggtgtccagagagagactattttctttgtgttccagaatttccagggaagagctgatgagttggtgtagaaaatagtgacttccatggtaatggtgggaggatggaagccattaaggaagtcgttgaggttcagcagaaggtccgtccttgctgcagtttataaaaatgttagagacaccactccaacagttaacaaataggaaaggacctgggctgtgaaagctctgaagccttgcattaaaatttaaagcaaaacaaaacaatcaaataaaaaactaaattaaaacaaaatgccgccatcaccagtgctaacaaaaaatccttcaagattgaaaatttgaacctgctgaacaaattcggaagctgctttttgtaaaatcaaatttcttttttagtaaaataaattatagcttattttcacgtcagcattatttgagcttagagaaattgtggccaaagtttaaccaagcagggtagcttgacatgggatatatatacctgaaaaaacaggataaatataaatattctaaatttgccaggtatagtggctcatgcctgtaatcccagcactttgggaggctgag

SEQ ID NO: 39596 - DNA, 1049 bp, Homo sapiens
agggagaccctgtctcaacaacaacaacaacagcaacaacaggctgggcgcggtggctcatgcctgtaatcacagcactttgggaggcctaggcgggcggatcacctgaggtcaggagttagagaccagcctggccaacatggtgaaatctcgtctctactaaaaatacaaaaattacctgggcgtggtggcaggtgcctgtattcccagctactggggaggctgagacaggagaattgtttgaatccaggaggcagagcttgcagtgagccaagattgcaccactgcactccagcctgggggatagagtgagactctgtctcaaaaacaaaaaaacaaaacaaaaagccagaataaagaaaaaacttaacaaaattttactcatgaagtaaaagacaaaaacttcagtgaaatttatgcagcctgtggggttgggcaggcgcagaggaagtgcggccttaacagaatcacgttcaggaaaagcgcaggagcccattcagaggtttttacgggctctgaggtggtgagggcagtggcgtgtgtcgttgcttaaatgaacttcaatttgaagaaagattgctctgatatttctgggaattagtgccatttgagaatttcggaatttatacgtatgttggtttgtcatcttcataccaaaatctactttatttgcacatcagtcataaaggtgttttacccatttggcttatttgtgtgtttaaaattaaaactcaagccattttccctctccagaaaatgtgacttgtgtagtatgacatcttactggagttgggggaaggcttggtgggcacctgaataaacatcgatctggggaagatgcacctggagggctgcctggacaagtccctgacgctactagattgcctactttcaaaggactaggaaacattttttcagctttaaaagatttaaaagccggtgatatttcagaatagtgctgaaagagccctgctgttgaatgaacattgggagcaccgcatgtgggttgtggcaaaccctttatcccatgaggccctctcttctccatg

SEQ ID NO: 39597 - DNA, 2043 bp, Homo sapiens
agcattctcttgaattctttcctcataggcacttttttccaaaaagttctaagcaacattttaaacactgttggaagcttttaaaatttaacatagcataagcatttttcatgttttaaagtggttttcataattatacttctttttgaaaaattttttattgtgataaaatttactttttttatggagacagggtctcactcttatccaggccggagggcggtgatgcagtcacgactcactgcagccttgacgtcccgggttccagcgaatctcatgcctcagccttcccagtagctgggactacaggcacgtgccaccacgcccagctaatttttgtattttttgtagagacatggtttcaccttgttcccaggctggtttcgaactcctgggctctagcaatctgcccatcttggcctcccaaaatgctgggattataggtgtgagccactgtgcccagctaaaatgtaccattttaaccattttaaagtatatagttggctctacatatccgcaggttctgcatgtgaggactgaaaacgttcaaagaaaaaaaatacaacaaaaatatagtagaacaatagcatttacgttgtattaggtaatataaataatctagagatgatgtatatgagggatgcatatgggttatgtgcaaataatatgccattttatatgagagacttgaacatttaaggatttttttatctacatgggtcctagaaccaacccccatcgatattgagggacaacggtataattcagtggcattaagtacgttcctgttggtgtacagccatcatcgctatccatctccagaacttttgttcatcttcccaaactgaaactctgtgcccatcaaacacttcccttttaccccttccccagcctctgataaccaccattctatttctgtgtctataaatttgactactctagatacctcatattagtggaatcataaaatatttgtctttttatatctggcttatttcacttagcatgatgttctgaaggttcatccatgttgtagcatgtgtcagaatgtccttccctttcaaggctgaatgatatttcattgtatgtcaatacacattttgttaacccattcatctgggtttttttctttctataatccaggacagtgctgaaacccattcatctgttgatggacaccgggtaattaaactttttgaagacataataggccatcaagtagataaatcatactagaagatgcaatttttgccctcaaagaatactgaagttgatatgccaacatgtcaaacacagaagatgaaagcaactaagtgatgtgagaagtcagtgtgggttcatacagagtaaccaaaggaggttgtccttgcctttcatctagttgttagactgagggagggtaggacctgggaggattccagaagaaggtcttcagtttgatttctgaccctcccacttctgttgctctgttaggcctctgtgtacagttagcagccatctcatagtaaatcttccaaataattaggagggtcactgctttgtcaggacaatttataccctttctcaattagcaaattgtgtggcaatccaaagttaactggagtgttgctccccttttctattttgctcccgtgtggatgtggtgcaagaaggcctgccaaggtcagcctcccgttttcctccgtgggttggtatagacatgtttgttggccagacattgcctaaagccctgtagtcaagggtggtgtgcttgcatttgcctggctgaattaaggctcttggtgcttttctatcagtcgaatcccttctcctccatgtcttctagaaattgagaagggtttatcagtggtacctcactctgttttccacaggtttttaaaatttttttttgttcttttacatttgtttgatcttttcttttcttttcttttctttttcttttttctttttttttttttttttgagacgtacttttgctcttgttgcccaggctggattgcagtggtgcgatcctggctcaccacaacctctgcctcctgggtt

SEQ ID NO: 39598 - DNA, 1026 bp, Homo sapiens
tctttcttcctcccttcctgccccaatggctatgatcttattactagccaagaattgttgttcagtacaagataatggtattaatagctcgtatttgttttttatgcttaatgtgagctgaatgagggagaggctggagctgaagaagaggatctggcagtgagtgctgtggaacctcagcatcccaggccagccaaggcagaggaacaagcagaggagacagaaagaatcacaagggaggaggaaactatcaggaagttcctttagagagcttacaattaactcactgaaatccctccacagctgcctgagataggttttgtcatacctccattttacagttggggaaactgagaccttgagtagttaagtagcatagctctaatgcaggaagtagtcattgacagacccaagatttgaagtgaggctgtcagcctcctgagttccccttcttaatcactactgctttccaagtttctagagtgtttcagtcaaaaacaaatgtgacagttaggtttgtgtaactttactatagtagatgtgtagttctcaatacatactttatcttagctagaaggctaaggaaacgatcaatatgtgttttaaatattgaaaaagagcttatggactttgattattgggtttgtagatgcatagagatctcatgacctggctttgggaatctggtccgatcttgtcattttgcctttggcgaaagtgaaggcccttgttgagggacctacccgacacttcactggagcttgagcctgggtctcttgagtccaaggacagagtttttcccattgtactatgatgtccttggaatgtgtgttcttcacacagacagtgttgccagtgaaagttagggaaagtcaaaatgggtaagatgctaaaagaacagataagcttcaggagccacatccaatgtcttcattgaactggacctttctgcaggccctctctttgctcaggtgttgagactcccctctctgttggtttcctcctccctgttcattcttccttctc

SEQ ID NO: 39599 - DNA, 1024 bp, Homo sapiens
caagtgctgggattacaggcctgagccaccatgcccggctaacaggatttttttgacttgagaataagcaggcagctatgtgtagttgctggaattcgttttgttataaggacacgactactgtagcaatggtctcacctgatttcttggattgggtacatcttctccgatatgctttctctgaccctgccccttgtccctgttgtacacttaacagacttctctggttgcgctgatcatgctttattatagttatctgcttgcctcgtttggtaaaacttattggaagatcaatgtaccctgtcattcttaacttcctcacctctcattgtttagaatatcaattatttatttattttttaaaaaaattttctttaactttttggcccacttcagtgtgctttctttccttattctactgaaatgaactcctcaatgaccacacattgctaaactcataggtttttggtgttttgtttttgtttttaaactgcacttgatgtctcagtagcatcagtagaattgaaatgttgtccaggacaccaggctctcctggttttcctgttactgttctggcctctgctttccgcctttctttgctggctctgccttttttttgcctcatctttaaatgttaacgggcaccaggcatgcatatttttctgtatttcctctctatgttggctttaaatctccctacatgctatgactccagatacctctctctgtctgccatctccttctagttccagacttcattctccaacttgatatatgagatacaaaagtggacaccagtcaggcctcgcagactatcggtcacccagacagaactcatttccccccgccccttgaacctcagatcagttccatgcactgtttccccattttagtagatggcccaagaccagccagtcagttcagctctcaactcaggaatctccctgcgcttcccttgtccccaagtcttgttattagcaagacctcccactgtatctgacttccagataatatctgaaacgtg

SEQ ID NO: 39600 - DNA, 1139 bp, Homo sapiens
ggtatataagtgatgaaatagtaaagtactctataccctttgtacttaaagtaatatacttaagtatattactttccagtccttacaataccacttagtacctggaaattcagttactgttctgactcatgaggttagaaacagtgtttgttgatttttgttcctcagtttagatttgaaaacacatgcattaatttttagcaggtatttactgcatctctgttgtgtgccaggtgctgcgtgtatttgccactgtcggggggcaagagaagtcccagcttatacctcatggaatctacagtctagcatgagggtgaaacgtggacttcgccttcctctatttgcatttccattaggaagagaaagcaagctttcaattgttcaaagaatgaagaatgaggcttcctagagattgtgtggtgaagatgatctttgagcagggccttgagaaatacttaggatttagcacgtttagcgcgtgcttttctcagtggtgcaagaagattaagccacattctggctttagagaggcatttctgagagagatgaaggacacttcgttccccagccccaacctaagcatgtgactgtactcaccttgtcagatgctgttggaacctggctgacaaggacaaggacctatgcattttttcctgccctggaacaaaattgcccttgttggacaggcagtgatgttctgtgcgccttttgactatactgtgaaatgtttgtggtttgtaatggggattttatccatctgagcatgctacactttttattagtttccatggcagatggttaaactagggtgctgccttaataatttgacttatgcaggtgctcagatatgactgtttctgtgcttaatgtattcagcatgtggttgtagtcgtttgaaaagttacataatcatgtgttcatgacctgagttagagataatttattagtgactcagcattaatgactcattttatgcaactcttctggtaaagcaacgtttctgttcatgtgagcatattgtagcatgctaggtgaccacatctaccttgtttccttcctaggtagtacctttaggtattccattacaggagggctgccccactcccggaggtgcattgaatacagagagggcatagttg

SEQ ID NO: 39601 - DNA, 1648 bp, Homo sapiens
ccacgcctggctaattttttgtatttttagtagagacgggatttcaccgtgttagccaggatggtctcaatctcctgacctcgtgatccgcccgcctcggcctcccaaagtactggggttcaggcgtgagccaccgcgcccagccgaggaacagctcttcttttaaatgtcttaggaattcttattttgaataaggaacctttctagcaaagaggcagaaatgaaacttttgttttatatttaggtcagaatttcatttcacctaaactggcttatctatttttataccaaagctcagtagtgtgagttaattttttatcactgtaatagttatacatattggtaaatgctaagaatgaaaaatagcaatgttctaactcctgtctccccccctccccccacctgttgtcctggccacttaacaaaggctcatactattatttttttgatgaatcaattttaggattttgtctattgacttcattcccatctcgttaggctgagatttagcactcttctctttctttcatagtcactcaacccagctttgccctatcatctaatcattccagtattactgtatcacaaatattggttattattcagtgtttacactgtttaaactatgtcactgttattcccagatgagccaagtagggtactatgattgtattccttcattatttaactcttttctcctcatgataaaaatttcccccccagtggtttagtttatctattgcaaaaccttcctacatcttcagcataatttcatacattcaaaccaattagatggtttatcagttcatttttttgttttgttttgtttttgtttttttcctgaacacctccatctgagagtcctttgtcatccttctgctctctggattggttgctcagtgggcctgctgcccaggtgatttcctgaacttccttttaatcatcatcttgggaattctctttgccccctatttattccacgtgtcgtttatggaatcttgtatttttttggttaaactcctttttgttggaacataatctccagtatcttcctaagaaagtatttgtaagtcataaagtataagacttttaatctctgtaaatgtcttaattgctttcacacttgatagtttggctgggtacagatttctaggtagttttcttcagaattttgtcttcacatttccagagtttttagaagcatagtagttaagagctcaggccccggagctagactcagtttacgttctagctccatcacttagtaatgccatgactttaaatatattatctaatttatctttatagttgtcccttgactatcatggtttgaactttgtggatccacttatatgtggaattttttcaatcaaatacggatcaaaaatacagtatttctgggatgcaaaatccatgtttatatggagaggattatacacaaaatcaacgtttgtatgcttaagttcttgtgggctgactgcgggatttgagtatgtgagaatttgggtatacgtgcacagtcctgcaaccatcccccttgtgtaccagactgtactatgattttctcatttgtgaaatggatttataaataatactttcctcatatgggatttgttgtaaggattcagtggttactatagccatttag

SEQ ID NO: 39602 - DNA, 1722 bp, Homo sapiens
gcttttgagataggtcttgattgacaaatattctctctggctctgggaaatgttgcctcactttgttttcagaactcccttcctgtgagtctctgatgacagctcttctcatgcaggtataagccctcctgagcgggcaggcattccctgtgcttgcatgtaagactgagtcttacacttgggaaaaagtcttgcacttgggaaaaagaaaaaaacacattggtgtgccagatatcaggggaacctgcccccagtaattcaacgtgagtccttttctattttccctaagtgtcggccagtctgagaaataaaggaaaagagtacaaaagagagaaattttaaagctggtgtcctgggggagacatcacatgtcggcaggttctgtgatgcccccgagccgtaaaaccagcaagtttttattagcagttttcaaaggggagggtgttacgaatagggtgtgggtcacagagatcacatgcttcaagggcgacaaaagatcacaaggcagaaggtcagggcgggatcacaaggtcagggcgaaactagaaccactaaagaacttctgtgtcccgctgtgcacacattgtcagcgttcaagagcagagaaccggtctgactagaattcgccaggctggaatttcctaatcctagcaagcctgggggtgctgcaggagactaggatgtgcttcatccctatctacatctgcataaggcagacactcctagggtggccattttagaggccccaccctgggaatgcattcttttcccagggctgttaattattaatattccttactggggaaagaattcagcaatatttctcttacccatttttggtaataagagaaatatggctctgtcctgtgcggcccacaggcagccaaactttaaggttatctcccttgttccctgaaaatcactgttatcctgttcttaaggtgcccagatttcatattgttcaaacacacatgctctacaaacaatttgtgcagttaacacaatcatcacagggccctgaagctacatacatcctcagcttacaaagatgacaggattaagagattaaagacaggcataggaaatcacaagaatattgattggagaagtgataaatgtccatgaaatcttcacaatttatattcttctgccatggcttcagctggtccctctgttcggggtccctgagttcccgcaacaggccgtggagctcaggataccttaattgtattggccaggtgagcttagttgatgtggatctgctcgtgcaaggtgagttgaccttactgtaggcagtaggacatgttcagagatctgtaatttcatttggtggaatgtacagtaaccttgataatttggtgactagagaaaaatgggttttttggggggaaagaagtgtatcagaattgttttataactaattagccattaaaatgaacctgaaatagtagtatagacatgcaaattgtaggaccactcctaagtgttgagtataatcatatttattgaattaagtcctcattaatttagctttattttcttatgtttgttcctgagtgtgcctaagtgagtctttccctcctgccctgacgctgcttgggccctcctctgtgtgcacacagggtgagcgtgtgtgggtgtgcatatctcgtcagctgatattatccctctggaggaaaggggtggttccacagagttgaccgtactgctcccaaaccaggc

SEQ ID NO: 39603 - DNA, 1034 bp, Homo sapiens
aacataatgtcctccagttccatccatgttgttgtaaatgacaggagttcacttttttttatggctgaataatattcccatgtgtgtatatgccacacttttctttatccatttaactcttgatggacacaggttaattccatatcttggttatttgactggtgctacagtaaacatgggagtacagataactctttgacaaactgatttcctttgttttggatatttacctagcaatagggttgctggattgtatggtagttctatttttagttttatgaagattctccatactaaacgttccgtccaacaatatatgagggttcccttttctccacattcttgccagcatctgttattgcctttcttcttggaaaaagctgttttaactggggtgagatggtatcccattgtagttttgatttgcatgtctctgattagtgatgttgggcatttttttttcatatacctgatggccatttgtatgtcttcttccaataaatgtctgttcagatcttttgccaatattttaattgtattatttattttttcctattgagttgtttgaatttcttatatattctgtttattaatcccttgtcagatgggtggtttgcaaatactttctcccattctgtgagttgtcttttccctttgtttattgtgtcctttgcagtgcagaagctttttagcttgatgtgattccccgccgcctctgagctggagtcttgctctgtcgcccaggctggagtgcagtggtgcaatctcagctcactgcaacctctgtctcctgggtttaagcaattctcctgcctcagcctcctgagtagctaggattacaaggatgtgccaccacacctactaatttttgtattcttagtagaaacagtgtttcaccatgttggccaggctggtcttgaactcttgacctcatgatccgcccatgtcggcctcccaaagtgctgggattacaggcgtgagccactgcgcccagcccagcttggtgtgatcttatttgtccacttttgctttgg

SEQ ID NO: 39604 - DNA, 1482 bp, Homo sapiens
accagcaagttttattaaggatttcaaaaggggagtgggtgtaagaacagggagtaggtcacaaagatcacatacttcaaagggcaaaaaacagaactactgataagagtccaacaaagatggcaaggcaaagggcaaaagcagaattactgataagaatgtattttcagcggtgcacgtattgtcttgataaacatcttaacagaaagcagggttcaagagcagagaagtggtctgacctcaaatttaccagggcagggtttttccctaccctagtaagcctgagggtactgcaggagaccagggcttatttcagtccttatgtcaaccgcgtaagacagacactcccaaagcagacgtttatagatctgcccccaggaatgcaatccttttcccagagtattaataacaatattccttgctaggaaaagaatttagtgatatcttccctactggcacgtccgtttataggctctcttcaagaagaaaaatatggctccttttgcccgaccccacaggcagtcagatcttatggttgtcttcccttgttccctaaaaattgctgttattctgttctttttcaaggtgcactgatttcatattgttcaaacacatatgttttacaatcaatttgtacagttaacacagttatcacagggtcctgaggtgacgtacatcctcagcttacgaagataacaggattaagagattaaagtaagacaggcataagaaattatgaaagtattatttgggaagtgataaatgtccatgaagtcttcacaatttatgttcctctgccacagctccagccggtccctccctttggggtccctgacttcctgcaatagactaccaaagtgttaggattacaggcatgagccactgcacctcatctgaacataactctcgtatgcactaggaaaccaaaaaatggtgtgactcgatttattttgatctttgctttattatagtgatctagaaccaaacctgcagtatctacaagttatgctgatatatggattattcctatcacttttgtttggcttatcaaataaaaaaagcatctgtaactttatacttgggtttcttttagcaccaaaaagttcagtgttttgggttctaaagattcatttaggcagagtatttaatgatttaagactggtgtagattgaagcttttgctgaaatgaaacccctttagccactcttcctttcctttcttccttcttgaaggtttacatttttctcctttcctcatgacttgatgatgattctgtaattgtctgatctgctacttgctaatttggcattaaatttcaagttaatatgtgtgtgcatcttttttgcccctcaaaatttggatgaaagatgtgaccatagctgcagcagacatgaaaggtgaagttcctcctgcaatcccagaatgtggaaatggtagggagggttttttccctggcaaatcacttttgttgtgcttttttct

SEQ ID NO: 39605 - DNA, 1023 bp, Homo sapiens
actgctaagcctggtctaagctcatcccttgtttggattagtgcactgacatacttggttaccaggcttctcttctggacttttcttttagtccacataacggccaaaatagtatttacaagcatccagagaccaatctaccctctgacttgcttagccctctactggccccttgactcattactgtgctgtcaggccctcttcatcgcttgtgcctctgacttcatctcctgccatctctttgaggtaaagtcttcctgcctgctgaccttcctgaagtgagccaagcttgctcctaggggcctaggcccttagtgccagctgtctcccctgcctgggtggtgccttcttgacacttagattctactgtgtttaaggtgacttcctccggccttccctgactgcatcacaagttatcccttctccaccttttttatcactattagatttttttttctgaaataacacttggattattttacttctttgatttaagaatctataaggtagaatgtttttggatgagaaaaaaaaagaatctgtaagtgttttctaaattgcatatttcatcaaatgaaaactctccaacctgggttttttttttcttgatctttatttctcatttgaacatttatgttttagagaaaatacttagagtccctttccttgctgagattctgtatttctagcaattgatcacttaaacaacgtaaaccttaatagataaatgccataaatccactggccctgtgcattattttatgttttggtcttttttttttttttaaggtttttttttttttttagtatttattgatcattcttgggtgtttctcggagagggggatgtggcagggtcataggataatagtggagagaaggtcagcagataaacacgtgaacaaaagtctctggttttcctaggcagaggtccctgcggccttccacagtgtttgtgtccctgggtacttgagattagggagtggtgatgactcttaatgagcatgctgccttcaagcatct

SEQ ID NO: 39606 - DNA, 1043 bp, Homo sapiens
cagtggttgctgtggtcatcggccccagagtcttcggggagcaattttgttgacacaggagatgttctcatctagcatgtgtcctcacctgaaggcccatcaggattcttagctggcaccgtttcctgaggagtgcctttggaaggaatcttcagagtaattgtgtgaccactggtaaccttagggaattttactagaggattgtgtctttattttccctagtatttgtacttctccttggaggaaggtatttaataattttggttgacggaaaaacaaaggagtgaactaataaggatagaagctaatatatgaatagcctttatgtgttttatgtttttttaagttgatctctaaggcatttggagagcatccagctacatgatgtcattaccgaacaagtgaagccatggggcatacattctgtcgtactcacaggctggcattttccattatgttaccacatttgtcgactggtgtcaccaagaacaaatgcaaacatctgtcttcttgtagatgtggaatatttgtaataggcatacttaacacggtatcagctttttcttgtttcattgctttagggaaaaaaatgtattgagatggcttgctgacagatgtgaataaagaataaaatgtttgcccttggctgggcatggtggctcatgcctgtagtcccagcactttaggaggccaaggcgggaggatcacttaaggtcagggatttgagtctagtctgggcaacgtagcaagaccccatctctaaaaaacaacattggctgggtacagtggtgcacacctatagtcctggctgctcaggaagctgaggcgggatgattgcttgggcccaggagttctaggttacagtgagctataactgcgccactgtactccagtctaggtgacagagcaagaccccatctcaaaaaaaaaaaaaaaaccagaaagccctcaagatgctcatttgctcattgtcaagtataaataattgccatacaggaaaataatagttgggtacagttgtgtacgtggtgtgagaaattctg

SEQ ID NO: 39607 - DNA, 1034 bp, Homo sapiens
ctcgagtgcacatgtcagtgtctgcccaagaggctgtattcttatatgtcatatgctttaagaatcagtcttcaagttgatactatttttctaagtgatttggaagattgaattgaaagaccattgttggaaggcaatggcagcaagtagaatgtggcatttatgaagaattgggttccgttaaaaaatgagtgtagcaaaaaccagacagtcaggtaaaaggggaagaaaaatctgttaatgtttatttggcaggtaattgttgctgagatgtttacttaatgttggaagacatggaagatggtaagaataatcccacaggctctgagcaggtggaataggctgtatgcaagtaagaagccctgagcaagtgaaaccctacccaataaagaggtctagcaaaaagtacagttcatgctctgtcatgtataatgcatgtgcctatcagaaaatagcctgttactacagttatgccaccattagcataaatgccaccattagcagaattacattttaatgtaattattgatatagttgaacttaggtctccaattttgctatttgttttctgtttatctccttattttgttattcctgatcctcctttcctgccttctttagtgctaaccaatttttttccatgtatctttctgtttttagttttatttcttttttaaagtgattgctctaaagattgtaacattcatcttggatttatcacaatatacttaaagttgatgtagaattgcttctgtggtgatacaggaagcttgcaacagtgtacttccatctgtccagtcctttgagctgtccttgtcaggttcagcctctgcctgtgattgggacccctggtgggttttgagcagagtgatatcaggagcagctattgctgttagctgttcctgttagcagtacctccagacccactgattattctaatagagcagtattcaattctagtttttagcaagtttttaaaaactttgagtgcatggttttcactgtttaaaaatagcaatgtgttgtcccttata

SEQ ID NO: 39608 - DNA, 1050 bp, Homo sapiens
ccaagtggataatgagctgtgtcctctttgcttttttgccatttgccatgctcctccaagcagcagcgagggtgagaaaactttggagtccagcagactggggattgaatccttggcttgcctatttgctagttcattttggtgaaattaccttcaatcactgagtcaggttctcacctttgaaaggatggtgattaatagataaggttgacctcacaggtgtgtagtaaggatgaaatgagataccttaaatcatgtgtctttaaatgaggtactttaaataactcaggggatgagccacttagtaagcctggagaaatggtaatttcctgtctcagctttggtaatctctttgtaagccatgagacttgtagatagttaactctggcatttatttgagaaatttagttgtcattacagcaagggttgacatattaattagagcaatgcccttttcacataactgagtcaaatatcataataaatgccattaatcttggaaagtcgaaaaggagatcctgagaggcgaattagtgctgtgccaaaaatggaatgagaactcaggttcaaggatcaaggtcgcagccaatttagccgtgggtcataagaagcatttgctggagcagtctgacaaattttgttgaacctggcaccagaatgcaacccctcttgccttagaccattctgctgtgcatcctcctcaaagtcccatggccattaagatgcggggcctggacttgaaattcagccttttgacttcagactggggtgcttctcactactgtatgcctccctgctctcacaaagctccacctgcccagtacacattcctagaggtgtcaaggggtgaggagagtaatagttggtaaatgttatgaaatcttacattcagtttctctgctgtaacatgggatgattatatctacttctatggtactgttgtgagaattataatgcaatgataaaagtaaaagtggcacacacaacaattagtgtcacccattttttagctaatactatcaaggtatggatttacatcattcgagttga

SEQ ID NO: 39609 - DNA, 1060 bp, Homo sapiens
actccagcctgggtgacagagtgagactctgtctgtatttaaaaaaaaaaaaaaaatcaacaacaagtgagttacttccaagatacagtgggggtacatttattgggtaaatgctcttgatccaaatgggaaaaattggccaaaacaaaggggctacaggccccatgcaagactgaaacccagcagaacagccattaaatcttaaagctccaaaataatctcctttgactccatgtctcatatccagggcatgctgatgcaagaggtgggctcccaaggctttgggcaggtctgcccctgtggctctgtagggtacagcccccatggctgctttcatggactggtgttgagtgtctgtggctttttcaggtacatggtacaagctgtcggtggacctaccattctggggtctagaggatggtggccctcttctcacagcttcaccaggcagtgccccagtggggactctgtgtgggctccaaccccacatttcccctcacattgccttagtaaaggttctccataagggctccactcctgcagcagacttctccctggacatccaggcatttccatacatcctctgaaatctaggcagaggtttccagacctcaactattgccttctgtgcacccataggcccaacatcatatagaagctactgaggctttgggcttgttccctctgaagcaacagcctgagctgtaccttggccccttttagctacaactggagctagagcggctgggacacagggtgccatgtcgtaaggctgcacagagcagcagggaccctgggcccagcccactaattcattttttcttcctaggcctccagagctgtgataggacgggctgcagggaaaatatctgaaatgacctggagacattttccccatcgtcttggcgattaacattcagctcctctttacttatgcaaatttctatagctggcagcttgaatttctccccagaaaatgggtttttcctttctaccacatggccagactgcaatttttccaaacttttatgctctgcttcccttttaaacataagttcca

SEQ ID NO: 39610 - DNA, 1023 bp, Homo sapiens
gccccactcctggtaccgattttctgtattacttccattgttatactgctataaagaactacctgcatggctgggcgcggtggctcacacctgtaatcccagcactttggaaggctgaggcgggcagatcacgaagtcaggagatcgagaccatcctggctaacatggtgaaaccctgtctctactaaaaatacaaaaaaaaaattagccggacgtggtggcgggcgcctgtagtcccagctgcttgggaggctgaggcaggagaatggcgtgaacccgggaggcggagcttgcagtgaacccagattgtgctactgcactccagcctgggcaactgagcaaggctctgtctcaaaaaaaaaaaaaaaaaaaaaaaaaaaaggaactacctgaggcagggtaatttatgaagaaaagagatttaattgcctcacaattccacaggcttaataggaaggatgactgggaggcctcaggatacttgaaatcatgcagttggaaggcaaaggggaaggaaggttcttcacatggtggtagaagagagagacccaagcaggaagtgccacacacttttaaatcatcagatctcgtgagaactcactgtcatgggaacagcaagagggaaatccgcccccatgatccagtcacctcccaccaggtccctcctccaatttgacatgagatttgggcggggacacaaatccaaatcatatcaggggattacatttcatcatgagttttggaggggacaaatattcaaaccataccatcccatgtttccctgggttgatctgtaaaatttcagcagtgattccagtggctcactccttggaacagtcactgtcagtagaagtatggaagacctggccgggcacggtggctcatgcctgtaatcccagcactttgggaggctgaggcaggcggatcacctaaggtcgggagtttgagaccagcctgaccagcatggagaaaccccatctctactaaaaatacaaaaattagctgggcatggtggtacttgcc

SEQ ID NO: 39611 - DNA, 1032 bp, Homo sapiens
atccaggcacaggataccatcacacttctcctttcctgtcaggttagatgtttttagctaattggccttgtccaatagagtatgcgtggagaccttgtaaatctctgcctgagtgtccattctccctcttcctggtactgcagaagaggtactagagcaagtctgtccaacctgtgggcctcatgcagcccaacacaaattcgtaaactttcttaaaacattgagttttttttgcaattttttttttttaggtcatcagctattgttaggtgttttgtttgtttgtttgtttgttttttgtcatcagctattgtttttgatgtgtggcccaagacaattcttcttccagtgtggcccagggaaaccaaaagattggacacccctgtactaaaggctctcccactcatgtgcctgagtgaagatagtgtagaacagagcctcagccggcccacgtggccgtgaagcatgattaaaaaataagccttggctattttaagccagtgagatctggggcattgtttgtcattgcagcaaaacatagcctcttcgtgattgatagtggtgtcatcctttagcctcaaccctgcaaaaccaatttacctgttcctggggctggtatgagttacaggtgagctgggccaaggtgaaattctgatgtagcttctgtagattggcaatcttaagctcctacctaattgaaaatagtaggtttattttggtatataaaatatattaatggcctcctattttttcatatattatggaaatttgaaagtaaaaaggctgaaaacaggatagatacagatgttttgtaaggcagtgaggacagcaccataaaacaataggtctgtgctgggcctttctcccatagacactagcagtgcagggctgatgcctcaggtacctggtgcccccagcataccagccataggccttttgcctctttcagcgggtactgtggctgatacttttggaacccacagtcattagtctatctgtgtactataaatcccctagtacatacaaggtgtg

SEQ ID NO: 39612 - DNA, 1122 bp, Homo sapiens
agaatccattctgggagtagaaaaaatgtcacctctgccattttcttgtttttgcttatgcttaatttgttttattttcactctttggttttttggcagtgatgttttaaaactacttgttcatttcctgcagttagttgagctagattcacaactcagacgcacacctacctgggtggatgtgtgcaacagagctcagtaagctagccgaggtgtgtgttatagatggtgcctggcccctgtgtacctgcctgaggtagggaaaccaaacattatacagtacaatgtactgtataatgtgaaagaatgatatttcagttcttagcagagaaccgttgatacaggtgttctaggctatgtactcaagtaagtaagcagaaaatagcttttctggattaagaagataaaacctgcaggtatttccaggttggccgccttttatgtttgtttgggttttttgttgttgttgttgttgttgttgttgttgttgttttgttgttttgagacaggttctcttgtacctgggctgtagtgaagtggcatgatcacggctcactgcagcctggacatcatgagctcaagtcatcctcccacctcagcctcccaagtagctgggattacaggcacgcaccaccatgcccaactaattttggtattttttgtagagacggggtttcaccgtgttgcccaggctggtctcgaactcctgggctcaagcgagctgtcagcctcggcctcccaaagtggtagaattacaggcatgagccaccgcacctggccagccctcttttatgaagctgtttttccctggcaactaacaagaactgtataaaacatagtgcatatgtgtgcacgcagtttgcttttatctgtggaacatattgtgtgtcagaagtgtgaagtgacccacaactcaagaagtaaaatgtgaatgttagacaatagttagtgatgaaaaatggagttgtgccgagcctctttcatctggaagcactgcagaaaacccgtgcagagtcaagctgtgggcccagggtgtggtcaagccgttctaagcatgtggcaggtagagtcagctctggacatgaaggagctcatctccgtctgtagtgcatctgagcactg

SEQ ID NO: 39613 - DNA, 1058 bp, Homo sapiens
gaggcacggcggtccccagattccagggctttgaccacagatctgttttctgagttcctgtattatctctaggccatttcattcacagattcttgccaaccaactgagattaactgaattgtgtttgaatgagaactggatttgtgaacattcaaatgacagaaataaatttggctatctgaaagtaaaatctaaagttttcttcacatgtagttagtgtttcagagggcttaagagaaactcagtaatagtaaagactacccaactaaaaatgggcaaagaatctgaatagacatttctcaaaaaacacacaaatggccaccaagcacatgagaagatgctccgcatcattaaccatcagggaaacacaaatcaaactgctgcacactcaccagggtggctgtcattttttagaagacaggcaatagcaagtattagaatttggagaaactgggaacctcagccattgctagtggggatgtaagttggtgcatcattttggaaaccagtcctgtagttcctcaaaaagttgaacatagaattatcatttgacccagcaactccactcctaggtatagacccaagaaaaatgaaacatgtttatacaaaaaaaaaacttgcacacaaaagttcatagcagtattcataatagctaaaagttgatgaacagatcaacaaaatgtggtctctcaatacaatggaatgttactgggctatatttaaaaggtaaacactgatacatggtacaacatggataaaccctgaaaacatgctaagagaaggaagccggtcacaaaagagaacatatcgtatgattccttttatatgaaatgtccagagtaggcaaatctgtaacaacagagaattggttgcttagggctggagggaaatattgtggggttggttggtggtagctaaaaagtacagggctttgagggttgaggtagatgttctaaaacatattgtaaaggttgtacaactctgtgaatatactaataaccattgcattgtacactgacaatgggtgaattacatatgtgaattttgtcccaataaag

SEQ ID NO: 39614 - DNA, 1055 bp, Homo sapiens
accatgccattgtcatgatagagacattgctgataacacaacataaacccataacccctacttgaaaaacagcaagaagttcatgttcttttggtgtttgttcatttattttctcattacctgaaatgtaatatatccattaataccatagattttttaaaaagctaaatgtttgtagctataagcaacattgaagattatagatagcatttgttttgttagataagattaaaaagaaacacaatgtaggacaaattgaaaaagtaaaccaaggtggtagaaaacaggaacaaatataatgctaattagaataaatgtaaatggattaaatttaccaatcaaaagatacagcttagcagattacatttgtaaaaatctagataacagtatatcttgtttagagccacacctcaaacttaaggacataaacacatttaaaggatgagaaagatgtatcttgcaaataccaagaaaaaaaataaagctgatgtagctgtatgttagtatcagataaagtagatttgaagacaaagtattatttggttcgtagaagacagaaaggattatttggtaagctgtagtttaccaagagcatattttaaatatgtatacacttattaatagcatcacaataagtgaaggaaactaatagaactgaaaggaaaaattgataaatccattgacatactcagacattttaacgacagtcagcaaagatgtagatgatctgagcaacacaattaacaagcttgacctaaaggacatttataggttcttaattcaccaattagacaacatacttttttctcaaacacagaagggttataaaaattgatcatattctagggcaggattctgcaaaccttttctgtgaagggtcagatagtaaatattttaggttttgtggacaaggagccaaaattgaggatattatataggtatcatataacaagaggaaaatcagatttccaaaagatttttattgacaaaatttaaaatttgatttatgaacactgaaatttgaattttatgtaatttcaaataacaaaatatca

SEQ ID NO: 39615 - DNA, 1162 bp, Homo sapiens
ttgggctcttttttggttccatatgaatttaaaaatagtttttttctggttctatgaagaatgtcattggtagtttgataggaatagcattacatctgtaaactgttttgggtagtatggcccttttagtgatattgattcttcctatccgtgagcatgtagtatgtttccatttgtttgtgtcatctctgatttctttgagcagtgttttgtagttctctttgtagagatccttcacctcactggttatctgtattcctaggcattttattctttttgtttcagttgtgaatgagagtttgttcctgatttggctcttggtttggctgttgtttgtgtgtaggaatgctagtgatttttgtatgttgatttcgtatcctgagactttgctgaatagcaatttggatagacaaattatggtatattcatacaacggaataatatgtataaaaaggaatgaactactgacacacggaattcagatgacactcaacatctttatactgagtaaaagtagtcagacagagaagttgaacatactatatggtaccattcgtgcaaaattctagaatgaacaaccagtgacagaaagcagatcactgtttgcctaggactagggttggggattgacttctggggcgaggagggactttactgcatgtaaattataccttaataaagttgatttttaaaaggaaaatattaacaactacttgccagcagttttgaaaacttacatgaaatggacaaattccttttcaaaattatcagacctttttttttttttttttttttttttttttttttttttttttgagacggagtctcgctctgtcgccaggctggagtgcagtggcatgatctcgtctcactgcaacctccacctcccaggttcaagcgattctcctgcctcagtttcctgagtagctgggactacaggcgcgtgccaccatgcccagctaatttttgtatttttagtagaaacagggtttcaccatgttggccagatggtctcgatctcttgacctcgtgatctgcctgcctcagcctcccaaagtgctgggattacaggcgtgagccaccacacccagccctaaaattaccagaactgactcaagaagtaaaaaggttgaaagtttagactgggcacagtggctcatgc

SEQ ID NO: 39616 - DNA, 1007 bp, Homo sapiens
gattggtactggttcgtttttagttatttctttttgcgtgtatttgagaaattctgttgagcactttgtggaataaaatatgtttctttagcagaaacaggtgcagctactatgtttgtactttttcattttgtcagtgttttggttgattgacatgacagttaagatgtctagaaattaaatcgccctttgttatctctggactcaggcgatgaatcaccaaatagagcactcagtattgatgaattataaaatacgctaaataaaaatctttcttgagatttgccttgaataagcaaggcgcagtggctcatgcctgtaatctcagcactttgggaggctgagggggtggatcacctgaggtcaggagttcaagaccagcccagccaacgtggtgaaaccccgtatctattaaaatacaaaattacccaggcacgatggtgcacggctgtaatcccagctagtcgggaggctgaggtaggagaattgcttgaacccgaaggcagaggttacagtgagccgagatcacaccactgcactccagcccaggtgacaagagtgaaactctatctaaaaaaaatattaggttaagaataaaagatgagaggaatttattaatatacactggctcttgtcacatataccttcttaaagtcagttttttgttaatgcaacgttagattttcttcatatatctttatcaataccacagcatgatgatggccttggttttgacacagggatcttgcctaaatgccagcgtttagccagatggtgaactacaaaattgatcttcctggggttccacatggcactgctgctctacagcccctgaccttggcattgaatatgtccttatatgtgttaggaggggtgagatgtattgtttcacatgtgttcaccaccaggacaaaggctcgctccttctggtcaggcctctctgggccctcttctcagctggacctcaatcttggcctctaaatactgcagactctcggacataaatt

SEQ ID NO: 39617 - DNA, 1054 bp, Homo sapiens
gggcgggcttgtgcccatcctcaaagggcggcgcatcagcaagctgcggccagagttcgtcatcatggacccgcggacagatagcaaaccaggtgggcccctcacccgagggactgggaccttgttctcctgtggtcatgggctgttaacgccttacaccccatgcaaagagaatgtctgctaatgaaacgtgagcctgtgggggctagtgtggaacatccttgaagctacgacatttccagaatcccattgaaatgaacagttctctaaatgtactttttgacaggtttttaatcatattccatgggcagtggatagctgggcggtggatagatgaaccaggcaaggggaagttggcgcagtcctcctgggagtgagggtttcctcttcacagttaccgagtattcatcgagtgccttcatgtaatattgagacaacttgaaaataataacaagatacagtccctaccctcccagagtggatgataaaattgaaatcaaaccttcagcctcctacccctccctagtctactgttaactgctttttacctgattgctaatgacaatgttttgctcatccataaagatgttggtatgagtcacccttttcttctaaaaacctttccctgcagtgattttcattgctcagttaatgtattcaagatgctccctgcacatctctctgggatcctagattgtaagcttcagagggaagggactttgttctttttttgtgccacttggtactaggctagtgtccgtgcacccatcagtcactgccagctcagtctgccacctccctctgaaactttgcccatcacctatggcagaacgaacagcacgcttagtcattgtgctccagacgctgccccgctgaatcctgtgggcctggggggagagaactgagtcatctttgtgccctcagtggatttggatttgttttcattagttcatgcttcctctcgccacttcctcgctccagtttactctcctgcccattagtctggtccctgcctctcattacgacctggagctagcatgacctgtggcctgac

SEQ ID NO: 39618 - DNA, 1028 bp, Homo sapiens
gagatctctcaccacgcacgtgcaccaaggagaggacatatgaggacacagcgaaaagacagctgtctgcaagccgggggcaaagccttcaccaggaagcaggcgttgtcaccctaaccttgagactgctcagcctccataatcgaatggaccagttatttagcgcgtgcgcctgtgtgtgtgcacgcacgcttgtgcgtacacacgtgctcttgcatacacacacgcataatactggttttgtttttctggagaaccctgactaatacagattttggatccaggaaatgggtattgctgtaacaaatctctaaacatgtggaagaagctttggaactgggtaatggatataggctagaagagttttgaggtggatgctagaaatacggatgttaagggcaattctggtgaggtcttagttggaaatgaggaacatactgaaaactggatgaaaggtgatcctataaagcagcaaaggatttgagtaaactgtgtttactgtttcatggaaggtagaacttgcaagtgattaaactggatatgtaactgaagagatttgtaagcaaagtgttgaaggagcagtttggttcctcctgatggcttatagtaaaatgcaaaaggagaaagatgaatggaagaaggaattgttaagataaaagatgaagatttagatttagaaaatatttagactattcatattgcaaaaaataagtattaagtacattttgaagaaaataccaaagttatggctggactctcatttgataaagcgcttatgaaattatatgagcagagacactgccagtttgaactgtagtggatggaaacaggatgaaaggaaggagagaggctgttggacttcttagctttgaccagctgggatgatggagctgtttggccactaacatgcactattcttcaagaagaaagaaaaataaccttgaaagtgattcagagatcattaggtccacctcctcagtttcagcaggccagatggcctttgcacagagccttgtgggcagagccat

SEQ ID NO: 39619 - DNA, 1032 bp, Homo sapiens
tcccattatgtaagcagagaggacatctaatgcatgcagctaaatccttcacctttaaacgtcctcttcaggttgccgtcttcctgtggctggacctcctcctgttgtcctttccccatttggaccctccacacagcagccaggctaattgtcccacatcatagctttagggagctcaatctgccatcctcccactcctcaggagcccagagtttctcatcaagctcaaaaccagtatatatgagacttaatgcattttttcatagactgttttaaaccttaccatactcattttaatcacactgtctttggggtagactgtcattaaacatgtgtgtctccatgttacaaataaagggactgagaagcagagatacaacatgggatcaaaaggcagccaaaaaactttactaatttgatttaaatattgcagatggtgaaatgctagataaatttgttgaaattcacactgttgcagaagaaattataagaatcactggcattagggtaagaaatgacttgttccacctgccattttcccaggactgattgtgcaggcccctggcagaaggccatttccacgcttgctccaaggcaacagagagtgaaagacagttaattctttgagttccttacaaatggatcgctggatctcatttcagtgtatactaagtatattttgagatggggtcttgctctgtcatccaggctcaagtggagttgtgtaatcgtagctcattgcagccttgaactcctgggctcaagcgatcctcctgcctcagcctcccaagcagctgggactgcaggtgtgtgccaccacacccagtttctcaatatattttaaaatgtatattattcaatgtaaagttgtcattctttcctcatattcataaagcaaaagcaaggggagagctttgttaaattcgggcactggctgcagggtgagaacccaacacccaggctggctgtccagaaaaagaaaggactgctggagtcagggccatgctcaccattcccgccacggatgcctga

SEQ ID NO: 39620 - DNA, 1817 bp, Homo sapiens
cctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaattggaaaagaaaccgacccatttttttcccagatcaagatgacatgacatcactcccaattctctccaaaccccagagaaatactgacgaagttttctgatgtggcaaaggatatttcccatctaataccagtttctcatttatatttaacgtattggacctgatatttttagtgggtgcattcttccagaaagaattcagcaatgttatcagaattaattcttttatatgagtttatgtagcttgatatggtgtttcagtgcttattggttgtgcaataatggttatagcctgttagataatctaaatgcaattcccctgttttgtcgtttaggagataattatttatcttgcttttcatagtgttcttaggaattattttgttgttacgttttggtgagttatacccattttatttatttagaaaaatagtatctttgttaacgacttacatggtcacagtatattttgctgcaagaaataaagaggatatgatagaaggtttttttttttttttttttttttttttgagacggagtcccactcttgtcgcccaactagagtgtagtggcacaatctcggctccccacaacctctgactccagggttcaggtgattattttgcctcagcctcccaagcagctgggattatagacacccgccaacacgccaggctaatgtttttgtatttttaatagagatggggttttgccatgttggccaggctggtcttgaactcctgacctcaggtgatccgcccgcctcggcctcccaaagtgctgggattacagacgtgagccaccactcccggcccatagaaggttttttgctggataatttgtaacttttctaattgggaaaaaattcctattaatcacttaaaaatttttttttgtattttgtgttattgattatatacaaaggagactttttttttgagataacactcaaatagtattctcttcttttgaaaattttatttttatctgaaaataacagttgatctgaaataaaaaggggagacctattagaatgagagtagccaaggaaagagttactaggtaataagcttcactttttgtgttctaattgtttttgagatataaagaccctgaaaaagcccattttagaacctgtttaataagagcaaatataggggaaaatctttgaaatgaaagctacaaatacatgtgagaagaaaaaaatggatttttttagcaaataattaactaagcttctaaatgcctagctccctcccccaaaggcgctttcccccgatggaggcacaggcttctgtctcggatgtttggcgcacgtgagtttgtatgagtttgtaccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcattcagtcagtctctgttgactaaatacgacgaaaattcatactttatgcaggagatttctaaaaatttaatgtttattaatagtttatgaatatcaagatacctcattgaatccctaaatttaaaagcagtccagtaaa

SEQ ID NO: 39621 - DNA, 1031 bp, Homo sapiens
ttgggtcctcatttctgaaggttcccatgtcatgtaaaacttgcatcacttaacaatgagagatgtcctgagaaatgtgtcactaggctgttttgtcactgtgggaacctcacagagtgcacttacacagacctagaggcatgacctgcggcacacttggtctctgtggggccgctgattgcttccggactgcaaacccgcacagcatgtcactgtgttgaacactgcaggcaactgaaacacaatgggaggtatttttgtatctaaacatagaaaagggacaactaaaatccagtgttatagtcatacgggatcaccattgcatattcagtctgttgttgactgaagcatctttatgaggtgcatggctgtattaaataaaatttgtatggttttctcttgttaatgggggccctggtcatgaccctagtgatggatgaggaaaagaaatgtttcctcccctgcaaaggtttggtcccagttaaaagatggggaaatctcagatagaaaatcgtaagtgactttcctctcatccaggcagtgtgtgttgaaaaagagtcaggagcaaatctcagagccatgaggccgcagcccctctttgagaatcgctccttgaagcatcctgaaccacagagaacaagcgccggctccccagggagcagaagccagcacctcagatagaagcctcccctccagggaaatgagtcacagacgagcccgggtgaggctgcgcggctgcgcctgccccgacctttgcttttaacttcctttctcctttgcagtcaccttcccatgagggagatgatactccgaagatgggttcattttgtccagactttgtccaggttcccgaagatgatctggaggatcattttattgtatgtttatggaaataaacaaaaccagtgccagtgagcctcgcaatagaaggtggtgagtataaaatgtaaacggcaccctgatcagcactcagccttcttcgtgttcacactgaaactatccagcctgccaggtccttgctgctgggtaaa

SEQ ID NO: 39622 - DNA, 1050 bp, Homo sapiens
cttaccatttaccattgcagggaaaataggagaacatggaggaaaacagaaaaaaacagggaagagtgagttagtaaaaatgagaggcatcgaaagttactggacctgcaccattcctgaggctcagtgctggcctctgggggtgggaggggagctgcaggtgtggggagggtgtggtgtggatccacagtggagcccctgcaatgaaatcctgaaaactggtgcagcgtgtcctgcgggcgagtggacagttgctttcccccacagagcctcgcggtgggggcgggggtggagtgacctgtcagtggccgcaggatgggcagtgccccacagcagggatgcctgctgtcttgcgttctgaaaggacagttcccggcacctcgagacaggaggttttctatgcctatgtgactttgtatgttgcgtttccttctaaattttgttttatttctggggtgtgtgtactggtggagaactttggatttagtagaatatctgaggtgaatctaaatagattcttcccagtctcctggcttgtgtacctggacggttggagttgttgtgtcctgagatgggccaggccacaggcacaggaccaggggtttggtgtgaggcaggtcatgtgtgaggtacctgcttgatagccaaacgggcatgccaagtggttgagtaggggtctggagttgaggggagaggactgggctgaggtctagagcaggccattgttcatacctgcatcctctcgcaagcccgagacaggatgagattaccaagggagtgagagtagagaaggggaggggacagagagcagtgtgtcccaggatgatgatggtgagggaggtgatggggtgaggaagatgatggcgaggagttgatgagggaggtgatggtgagggaggtgatggtgagctcctgagggaggtgatggggtgaaggagatgatggtgaggagttgagggaggtgatggggtggagggaggtgatacggtgagggaggtgatggtgaggagttgagggaggtgatggggtggagggaggtgatacggtgag

SEQ ID NO: 39623 - DNA, 2812 bp, Homo sapiens
tgagtgggccagcctggagtctggcttgaccctattgggcagcatcatagaattgaagctctggagttggatgcgcgggtttcagtgttgcacttagcagccttgtgatctagggcaagtaatggaaccttcctgagtctgagctttctcatctgaaaggggttgcagtagtacctatctcagggctgtgatgacggagggagtgcgtataattcacataggatatgtgcagggtggcaggaaggctggagagggattgtggggaaggatctcggggactttgaaaggcctgtctaaacttgatggagttggctgcggggcactgtacgcttcctgagcagggcgaggctgttaaagtgctgtaatggcacaaaggaaggtgcgtttggaggtgatggcagcagctggcaggagtttttggggcctgaacagtgggactggcgtgctggggatgaagaggaactggggagcaaggactcagctcttcctggctggctgaaagtgtggaaggagcgagagaagggcatctgagatggtgccaggtttcagggtacgagaatggagaaagggtggaggcaggaagtgggcagtggaagcgggcttttcagtaatgttattttgttttttagctcagtttgaaaccttttgaccttgaagtactgtagggcttctaggtgaaaacgtgttgggcagcgctgcttcagagtggggtagggtgggcagggaggatggctcctgaaggcaggaaggacggagagagaagcagcaggagatgagctggtgttggaggactggtgcgaggggtggcaggagtctaggactagaggtttcaggaagcacacggggacgacagagatgaggagagggaaggcctggggtcagggacccccagggaccctctcctgttcgtaggctgtgcatattttctgcatcacagacttgcctctatgtgtttagaaatatcctcccttgggggactgatcagagagggccatgggctctcttggtcactgagacttactcggtcactggtctaggttggcatggtgttagagacctgtgagcattttcagcaggaggcagagctgccagtgggtttctgttgcagaacaggagccgtgttctgaagcgactggggactccagccgctgtggtcactgagctggtctcacagcagggggctaggttagttctggcaaagacacctcccctctcccatctttaccttggcttctcaatgttttgttgttttgcccatgagcaacagttttagagctatgattgatctgaaacggggtcttgtttctgaggtttctgaagtctgtggttttttggctcaaatcttttttattttaattttttagtgacagggtctcgccctgttacccaggctgagtgcagtggtgcagtcttagctcactgtagcttcaaatttctgagctcaaacgatcctcccccctcagcctccagagctgctgggactacaggcatgagccatgctgggctgtttcagaacttttagattggaagtcgagagcggaaagagtcgcagaggggaaggcattgatcatcacgcagaattatcctgtcctgggtgctgccttggcccatgatagccctgcaggctgcagagggtcccaggaccctaggccctccagtgaggatgcctgcttgtcaggaaaatgaagacagcggaagccagggcctggcgcccaccctctcacccacgagcctgttgcagcacaggcggttatacccagcttacacttgcttaagaagacagattatgttgttttctctgtcttttttcctttgagttggatgacttgattgttaaaccaggaaaatttctaataagttggacttaagtagaagttttcgggaaggggagacaatggattttattgagccttctgagagagactggcaggtgcctggggcgggttgtgccctcatgccctttctcttttttttttttttttaaattgagacagggtcttgctctgtcgcccaggctggagtacagtggcatggtctaggctcactgcaacctccacctcccgggttcaagcgattctcctgcttcagcctcccaagtagctgggattataggcatgtgccatcacacctggctaagttttgtatttttgtagagatggggtttcaccatgttggccaaggctggtcccgaattcctgacctcaggtgatctgcctgcctcggcctcccatgccctttctgggattgcaggcgtgagccaccgcacccagcctctcatgccctttcttaaggcctctttttgcaacgttccttctcatttgctaaataactgtgctagtagggggtcaataatgtgtttttgaaatcaagatttaaaatatagttattctggttttctctgcttccaagtaatttctcttgtgcttttagcctctgcttgggtagttctcggagctccatagtcttgggactgtggctgccccgggggacgggacctccgagaacgttgtagtggaggaactcagaaatagcagtgtcattgtttaaaagctacttgagctttacagcagagggccagagatagcagagtgtttccgtacactttttttttttttttttgagatggagtcttgctctgtcgcccaggctggggtgcagtggtgcaatctcagctcaatgcaagctctgcctcccgggttcacaccgttctcctgcctcggcctcccgagtagctgggactacaggtgcccgccacaaagcctggctaatttttttttttttttgtagtttcagtagagacagggtttcaccg

SEQ ID NO: 39624 - DNA, 1049 bp, Homo sapiens
tgagtaagaccatatgacagatctgttaggcagagactttaaaacagctgtcttaaaggtgctgaggcaactaaaggaagagacatggagacagtcaagaaaacaatgtatgaataaaaagatagaaaacctaaaaggaaaccaaaaagaaattctggagatgaaaagtacgctagagtgattcaaaggcagatttgaacaggtagaggaaagaatcagtgaatctgaagataggacagtggaaatttttgagcctgaggaacagaaaaacagaagaaaaatgaacagagactgagggacctttgggacactatcaaatggaccaacatacacactctgggagtctgagaaggagaagagatagagaatgggtcagagaatatttcaagcggtgatgactgaaaacttcccatatttggtgaatgtgaatataaacatccaagaagctcaacaaactcaaagtaggatgaactgaaagagacccacaccaagatataatcaaactgtagaaagccaaagacagaatcttgaaagcagtaagagagtgactcatcacatacaagggatcctcagtaagtttgtcagcagatacctcatcagaaactttggagaccagaagtcagtgggctgatacattcaaagttctaaaagaaaactgttggccgggtgcagtggctcacccctgtaatcccagtactttgggaggctgaggcgggtggatcacctgaggtcgggagttcaagaccagcctgaccaaggtggagaaaccccatttctactaaaaatacaaaattagccaggcgtggtggcacatgcctgtaatcctagctacttgggaggctgaggcaggagaatctcttgaacccgggaggtggaggttgtggtgagctgagatcgcgccattgcactccagcctgggcaacaagagcgaaactccatctcaaaaaaaagacaaaaaaacaaagaacaaaacaaaactgtcagtcaagaatcctacgtgtagcaaaactgagggagaagttaagacattcccagataaaatttgagga

SEQ ID NO: 39625 - DNA, 1668 bp, Homo sapiens
aggcgtttgggttgtttccatttttttggctgttgtgaactacacaaaatgagtttttttctctgtctaccctatagccctttgcaggcggccgtctcctcccctctgagattgttcttttctttcacgttgtgctggggatgtgacctctgcacccctctggctccatgtttccttcctgaagctgccccagtcacccagctgcaggggcaggtgttgctgatgtggaaggagcaggtggccctgggctgtgctgctgggacagctgagccggctctctcgggagccacgtcactagtggtctcttcctttcagccctttgcctcagccagcctttccagatcttttggatctgaatctggggtctggtctttgctgtctgaatgatctcctggatcttagtcttcagagaatccgattagtattctgcttgtgtcctccattcatggtgcagtgggggattccagatggggtctgaggcaggtgcactgagcttaggcatactttgatgtagtcctttgttaatcatctgtgctttagactttgctatttcagaatcattctgattcaacagtgcagacaaacaagggacctctccctttcatcatcttctttattagaacatcatctcctacaagccttttatggttctcagcacctttctccagaagctgtagttcatcctgaccctgttctatgggtgtgggccgctgttttgtctttatggtttttgtccttccatcttttgtatctatgtttcctcttaaagttgttcctgaagaatttggtacatatgttaggtgaactaggtacatgccattctgccattgctgatggaaggcaagtgatacagtgttactgtggggctcaaaaaggaattggttcaaaagacgttaccatgggaaccactcaccttgaattacaccacagccagagcctcatttctggtggcactcttcagcatctggaaagacagcccttgagacccttgggatttgtaagggatgtcaccaaagatttttctgcgttttttgtacatttcgtttccccagcagccagcatagggcccagcagctgctaggcttgcaatagatatgtattggttgaatgaaagaacagcagtacagcaccttacaaatttagaaattcacgtggcaacagacttctgaaattatgttcatccttgctttaaaccaaagattagagagttcaagaatgaatgtcttttttcaaccaatcaattttcatagattgggccgggggcagtagcttatgcctgtaatcccagcactttggaaagtgaatgtagtaggattgcttgagcccaggagttcgagaccagcctggacaacataatgagaccccatcttttttttttttctgaaacggagtctcactgtgttgcccaggctggagtgcagtggcgcgatcacggcttactgtaacatctgcctcccgggttcaggcaattctcctgccttagcctccctagtagctgggattacagctactaatagctgtagtagttcaccacgccctgctaattttcatatatttagtagagatggggttttaccacgttggccaggctagtttcaaactcctgaactcaggtaatcggcctagctgagacccccatctctaaacaaaagtttaaaacttagccat

SEQ ID NO: 39626 - DNA, 2335 bp, Homo sapiens
gaaagaaacaggaaaagcggctcaacagtcaaagacaggtttgttttggacaataaacctgagagggccttctggccgagttaggtcagagtcactctctcttacaggctaagagtatttaagggttcagggcagaagaggttatcacaggcttggaatgtttctgtatctcttcgccttgcttatctgggagggggaggttttgtgtctgttcccatacaactccctgcagctgcagggataccccccccacctcctagtctgcttttagcttgtctatcttagcgcatttaaagggaaaggaatgtgcttattagggcctacttttttactggggcccatttttgggggcccatttacactcccaaaacatgagtgtgaagttcggtggttacccaagagacttgggtgcccagctgtgcccagctgtcttatctgtgttttactgtctactctttctggctgctttttgttagaagtgatttccttgaaacgtaagaagttagaaagggagctggaactgaaaatgggggtgtttgtccaagatgacggtgctcctgctctgtcattccagaccctatagttataaaaggaccaggggcgacgtgttctttctggttacttcctgctgggtgggagaggtagagagtcccttggtctcggattgactgcgggagcaatgccgtctgtagatgttttggatagttgtctgtgaaatagccatgctcctgtcagttaagaatctttgaaaaaggttaattaggcagggtaaaaacattagtcctaggcttattattaggagagggcccaggaatgggatgacccatggtatgctttttgttcccaaaccaataattcatttggttgttttggtattcgcttagcattttagccctttgtttgagatttttagcagcctctcttacgagacctgattggttgagatagaagcaacatttctttcccaatgagaggcagaggcacatgtttggaaagacccatgtgttattttttattagtaactgttattcctgctgtaaggatagtaattaagcaaaatgctacggtaattgagattgtctgtctgatatcctaccctcagggtgctgcagtacatagtcctactgcaaatagtccagtaaagcagttcccgcaagggtggcatggtaaataatttccataaaaaagctttaatatttggcttaaaaggagaggtagaaatgacaaaaagtacttggtgaggtaagagtgagactgagtcagatgagtaattgtcactcagttagttattttttatgattttcaacttaagatttcttatttctttacattgatatttaggacgttcctctgggctgttgggattgcttcctcagcttttcaggctttgacttgagtgtgatgtatgcaggggttgattcctgtaacagatgtaatttaaactgtcgaaaaccataaaaattgaaaaacatcagtcaagactagaatttaacaggtgtgctatagtttttgaaacctaattttctctctccagtttaccatttttattaaaagacaaatcataataggactggtttgctttattatacttggcttatttatttgtatacagtgcagcaagagtaattatttgctacatacaccttttaaattggctttgatggaacttttttccatagaaggaatcagataagactttccaaagccaaacccagccatggatttgtaccattaaatacctatgagttgggtgaattcctttcctcttgaggtttcaagataacttggggttcctggcctgtcaaagtgacatgctttgcttagcacaggtcagaaactctgtacagggactgtgtacacagaatatgagaccagtttccaagggctttcttggcttcctaagtcaagttcgattccttaaaggagagcacaccattccagtgaaagccttggcagaataaccagtttctccaattgtgttctgttacgcaagaaaatatattcttaccgcactgatgcacacaactatattgttgtggtttaagaatacttataactagttttcaaattctagaggaactaggcagagagaaacaaacatctttaaatcctaatatttacaggagtatatttagtttaagacaagtttccttgactctggaaaataaaataaggattggcagtgtcctgttcggatacaatcagaaacacaattgacaaataaatttggttatttctgtggtttacagtaacccaacataaccttacttgtgattaatagcacatatttagatactagaaccttagacatcccatacagttttagaacatatgt

SEQ ID NO: 39627 - DNA, 1136 bp, Homo sapiens
cttttttcctaattgaataccctttatttctttctcctgcctgactgcccgggccagaacttccaatactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaacacctagtttattgagagtttttagcatgaagcgctgttgaattttgtcagaggccttttctgcatctattgagataatcacgtggtttttgtctttggttctgtttatatgctggattacatttatagatttgtatatgttgaaccagccttgcatcccagggatgaagccaacttgatcgtggtggataagctttttgatgtgctgctggattcggtttgccagtattttattgaggattttcacatcaatgttcatcagggatattggtctaaaattctcttttgttgtgtctctggccaggctttggtgtcaggatgatgctggcctcataaaatgagttagggaggattccttctttttctattgattggaatagtttcagaaagaataatagcaactcctccctgtacctctggtagaattcggctgtgaatccgtctggtcctggactttttttcgttggtaagctattaattattgcctcaatttcagagcctgttattggtctattaagagattcagcttcttcctggtttcgtcttgggagagtgtatgtgtccaggaatttatctatttcttccagattttctagtttatttgagtagaggtgtttatagtactctctgatggtagtttgtatttctgtgggttcggtggtgatatccccttcatcattttttattgcatctatttggttcttctctcttctttattaatcttgctagcggtctattttgttgatcttttcaaaaaaccagctcctggattcattgatttttttgaagggttttttttgtgtctctatctccttcagttctgctctgatcttagttatttcttgccttctgctagcttttgaatgtgtttgctcttgcttctctagttcttttaatggtgatgttagggtgtcaatttta

SEQ ID NO: 39628 - DNA, 1035 bp, Homo sapiens
gtgcttttgtcctgtaaaatggccccacagcagaagcctagtgtggtagcagcctggttcacatgaataggactttcacggagtagctccgtttccaggtgtgacttcggagcccagcatgcctagtttcatgccacagtgacccaagtgagtcaccccgtctgctccagtcccctgtccccaattccctgtcatctcagccacccattttcattttgaaaatcaatctcatggaagtttctatttgcttttattgctttctttgttttcttgtctatttcctagtactcatacgtgccattaaaaaggtgactggaaaaacagctcttaaaactgcaagagaaatagtatatagggttttgtgtaataaaaaatactgcaactttccaatactgataaatgtggacccttggtaggattgtatagttttttcatgtgaaatatgaaattcaggatttctcataaatttaggattgctttgtaaaaatccttcactgttggtaggaagtagtttatattaataagtaaaaaaaacaaaaagtcaataagaaaaaatgtaaaataaaaagtaaaggtagttattaatctataattatttataatgtcaatttttagagttaacgaattacatgatccaatgtaccagtatcgagttgataccggaaattttcaggtaaggattgttaatgaggcctgcaatttttcttcttaatgctgttttgtaaaattactgaattttgtgacttaaattgttctgttgagctttttgctaactgactacttgggaaggactacatagaaagttcaagggtggaagatttggggaaattttttttttttttttgagttggagtcttgctctgtcgcccaggctggagtgcagtggtgcaatctcagcttactgcagcctccgcctcctgggttcaagtggttctcctgcgtcagccttctgagtaactgggacgataggcgtgcgccaccacacctgggtaatttctgtatttttagtagagatgggggtttcaccatattggc

SEQ ID NO: 39629 - DNA, 1063 bp, Homo sapiens
ctcctaggctgctggcgactccggctaagtctggagggaggagcatttgtccaaagagctttgcttaatttttgttttttatttttcaaaataaaatgcaagtggaatttacttccagagttgttaatgagtttctttctttttcagatctcaggttgaaatttttgactgcattgactttcgtagtacttgtcattaggtaagaagaccttatttcttgaaaacagcaaaacggaatttttcttttactgtcaggaatatctgttgcctccttttgtggagtggatttcagggtacttctagcccagtagactcatgaggttagagggcctcccaccaaggctgggcagccgagagcagccgtcagcctggagagcatgtttttgttgtaagcggccgaggactggagcacgttcacttgcacactcggcccgcgctgggcatgttctgtccttgctgtgccacctgctatgtgtgcagcgtgcagtcaccagctggaagtaagggcactggggacctcgggatccttggggtgccccagggacaggactctaagcgagttaggacagcaaacacccttgagcagcatgctccattgctgccattgggggagatgggaggcgaagtgggcttggtcctgttgtgtcagggagtggcgtcagcctgaggtctcccagggcaggctcggcctggcctgagtgccccagacctccctggggaccggtgctggccagttggtagaggaacagagcggtctgggaagttgtttatttgaatcgattccaggtaattgcttggtggtttatggtttgtctgtttctcctaaaatcagaatccagaggaggaaaaaatctagctgctgcttgcctttttaggttgtttggatggcaaataagcggatgttggcccttttcctttatgagtgacaaggggcctctgggaggtcaacccttgtccaagctttccaggtgggctctgggagtccccaccttgtggagggcgaggactgagataggcatccaaggtcgtccaccaccactaggagtgtgaactcagctcagac

SEQ ID NO: 39630 - DNA, 2671 bp, Homo sapiens
ctagaaggggctgctgatggcgggaggagtggtcgggctgtaggcagagcctctgactgatgtgtccagatgccgcgttccttcccttgacagcaccaccagccgagttcttatctttctatggcctgttgaacttctatctctacaccttggcctttgtatattctccatcgaagaatgccctctatggtaagccaccctggggtctggactgctggccagttagcgggcacagaggcctgtgttcatccacgacccacttcccgggtttcccattcatgtgggcgctgtgattcccagtgacttctcttggcagagagagagtgagttgaaatgtcgagctctgaggtgagttggggcccagcatatgtagaacctgcgttgtgtcattcccacagagttgacacactcattttattagtgtcagtccccagcttttgctgttcagtttgggattttttgactttacaatgatgcaaaagcaatgcacattcaggagaaatcacactttgaatacccaaacaaccattctgtttttcactttcagtacagcattcagcaaattcatgagagagtcaccatttattacaaaacaggctttgatcctttgatcccagcacttctggaggccaaggcgggaggattgtttgaggctgggagtttgaaaccagcctggggaacaaaatagggaccccatctctccaaaaatttaaaaattagacaggtgtggtgacatgtgcctgtagtcctagctactcggttggctgaggagggacggtcgcttgagcccaagaggagaggctgcagtgagctatgacaccactacactccaacctcggtgacagaatgagaccctgtctcttaaaaaaaaattaaataaaataggctttgcattagatgattttgcccaactataggctaatgtagtaacacttaaggcagaataggctaagctgcaatgttcggtgccttagctgtagttgatgcgtttttgacttcacgatattttcaacctgacgatgggtttatcaggacataaccccatcgtaagtcaaggagcatctgtagtagtgttgttaccattaaaaaaaaaaaaagccaaaacatacaaaaagtcacctaatagtgaaaccaaaacaaccctcttgcacagggaatgaaaaggatgggaactctctagaacataggcagccccccgcaccccccgacatcttatagtgggctagcacttgcccagcaccttcacaaacggcgtctcacttaagcttcacagcaactttatgataaacatataatcatgcccgttttacagaagcagcagctcgctgcacgtccaaggactgggcgggggcaggcagggcagagccacctctcctggggcctatgttcagctccccactccttgtgtcaacaggaggcagctcgtgcgtgggcaatggcagcctgcctgctccttcccacaggccgcctccctcagccttcaggacgtccctgccaggcaggccaggccagccctgtcttgtagatgagaaaacagcctcacgagatgtgttcaggtttatacagacatggcagctctgcgatttgagtccagttctttccaactcccttcctttgtccgggacagcatcctgcctgtccaggctcatcacgtcaattgcttgagatgcaaatgctcttgttggttttcagagtcccagctgaaagacaatcctgccttctccatgctgaatgactcggatgatgatgtgatttatgggtaagtccctgtccgttagaaggccggcacaccttgggcatcccggcacggccttgcatgtttctgaatgggttactcttctaaaattattttcaaggtatgaaggcatttaccttggagtgtcaagtggctcgtggttttctgttttcacagtattcaggcttagatgtggtagtagtcctttctgctggctacctgtagggcgtgctggccacgggaagaactgtgctttctggactgatgggccctgggaactgggggtcagggagaggaggacggggtgagcagtagcagttggtgatagaaaattgaaagagcgaagctatgatttaattcctgctggaatggtgtgtcagtgtggaagaggaaaataaagagctgtcagaagttagacggtctcaaaggtctctttgctcacaggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatgg

SEQ ID NO: 39631 - DNA, 1033 bp, Homo sapiens
aataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagcttccccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaa

SEQ ID NO: 39632 - DNA, 1050 bp, Homo sapiens
ctttttttctgtctagattgtattttctaattgagacttccaggtcatgagatgaaggcagtcttgttctaccacagacagtccatgggccgtggatctgacagcctttgaccttcttgatgatatggaaaaccatcacgttctcttttcctgtaacatgtgccctggctccagtctgttttttaataccactttccactccacccatcaatttccttctactgctctctgatagcctgggagaattgaagcatcttgttttggctaataattctcagaatccacatatgtacctgctgatattcaaacaaaccacacccaaaggatgtgaggccttggggtgatcttattttcacagctgcatcatgactgcactttcaatgctagcacctagggaggctgaggttcagggtacaaacactagatatcatctgagcagattgtgtgtccctcttaacaagcatgcggaatctgacttggggtccttgggatgagttccgtggggtccactggcactctgaaattgtaatgtagtttcattacaggaaacaattctcagcattttgaggagtcaaagataggctaggtcacagccacagagagggacagactatgtgtcctcttggaattcaagccctggaaagcagtgagtgacccagggcttccacacatggggaaaatctctagtaaaagcgctctttgaattccattaatgccatactctgttctctgattatcctagctttgggaggacttcctttcccctgggccctgataatgtttcttgttagtggcactcagctgatagtaaatgcctgataccctcactctttcatgtgccaatgtagtgcttccttcagtagattgaagcccattgcctttcttacatatctccaaattaattcacttgtattcccaggggagtggctttcttagtaactctatgtcacccaattgaatagcatattcaaagatgtttacctttgaaggtagggaaatgtgttggaatttgcctgggtctgtccagtcatggaaatcactgaagactat

SEQ ID NO: 39633 - DNA, 1050 bp, Homo sapiens
attatgaatcaaagactgccttctttccaagtacaatttcaatcaaagcctttggccaatggggaattaatgctgtctgtgacattactttcacagtagctttctcatgcagttattagttttatttagtgtgcacttcacaggacaaaagttcatggcctggaaggtgagctccttaagggcagggtgctttgatttactcatcttcctatctccagagcctggggcaattgcacagtgggtgctcaggagacatttgttcagtggaaatgcatttggcggttgcttctgccccatacctgtgcttggtagaggagtgggcattgacaagagtgttgacaacagctggggcttggacgttgcagaggtgcctgtgagaagattggggtcacctctgtctagttcaatgttgattcggggggttctgggcaagcccgtttgttgaactcagattggtgctaccattaatcagagattctacttcttgtcttttgctactgtgagggcctgggccaaaaaaaaagatgtgtgcatctgtaaactggaattctttgggctggctggtctatgaagatgaggtgtttgcacagccagatccatgggctgtggggtggcctgcccactactccctcccaaggaagtactgccccagaacgagcccttccatcttaagggcttggatctcttcatccggtgctcgtttcaaagctgcctctcatgttaaaatacagctagactttgctagttgtagagcccattctttaggtaataaaaatgtgggagacagaggtttgtgtgagaagctgtttgactccatttagccagatgtccctggggagaagcaaaggcctcaggagtccctgctggcacccccccaccccagcagaaatgccatggaagggaggcaggaaggagctagctggccagaaaagagattgattgggcacagccttctcctacctttgaggtgaaatcacaggcatttcacgtgaagacacaagcagtgggggtaaggccctttcttaggacaccaggatgtgtgcttatttc

SEQ ID NO: 39634 - DNA, 1478 bp, Homo sapiens
attttttattttctgagacagagtctcactctgttgcccatgctggagtgcagtggtacaatcttggctcattgtggcctcataccccagcttatgcgatcctcccacctttgccccccaaagtagctcagactacaggtgtgccactacgcctggctaatttttgtattttttggtagagatggggttttgccatgttacccaggctgatcttgaactcccgagttcaagatatactcccgcctcagtctcccaaagtgcaggaggcatgagccacaatgcccagccaaagccttaattttatactgaggtaggagaggtatctcacctttacagcctttatttggtgtagtgaatatactgtttctcaatttttgaagcatgttagcttatgcccttctttcagctttttgttttgaaataattatagattcataggaagttgcaaataaatgtacagagaggttctgtgcaactttcactgagcctgcttcattgttaacaccttgcgtgactagcagacatctctaataactgtgaaaatcagggaattgacattggtacaatccacagagcttattcacatttcacgttatactagcactgttattgggggaagtggggaagagctatatgcactattatcatgtctagctttgtgtaaccatcattaatcaagatacatatctgaactatcaccataaagcttcatcgagttattcttttatagccacatctaccccgtccctctccatgcctgacccctggcaaccactaatttatctccatttgtataattgttacttcagagtgttatataaatgtaatcatgtagtatgcatctttttgagactattttttttccttccacttagcacagtttccttaaggcttatacaaattgtttcatgtatcagtagtcctgtttctttttattgcttaaagtgttccatggtgtggctgtatgatagttcaatcatttgcctgttaaaggacatttggatagttttcagttttttagcttttacaagtaaagctgcttgcatgttttcatttctttgagatacatgtttaagagtgcaactgctgagttatatggcacattcatttttagttgtattaataaaaggaactgccatacttcttcagataccatttttatattctcacctgcagtgtaggaaacttcagtttctctgaatcctcaccagcgtttggtgttgccactaatttttattttagccattctaatcagtgtgtggtgatacctggggttttaatgtgcattttcctaatgatgatgcccattgttaagataccaaatagtttaccttaaaaaaaaaaaacttttgtaataaaatactttttcaaaaaatcataatatgtactgagccgtttaaatctcacacttgggagatgtttcataggtctcattatagaactttgtgtcttcaggaagaacactaaattcatattgt

SEQ ID NO: 39635 - DNA, 1068 bp, Homo sapiens
tttctaaagccaaattttaattaattgtacctgaagagcagcttgaaaacatggctcttaagtatgcaggatagcagacattcagggcagggtgctttccattaggaactgcctaataagactaggaaaaatctttattgctaagaggacctagcagtgtatatattcagggtagagaagtataatgaagaacaacggtccccttgtattctgatagcatatggcatttatgcaggtttctgacagttagatgtgattgttaaattacagtcttgaaaaatgttatattctccccctgtgtttacaggcagaaattgatactaccttgagaagagtcacatggtattttcccaaaagagccaagataaagaaccttcaattctacataatgaggcacatttctaatatgccttttgttctaagtggacaacatatgaaagcagcagtgggatttttttttcagcttctataatccaggattatcctgaacatcagtgatatcaaagtgaatctggggtttgatctcacccagggcatgcttggcatgttctcagcagaaaaaaccttctctatatatctctttttacctgtttcctgtaaaatgggaaggaataatgagggactattttatgatcagttaaactagatttaggctgggtgtggtgactcaggcctgtaatttcagcagtttgggaggccagggtgtgaggatcatttgagctcgggagttcaagaccagcctgggcaacgtagtgagaccccatctctacaaaaaaatgagccatgtgcctttggtcccagctatacaggaagctgaggcagggacatcgcttgagcccagaccctgtttgcgccacgctgcactccagcctgggggacagagcgagactctgtctaaaaaaaactagatttaaaatgaaaaatccagaagaatgctcagtattactaaaatctgtgagtttatagatatcttctagtttatttaataaactattttatcgtaacaactaatgtatggatttttttttattagatggaaacaatatgaagcatatgtacaagctttgg

SEQ ID NO: 39636 - DNA, 1796 bp, Homo sapiens
tactgtataacacagatgttttctgtcttctgttgggagtagatgaaactataaaaacataatttagttagtagtcatggagcactatgacaccattgtctcctaaaggagctctcgtgaccaggaagaaattcgcctgttataaaagtagttaggatggaaactaaagacttgattaattttttgaccctagttcttattgttcttgacagaggtatttagaacttgatcttaaaattgtatttataatttttttttgaatcatcagctaatgatgtaactggcctaagagagtctgaagaaaaactaaagcaacaacagcaggagtctgcacgcagggaaaacatccttgtaatgcgactagcaaccaaggaacaagagatgcaagagtgtactgtaagtatttcaagttatataaatgtctttagttgaggaattggtttttagtccacattattacatgttaattttaaacatttaatgctaaatataagagcttatcttttataggtacgtatgctttgagctttaagaatactagatgaaaaattttgataatgtctcatttagactgttttttgtggccaagaaggcaaagttttaagttttttttgaaattttcatgccttataagtattagttcatcaattccagacatttttcagatatcttggtgtctgaggatgtaatcaataaaagaacatttgctctttattgctttactttcactgattaggaaagccatctgaggactttatctctgttctcttgtcccctctgtgtatagaactgtttttcctagtgtcagcaacctctttagtgtctcctttttaattgttagaactttgatgtgtactgtgtagtatttactatgtctacgtagatctgaaatctagtgacataattgatcatccagctctggtagtttaggctcaatcttacggtgtaattatacaaaataattagaggcagctgtatccttgtttctgattttaaaatctgaatgtttcttcaattctttgtgtactctcccttcatttggtacatatagaagtcttcttatgtgttattaaagtcttctaagatagtattctggtcattggagacaccaaaaatctatgggcacagtcctgttctgtttcttttgccaatagaatgttccttaaggttcagtcacagtccttttacttcccttacagagattgtttaaatttccacaaaagcacgtatttactcttctttcacttgttactaaatgacttcttcacattttactttgctaaaggctggcttttatcattttctttacttttttttcccactaacccccccgcccttttcttgagacagggcctctctctcatccaggctggagtgcagtggtgtaatcacacctcacttcagcttcccgagtaactgatttcaggtgtgcgccaccaagcgcagctaatttcttaatttttgtagagatgaggtcttccctatgttgcccaggctggtcttgaactgctgtactttggcaatccttactccttggcctcccaaaactgttgggattataggtgtgagccatcgcacctggcccattatcattttctctaccttcttaacacattttgtccttttgtttctatcagttttgttgtaattcttaccaccactgatacttctttctccatagttactaatgaatgttttaacaaatttccctttacacgagaaatggatcttacctttagactgctagcacttgggagatagagtgtgaatagaaggtgttgatggtaatatctcat

SEQ ID NO: 39637 - DNA, 1896 bp, Homo sapiens
tgtgtgcacatcacaatgtttgtgctattcatgcacatctgattctccatctgtcctatatgcgctggcagttttgatcatattacgcctggtcaaggccttcggtgatacctcatcactcttgtctcctcgacctggattttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaaatcacaaggaaaggtcaagattatatatggcagatgaggataaagtttcaggtgagagtgaaaaaagatgaggtcagcctggaatcttgggtattctagaagagaggggactactgaagaattcttcagcaagagatgtatgtgatggatcagatttagatttacattttaggtagatcactctgacttgagtatgaaagatagatttgagaggaacaggactttaagcaggaaaaccaattgtgaggctgttaaaatagttcagatgaaatacatgaagccactggtggtagcagacaggacagaataggtgttttggaggcacaatcaataggacttgtttagtttggatgctgttgtggaaggaatgaaaaaaatctagggaggaatcacagcttcaggtttgtcttgtttgactgagtaacgatgctactaggatagatcctacaaagatcaaattttaaaagaagagtagagtgtggtgttaggaaaacaggaaatccagcattccctcctccttccccaaaatacaaagtgattaaaacaaaggcatacataaagttctgtacaatacgaatttaaaattgttcgttagatttggcagttaagaggttgttggccaaggaagccaaaagattggatacccctgctctagaggaactgtcaagtgggaagtgagagaaactaaatttaaagagtagaaagaatgggagtgatgtactataggagtttggagggaataggttaagcgaatggttgaaaggattggccctgagaaggagggtttcttaccctcttgagtgaaaaatagtggaaaggtttgtattaggtacctgtcctttaaaacagagctgctgcatttacccttggtgtttcaaattaagctaagcttagaaaaaataaaatatacatccttaggaatctatttgtgtagatcttttgtttgtccagcatactaactcatccatttgatcttttaataataatgctttatttctttgtctacatgcagtctttgccaagtacatcagtagtcaatttagttagttttgagcgtaaggcataaattagccacgtagttactatattcttaactatatactgtattcttaactatattttattttgttggtaagtaaaatctgtcatttttgttcacctcagtggtatttctgtttttcatttagtcttttgccaatcaactcaaaatagatttaggaataaaactaactttgaaaacactttactcagtgttctcttccctagaacatggaatttattctagtctgattcacctctcttttcatgaatgaaagtgttgactattgggtctttgtaaagctaaatagtaactgagtctcagtcagtgctgtagactgttttaatcagtcctgtcagtacatggagtgcactgtaagtcatggtttattctcgctctgttatcttagcagctggcttcacattgactatgcagttgtactagatttttgctcagtgaaacaaatatattcccaaaccacttagtatatttgttccttttactaaatttatattagaaaattttaactgtaatcctatttaagccttagtatggagtta

SEQ ID NO: 39638 - DNA, 1039 bp, Homo sapiens
aaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatcatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagataatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaagagctttgtcgttggtgttaatgggggaatgtg

SEQ ID NO: 39639 - DNA, 1144 bp, Homo sapiens
cagtaaagtggaaggaattccattgtttttgacaatcttgcatatctctcattttcccattgtttaatttctaagtggatgttcagtggaggctaacgcctgagagtgctgatgggaaatggtggaaatctggagctacagtagcagtgaacaagaacaccagctaataaagttatcatatcaaagaataaagcctttaccacatgctcactggtggctttcaccctcgggctcctctgagcagtagtaacccaggttgaactcttcaggtattttctggaagaaagcttaattacaaacttttccttgaattacattaggttagaaaacatgcagccaggcacggtggctcatgcctgtaatcccaacactttggaaggctgaggtaggcagatcacttgagcttaggagtttgagaccagcctgggcaacaaggcgaaaccccatctctactaaaaatccaaaattagctgggggtgctcgtgcacacctatagtccccaggtactccggaggctgaggtgggaggatcacctgagcctggggacgtcaaggctccagtgagctgagatcacgccactgcactccagcctggcaacacagtgagacccccatctcaaaaaaaaaaaaaaaatgctgtaggtgaaagaaccatgcaacacttcaaagattgataaaatatttacaaaatgctctcatttttaaacttataaggcatactgaagtagtgtatcaggcaagtgaaagcctcactagaagaaggaaagactagaatttaaaaaatgttttaacccataaggtcatcctggacttaccccaaggacaagaatgtcacactgtctttatccaagtctcaaaggtaaatatcacaattatttacttagatccctttaaaagtgatcatttctttttttttcttttttcataaataattacaagaacaagcaaataatttctccttttattgctgaggctaaagaaaagcagtaaaattttattgggaaacatttgagcttttcattacatatttgcaattgctatgtatgtgcacataggttcagtagtatgttgcactagcatttggaaactataatctgtggaaagtgtgacactcctagattggcagatatttgcgtgtttgaatt

SEQ ID NO: 39640 - DNA, 1792 bp, Homo sapiens
gatgatcttttccaataaagtcttaagtctttaaaaaaaaaaccttaactgctgaatgtgcctcaattaatataatagataatattcttgagagttatggaagatggatgtaccagaaaacttccctctctcctcctcttttttgagacagggtccctgtttccgaagctggaatgcagtggcatggtcacagcgtcaaccacttgggcttaagcagtcctctcacctcagcctttccagaggctggcactacaagcatgtgtgcctggctactttttaaaaaattttttgtagagttggagtctatgttgcccatgctggaggacttcctgttaaggaaaatccttattaaatgtttttctagcaagaataaatactctcattcatttttatttgtaggtactgattttcataaatatttgtgattgatgttgcatgtaccttttcaagaacttttctgataaagcgctagattccttagtgtaataatactggtatagccaaggtgtgtgttaattaactggctctgtttccatttcaaatgataatttgagatgaaaatagatggatttcagaattgattattgatgtaatagaaacaaggtgtagctgtttgggcactttttgtttagggtttatttttactgctgtgttggcaaaatactgaaatgcagaagatggatgtgtcccagaaaagaagatggtaattatggggaagcatctgctgtgatatagttatgtttgtatgtgttacatctatcactgtaataattgtaagcaaagacagagagttttgtcttcattttgtgatggatggctctttcctttgcagccaaacagggaaaaagttaatggcgaagtgtcgaatgcttatccaggagaatcaagagcttggaaggcagctgtcccagggacgtattgcacaacttgaagcagagttggctttacagaagaaatacagtgaggagcttaaaagcagtcaggatggtaaggggtttgtttctttttggaacgttgtctcaactttgcattggctttttaaaactgccagtcatgaatattataggttagattctgtacattgttaacctctgccctatgattgtatattattgtgagtgaagcatttttagttgagtccgcaaacaaagccatataattttagtttgtttatccccaccctcctaattctttattgttcaaaatttcttacatttttgtttttagttgggggtaggatttggtaaaagataaaagggtgttgtattacttaacaagatggacaaatttgtattcattgtttgaaagggagaataagcatttctcgttaagtgtaaatcttagaaacatgggcagttttcagcgatctgaaagtaataaagttgattgtatctgtgaaggttttattagtgaataagagatttaatctttaaatttgctgagataaaacttgtcagcctccatcctttttagtgcaagtgtagctgtatctctgtttctcttctttgtaaggtgcattattaataaggaaaatatccaaattctttgaaattttaaattgaaaattagtgtctctggttaattgcaaagatgatcagtagccaagtaatttcttctgaactacctaccttttcaaaatcttcaggaattatttcctgtgacttttgtccttttatatgtaacagtccttggttgagaacatgggcctctttggagtgttatagaggaccacactatccttaaggatcagacttgctatggaactaaggcactggatcaggaataaggggat

SEQ ID NO: 39641 - DNA, 1716 bp, Homo sapiens
agtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagtgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttagaatctgtgctgtgtaagggcattcgtactcatgctgttactgtacttatgcaccattcagacttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaattagcttttttgttttgttttgggtgtatgtttagcatttgtcattttcattgagtcattgaatttctactcattatccttcaagtaccacaacagtcaaacttaagaccaagcatcgattacgattttgcacacaatttttaatttatgccttattttgcaaaacggagctggagtttagggctacacttaaaattttttcttgacttataattgttacaaaatattttaaaatacagaaaagtataaagaaaatagtcatctatttcttaggctttttttttttttttttttttaattgagacagggtcttgctttgtcacttaggctcaagtgcagtggtgcagtcatggctcactgcagcctcaaagtcctcgactcaagtgatcctcccacttcaggcttccgagtacctgagactataggcatatactaccacacccagctacatttatttt

SEQ ID NO: 39642 - DNA, 1024 bp, Homo sapiens
taatatacctgctgttgagttggtgagagttaagactggccgctactcagaaatccctccccatcatttagttagcctgattattctcactgtagacattatgtcatccattgaaataggtaacacattgttagctttacttaagcccttagaggatttcttcatttaacagataattaattgcctcgatggaaagaataaatggaattcttaaggaaacaggacacagaatgggtaggtttgagggagaattgaaaatgggtaggtaggagagtaatcgttcccaacaataggaaagatgaagtctgctaattccaggggtctttagaccttggcctggctgaggacctagaactggggagaagggctgcaaaggggcctagatgaagacttaggaaatactagatagttttgagttgtattctggggagaagactaattgcaactaagcctaaatccatttttatttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagaccatatactaatctgcttcttaggtgctttcgtccttatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttg

SEQ ID NO: 39643 - DNA, 1786 bp, Homo sapiens
ctccagaactgtaagaaaataaattgctcttctttagaaaaaaagaaaagaaaaaaggctcaggtcatgatggagtaattgacaaagattagatttcctactataaacaagcataaaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaatgcaggcagatcacctgaggtcgggagtttgagacccacatgaccaacatggagaaactccatctctactaaaaatacaaaattagccaggctggtggcgcatgcct

SEQ ID NO: 39644 - DNA, 1040 bp, Homo sapiens
aagtaagtaatgagagtaatgagttataacttattcaataaaatgaaaatgtatgagtccatcctgatataaataactgaataaatgggagaaaaggaaaaggttttctttgtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaa

SEQ ID NO: 39645 - DNA, 1024 bp, Homo sapiens
gtagaaaacccaaacatggttttgtggggtgtgtgcctttgaccccggacttaagcaacaagcgtggtcttgggcgtagctacgaggtggttggtgggctccagggcctgcgtgcccctcgacgtgagcgatgattggcgatgaaggataacagatcgccttctcggccactcagtggcaggggacttgctacttccgggtcggtggcgtctggcgtggagagtttggggatctacagcagccaaaggcttgtccctgactttatatggctgctcctggcgagcgactgagtcgtccgtgaggaaaaagaggcgaggcttttccgagatcgtctcagcgatggcgcttcggtcgcggttttgggggttgttctcggtttgcaggaaccctggtaattagtcttgccccccttctcccagctcactcgcctgggcttgcacagtacattggaacgtgcgggttctattttgtattcgacgtgccggatcgaaatagagctcgcggcactgcgaagaccacagtaggaagttaaggacggggtcagtgctgactccaccctgtgggcatacgtatttttcgtcccctcgggcctaaagattgggggtgtaaaagcggatagacgttagagcgggttcgtgcgctgtccatatccgtcatttttaagccctgtgcggtttttcccgttgcccagggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggtaattaaatctgcttgtgattgacaagggcagtgcaccctacagactattttcattcattcaactccaggcactctcccaggtagctgccatgcggcgggtagaggcagggttcgcggaggggctggaacaaacaacaaataggt

SEQ ID NO: 39646 - DNA, 1095 bp, Homo sapiens
ttctgaaaagttaaaaccatttctttaaatggaaaataaatgaagccgtttacctaattggttaaggactcacccgtgggcctcacaccgcctaggttaattcttcactttataattccgtgatgttgggcaagttcctcattctgagccttgggatatttggcttcaaagctgaggaacttgggagggttggataatggcatcacgttctgtggggagatttggctcacatgttagctgtgtgggtgagagccgtgctgtcatgcgttcttagccactggccagtttccttctcaagccatcagtagagatgctgatcctgcatctgccagtcattgctccaggagggaagacattactgtcccagagtgacggtgtcattggggataacagacacttcagaaaatgccaccactgagctgtatgaagtgccatggcagctagtgctggagctgtggattcagccggggagcactgtctggaggagctgctgcagcacatgtgtgtctctccagctgtcaggctggcctttggagtgcatttggattttttgagaatgagagagggaccattggctaactgttttacgctctgaaaaatgacatagaatagcaaagattttacttatttttgctgattttctagaacattttctgtcccagagtgatggttttgaagaaccagcgttcttggaaagatggttttgcatccagaagagtgattttaactaaaatcaggctgcctcccttgaggatggtcactgaattttgtacaactgggacaacggacagggatcctgggttgtttccagtggacaagccgcttctgtgggggcctttgcagttctccccgctcctctcctgtgtcccgctggtttccttcagttgagatggaatacagcatagagtcagtgacttttagaagacttgacagagtttcaggaaaatgctcactgggctttcttacctatcctgctgcagaactttttttttttttttttgagatggagtctcactctgtcacccagtctggagtgcagtggtgcgatctcggctcactgcaacctccacctcctggattcaagctattctcgtg

SEQ ID NO: 39647 - DNA, 1030 bp, Homo sapiens
tatctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccgtattgttgtttttcactgtggtttattccttctgactgctgtgatattttgtgtggatctgctgaagttaatttatccactcttctgttgatgggcctttggtcatttccaggtttttgctcttctgaagagcatgagatattctttcacattttctgctgtgcatgttccatatgtgcatggttttctcttttatatagacctgagtggagtaactaggtcatagggcacacgaatgttcaattttaggacataatgtcctgctgacttacatagttgttgaaccagttaacatttcactagcaatacaggagagctctgagccacctcatggctgacacttggtatttaatttttgccagagggatggttgtaaatggtataccattttggtcttgatttgaaattccttgatcaccagtaacattgaacatgtcttaacatatttattgatgtacatttttctttgatttgcttgatcatgtcttgttcattttatattgggttattgtgtgtgacctagattagaattttttcttttcattggatattaagatccaccattgtgtggctaggagtgggtttttccttctctctcctttccagcatggtgtgtgctttctcagtcagaggtaattcatcgtcctttatttcctggaattatacagacattcttttcttgtttgtttgcatgtgaatgtgtatgtagagattcttgatgctggttctttgccagttctgtgtttttcctagtttataacttacttccgttttctttaagctgttttttgatgagtataaactcttaaattgaataggtcaacctcattaatct

SEQ ID NO: 39648 - DNA, 1064 bp, Homo sapiens
aaagccagaactaattggtaaagacatacactgaagctaaagggatggaaaaagatattccaggcaaatggaaatcaaaagcaagcaggaagacccacctatacttagataaaactgactttaaatcaacaacagtaaaaaaaaaggaaaaagatggtcattatatgataaaaagattattcaacaagatgtaacaatcttaaatatgtatgcatgcaactctagagcacaagattcataaaacaactgctggtagacttcagaaaagaaatggacagcaatgcaataatagaattcaatcactgagaaagaaaatcaacaaacacggcacataaattggattcaggaccacgtagacctaacagatatttatagaacattctccccacagccgcagaacatatattcttctcatcagtgcatggaacgtttttcgagatggactatatgtcataccaaaaaacaagtctcaataaattgaaaaaaaccaaaatgataccaagtatcttctcagaccacagtggaatgaaactagaaatcaattcacagagaaactctcataactatacaaataattggaaattaaatagcctgcttctgaatgaattttgagtcaacaatgtagttaagatggaaattaaaaaaaaattgaaacaaatgaaagtggatacacagcataaaacctgcgggatacagcaaaagcagggctaagtgggaagtttatagtgttaaatgcctacatcaaaaatagagatcacaaattaacaacctaatatcacacttcaaggaactagaaaaaaaagaaaaaaccaaattgaaacctagcagaacagaagtaacaaataccagagcagaactaaatgaaatggagaccaaaaaatgcagtacaaaggataaaaaaaatgagaagttggttctttggaaagataatattcatagactgttggtcagattaaccagaagagagaggattcaatcagaaataagaaagtagacattacagctgataccacaaaaaagatcataagagacttctgtgaacatctgtgtactcacaactgaga

SEQ ID NO: 39649 - DNA, 1053 bp, Homo sapiens
tcagcccccttcatggctcacatcaaagacgaatggtggagctcctgctctgtagaagcaacacaatggcagaatcgggtttgtgtctgggtggtgccctggcttcacccaggagcaggtgtgggtacagatatggtggtgcccaggatcccaaaggggttgtggaccgtgtctctggttgtgcacgcatgtgataatgttcactcagtgtcagggttgcaccactccagttgagcacctcgtggaaagcggtgaatggaccatgcaccctgcacggcctgttagcgcttgccgatgtcctagtgattgccacgtgccactgagtccaggtgcttgctggccgaagcttgagtgtctctctgaaggtgactagactagaaagggaatagagtgtaaagaggaaatggaggtgttacgagtcaaatggaaaaaaaataacagtttagaaaaaaattaaaagtaactttactgagttgttataagtcaaataatcttaatgtgttagaggcaattatgattcaaaaaacagaaacagcaaaatgtagaaacctaacaacctgtctttgagcttttcataagtgtggaaaatctgcattaagctgcatgaaacattttttattttgcttctttcacattgttcctgatagggcaccattcccaaactcacagctaaatccaactgccgctatgaaattgagtggattactgagtatgcctgccacagagattacctggaaagtaaaacttgttctctgagcggcgagcagcaggatgtctccatagacctcacaccacttgcccagagcggaggtaagcaggtgctttctgcctcctggcgctgcttaggaagaaggggatcgagagagggaacgggacagtaggggccaagtcagtccatgcatgcttctgggttggagagagctgtagtttgggctggtgtttcagaaataggattcaggtttgactaagtaagactgtaatcttctaatacctattcatataaaacaagcctcttcttgttaatttccctgtttttaggttcatcctatattt

SEQ ID NO: 39650 - DNA, 1256 bp, Homo sapiens
tagaggcgtgtatggggaatgtggctgaagatgaccctggaacggtgagtgtgcagtattgtaagaaacttgtatgtcctgcagaggagctggattatatctggaaatctgtgaagtcccaaggattttcagcaggggtatgacatacatctgactcgtgaatgagaaaatcagtgtggcctctggatggacctcgcatctggtctgagcactccctgcacccctcagcttctccatcattctctcatcgccctcacctcctagcctacctacgctactagcctccttagccatgtctgcaccctgaatcacgtctctcctacttggtgtccccagtccccagggatgcagcctgtatcttccccatgtgcccagcccctctgatgcctgaccttggttctggctcccaggtcaccccaactggctctcctggactccggctggctcaggctgctctgctgtggtctgaatctccctgcaactttgtgatgacctcctttggcctgttctgttcagggctttttattaatgacttggccgagatctttgagagtgtgctgatctcatttggggatgctgggaagacagaatcattatccaaaaagatcgaaatggacgagcaggatatgagaagggcattatatcgtttcagacttacagggaagaggtgtggacatcgatgagctgccaaccaaacaaaaaacacaggagagaaaaaccaaagaacagaaagaaagaaaaatagaaaaaaaaaagaagacccgcagtagagtggggagatcttgccttgtagttatgagcatagatgaggccacaccctctgggtttggttcccagctgccctagtttttagttatgaaatcatgggcccagagggagctaaagcccagatgagctgaggcttgacaaaacgggtgaaggcctcccatagctccatttttccttttcattataaaaattttcaaacatggaacattaaaacagaaatttacatgcctgccactctgacagccattgatgttttgccagatttttcatgtaagccatgcgtcattgatggctcatatcaccccaccctgatgccaagaacgaacattcctttatgtaaattcagtaccatcgttgtacttaacaaaattaacagtgacatcctgatgttaaaaaacccatgttttcctaggctgttttcattatgattgtaacaaggagcctggacagagagatgtcaggtgttttgtgggagggttttgagctgg

SEQ ID NO: 39651 - DNA, 1058 bp, Homo sapiens
tttgaaggtgaacgagtgttaattggctatgtaatagaagtgtggtttaagttggatctctaggaattattcatgtgaatctaggttcatgtacttttcaggatgcaagcgcatcttttggtcataatattttttaccagtttaaatctagtttgttgtaaagcgatgctttattattggtgatttttttaaataaagatgttagataattttttggaagagcagaattcattaggataggctaataaactactcacaatttaagtggctcagcccattaaaggtttattttcttagttcagtgctagtctttggggatggggctggggtcgggggtgcgggctctgctccatgtggtcatttggagacctacgctttttccatcctgtgtttctgccatctgcagatgtgacttccaggggctctgcaggatgggaacatcaatttgctttgttttattttttttccaggccagaaataagtcacttggcccagcctgaatatcaggggaggctgggaaacggagtttagctatgtgtctagaggaaaaattaaactagttgggtaagaggtagcattgtttttgccacagagaaatgggtgctgctgcctcctccttaggcagagagctccttggttccatttgaaaaccttccttccccttttgctggaattgagagactgaggacacaaagtggtgtgctggagaataaactagagcctgtggtgccagactggcaacttggggattgtgtgagtgagggagagattgtgcagagctaatcctaacattgctgatgagtggacagaaaccataggcctcatgaatagtgatttctgaagtcaaagcccagtatgcttaaatatcaacccaagtggtttgggagaggggagcacagcttactgttctgctaaaattctttgaggaattaagtaagaatacgtgtaaggtacgtagcaatggttatttacaaaatggactctgcctgcagattattagtatgtctcagatgtaaaaccagctcaaaagtactaggacgatttgtagtagtatttaa

SEQ ID NO: 39652 - DNA, 1047 bp, Homo sapiens
tcctgcattcttcatatctctgttcctcatcagtcactgcaaagctgatcagacagattggcatggtgttcagcattttgagttccagactctggcgatgggagataggtcatttggaatttttccctcatcccctcctcaaaaccaaatcagaaatggagaaaccagatggtgtcagaagggagttgtgggtctcagcgctgtatcctcttcctcgggactgatactcggccagtcatgtggttacttaacttccttcaaaggggaaaaaaatcataaatggtttaaaacattgcccgtgatctcaccacttaaacacaatgttaattttcattacctttatttatagatgtatgttgtttttaccaagtcaaaatttttatggtaacaaatcttaatgtttctcaaagtgtagtattttgtaaatacttttctatgtttcacagttccattaataatttttaggaacttccttgttgacatggtgtggttttactatttttgaacattttccttattgttggattaatagcgcgtttccagtgttgctaattgtgctattatgtatcctctctctacctcccattgaaatatttcctttggataagttcccagctgtgggataaagtcagaagctagggtcattttgtttgtttgttttatatggtaaaatatacaacataacgtaaaatgtaccatcctaactgcttttaagtgtgtagcttggtgacattgttgtgtaataccaccaccatccatctccagaactttttgatcctcccagactgaaactcagttcccattaaacacgagctctccattccctctcttctactttttgtctctacggatttgactgttctagatacctcatataggtggaatgctacagtatttgtagggctgttttttgacccttctatgcattatacctcatttcccactgtcccttccaagtctacttctagcagagaagaatgaggtaagatattttaggaatgaacggattagtgatccccatctcttttccccattgacaggtgatct

SEQ ID NO: 39653 - DNA, 1804 bp, Homo sapiens
gagggagataggggatgtagacagttcttttgacggggcagcaaatgattatttgggagaaagaatggacagaaattaacttgcaaatgattctctttggagcctgaatgaggaaggcattatcttgtgcacaagtctgtccaggtgtgattgctgtcctcagtcttcttttgtgggatagataatgagatttccgagtttcttttggaaagaagccttcttggtcaggtaaggaaattccagagaaagtctctccctgtgcttgagggtggaggtaacaaggcacggttcaaaggatgaccttgattctcaggcagcttctcagcatgtcaaagcactgatccttggggtattgctttctgagccccagcagtccaaaccacaaagaccacagataggaatctgaggcttggtatagctcaggcctgtgggtgaacgatgagggctgtatgtgtaatacaaaacaggaataagaaattaaggctgagggctgggcacagtggttcagatctaacccagcactgtggaaggccaacatgggaagatcactcacttgaggacaggaattggtgaccagcctaggcaacatagtgagaccccatctacaaaaaatttaaaaaaaaatttagccaagtgtggtggctcatgcctgtagtcccagttactctggaggctgaggcaggaggattccttgagcccaggaggttgaggattcagtgagccatgattgcactgcagcctgggagacaaagcgagcccctgtctcaaaaaaaaaaaattgggaggcagaggtaggaggattgtttgagcccaggagtctcagactagcctgggcaacttagtgagaccccatctctacaaaaaattagccaagtgtggtgatgtgcacctgtagtcctggctacttgggaggctgaggtgggaggatcacttgagcccaggaggcagagattgcagtgagctgaggatgtgctactatactgcagccccttggcaacagagcaagatcctgtttcaaaatagtaatcatataaacaacttcagcaaagtctcaggatacaaaatcaaggtgcaaaaatcacaagcattcctatacaccattaacagacaaagagagccaaatcatgagtgaactcccattcacaattgctacagagagaataaaatacctaggaatccaacttacaagggatgtgaagaacctcttcaaggagaactacaaaccactgctcaaggaaataaaagaggacacaaacaaatggaagaatattccatgctcatggataggaagaatcagtgtcatgaaaatggccatactgcccaaagtaatttgtagattcaataccatccccatcaagctaccaatggttttcttcacagaattggaaaaaactactttaaagttcatatggaaccaaaaaagagcccacattgccaagacaatcctaagcaaaaagaacaaagctggaggcatcatgctacctgacttcaaactatgctacaaggctacaataaccaaaacagcatggtactggtgcaaaacagatatatagaccaatggaaccgaacagagtcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacacctgagacaaaattaattcaagatggattaaagacttaaatgttagacctaaaaccataaaaaccctagaagaaaacc

SEQ ID NO: 39654 - DNA, 1049 bp, Homo sapiens
gaacatgcttccccctaggagccctcctgtgccctcttcctgccactgctgagcatcctcctgacctctgacagcgcaggccattgttgcccaatcctgagctgatgtcagtgaatcctacgtaccgttgcctttgtgtatggcttcttgcattcaactttttgtgtagggtacttttcagaaccttgagctcagacctaggtttggatctgaattctaccatttactgctggcacgatttctatatttctgaatatccaagcgtaggagattattttgtcttcatagggagaatgagaacattaaattctaattaggtaatgcacattaagtgcctagcttattggctgactcataataaacatctagcagattttggctatttttatgtctcaggcgagtattcttttggttctatcaagttccatgttactgtattgacttttaccctggatttgcccattcagaacagccaccccatcttttctctcaactgggagtgtgtggtcagtttcctgtggaacacagaggctgcctgtcccattcagacaacgacggatacagaccaggtacgtgtgctttcacctggccctcgtgctgagctgcctgctggacatcctcaactcaccccagtgttccagctctgaaccgacccctgccccttctttctgaatcagttactatgttgcattgacaatgggtgtctgcaggtcacccagagttcctctccactccgcagctcccagctcctgggataagaaccaggtccctcagtcttactctctgctcactgtagtttccttccttttgtttccattcctttgtgccttccatgtggcagtggtatcctggtgggctctggggcttctgcaccaccggcagatgtctgactagtcgatacgtcactccacacctaaaccatctcagtgcctgtcccctagagggtagagcccgtatgttttaatgtgaccctatccatagagcacagcctgcaggtgttaatgtgatcctgtctatagggtaaggcctgtgtgtctctcacctgtgca

SEQ ID NO: 39655 - DNA, 1689 bp, Homo sapiens
cttgagtgctcacaaggaggcagagttctccagcgtggttttttgttgtgtttcagacctggctggaaatgagtacgacctgactggcctaagcacagtcaggaaaccttggacggctgttgacacctctgtcgatgggagaaagaggactttctatttgagcgtttgcaatcctctcccttacattcctggatgccagggtgagttctccttggtctcttgattggcgtctgttcattttattagagcatttgactcaaggtcatcgccttcctcatgcccaaaccacttattctgttcttccaggcagcgcagtggggtcttgcttagtgtcagaaggcaatagctggaatctgggtgtggtgcagatgagtccccaagccgcggcgaatggatctttgagcatcatgtatgtcaacggtgacaagtgtgggaaccagcgcttctccaccaggatcacgtttgagtgtgctcagatatcggtgtgtgttcagaccagcaatgagatgttgtccccgggtgactccatttcccatttcccttgaacctctgaatcttctatcttgtttaaaacttgcctgtgttttcgtggagtttcagccattgctagggtttgacgagaatgcactcatttcttcaggtcttaaatgtttaataaatgttacgtagtttgcacatggaggtcaaagattgggtactaactgtggctatcatttatttaatttttttttttttttttttttttgagatggagtcttactctgtcacccaggctggagtgcagtggtgcaatcttggctcactgcaacctccgccccccaggttcaagtgattctcctgcctcagcctcccgagtagctgggattacaggcacctgccaccacgcccagctaacttttgtatttttagtagagacggggtttcaccatcttggccaggctgatcttgaactcctgaacttgtgatccacccgtctcggcctcccaaagtgctgagattacaggtgtgagccaccgtgcccggccccatttgattaatttttaaaataaacaggaaacaaatcaggctgctgatttatattacagggctcaccagcatttcagcttcaggatggttgtgagtacgtgtttatctggagaactgtggaagcctgtcccgttgtcagagtggaaggtaggactgggcctgtccctacaagtcattttaaatgtatagagtagcagacgttctgaacgatgccttagatatgagaccgtgtgataacagccatagctggggtcatgagacacacgctagggggaggataatttcttttccttgagcttttttttttactgaagcatattgctaatttcacgagtgacattttccttgtgtgcctggattgatgggattttggcgtctgatgcttgaagacactaatgtggggtttggttttgtgttgtttgatgaagcaagtctttattcggggacctagactttcctagaaagctgtttgccaggcgatttgtattatatataaacaaaatcatgtggaaatggcttttaatgcccatttatagctggtatttacctaaccaaaaattgtaaaagtttttttttttttttttgagaccgagttttgctctgttgccaggctggagtgtaatggcgccatctcggctcactgcaacctctgcctcttgggtt

SEQ ID NO: 39656 - DNA, 1028 bp, Homo sapiens
agtggccatttaagaggcgcccctgccttcctcccgggaatgcattcttttcccagggctgttaattattaaaattccttactggggaaagaattcagcgatatttctcttacccgttttcggtaataagagaaatatggctctgtcctcaccggcccacagtcagccagactttaaggttatctcacttgttccttgaaaatcactgttatcctgttcttaaggtgcccagatttcatattgttcaaacacacatgctttacgaacaatttgtgcagttaatgcaatcatcacagggtcctgaggcgacatacatcctcagcttacgaagatgatgggattaagagattaaagtaaagacaggcataggaaattataatattgattggggaagtgataaatgtccatgaaatcttcacaatgtatattcttctgtcacggcttcagcaggtccctccgttcatggtccctgacttcccgcaatagtccagggaccaaaatgggatgtattaaggaaccaaacgtgttaaatttacgaaggattgctatagctttgttttgaggcttattttgacaaaacgttattccctattttctgaatcacactcctgttttcaagtacttgtaggtattacattattatcttaaattttttttttttttgagatggagttttgctcttgttgcccaggctagagtgcagtggtgcagtcttggctcactgcaagctccaccttctggtttcaagtgatactcctgcctcagcctcccaagtagctgggattacaggggcccgccacctcacccagctaatttttttgtatttttggtagagatgggatttcaccatgttggtcaggctggtctccaactgctgacctcatgatccgcccacctcggcctcccagagtgctgggattacaggcgtgagccaccgcgcccagctatcttattttttttcgtgatcattagtagattggtcaaatattgaatacccgtgtgaggaatcacctagggctgtggggtta

SEQ ID NO: 39657 - DNA, 1027 bp, Homo sapiens
gtgctgagcgcatcgctgagaaggagcgggtgctctgtgccctggtgcggctgagaaggagcgggtgctccgtgccctggtgctgagcacatcgccgagaaggagcaggtgctccgtgccctggtgctgagcacatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctccgtgccctggtgctgagcgcatcgccgagaaggagcaggtgctctgtgccctggtgctgagcgcatcgccgagaaggagcaggtgctccgtgccctggtgctgagtgcatctccacgacggcagcacctgatggagggaagctgggtcagcatcgctgctcctggtcacagattgtagacagcgccctggtgcatctgctcatagcacctgtggcccctgaatagaactgggaaagtgaatgttctgctttctgggtgagttgatgatgggaaagttgatcagcctcattcacttgcataactccacagcacggagctagcactctgtgtttctctgttctctgccttcctcacacttcggtgaatccttcagtcattcagaatcagatgttgcatgtcacaggttgtgccttctcttgctgtcctctttcccagtgctcggtaaatcttgattaaaggaaggaaggaaggattgtttcagaagccttcaggggccctatcatgcagagaaggaaagtctaggctctctctgacacagcttgaagatgtctgagaggctcccatgtaccagggtagccttgcaagctgctgctcctacacatgcctcagccatcaggttattcactagttcccaaagtcaccctgtaacctggtgggtttacatatgctgctcttggtgctggaatgccttggcccaccttcctcatccttccaaacctacttctagtgcccctcct

SEQ ID NO: 39658 - DNA, 1033 bp, Homo sapiens
gtattttcagcttttgaatgtttatggtgttccggtgacgtcattacaaaatgaaaggattgaaactggaagttcttcctgaaagaagcaaaatgtgaatttttataaaagataaaacccagaagtgaactttccctgcattctctgtcatggagaggctacagctgccatgagatgaatcctgcctcctgacatggcagctggtcttctgtgtgggtttgagggaccaggccaggctaggatcccgtccatgttgaatgtttagagttcgacttctgtgagtaggaaaagcactgtttatagggctttggtgtttgactctaaaaccagagaggaagattctccaggaaacctcggtttcatgatgttcagaacatcaggattgggagctgtttaaatcccttaacacactgacaaggtaataaggactttaaaaaaaagaaacagaagttgaaaccaagagcaaaaactcagatggtggattttgagggatgcaggtaccacccgggggtgacgtggaatagtgcctgagatttttttttccccaaatgttatcagtgttgtacattgtagaatcatgtaaatatggccagacgcggtggctcacgcttgtaatcccaacattttgggaggctaaggtgggcggatcacttgaggtcaggagttctagaccagcctgggcaacatggtgaaaccccgtctctactaaaaatacaaaaattagccaggtgtggtggtgcacacctgtaatcgcagctactcagaaggctgaggcaggagaattgcttgaacctggaaggtggaggttgcagtgagccgagatggcgtcactgtactgcagcctgggtgacagagcgagactagatctcaggaaaaaaaatcatgtaactataacaaacaggtagcaatgttcgccctaatagattaccatttttagttcttttagctatttcttctggaatttacctcagtattttaaattaacatcctatatctcatctgttgacttcctgcaatagtagatgaagataga

SEQ ID NO: 39659 - DNA, 1025 bp, Homo sapiens
ctcagctttatgttatgttatgttatgttatgttatgttatgttatgttatgttatttttttgagacagagtctcgctctcgcccaggctggagtgcagtggcgcgatctcggctcactgcaagctctgcctcccaggttcacgccattctcctgcctcagcctcccaagtaactgggactacaggggcccgctaccatgcccggctaatttttttgtatttttagtagagacggggtttcaccgtgttagccaggttgatctcgatctcctgatcttgtgatccgcctgcctcagcctcccaaagtgctgggattacaggcgtgagccaccgtgcccggcctcatcaactttataatgagacagttttgaaggaaatgatgtcattcgaggacctcccatagtcgcttcacggaaggttgcagtttgaaggaaactgtcagcgaccctatgaggacacactgtactggacaacagtggtgtctaagctgagaggggtggcagagttcccagcttttaaaatttcttacagtgatagcatcatatgaaagtaaaaccattttcttgaaagaaatgaaggaaggaagaaaaggtagagttcctaattgtttggaagacatactgttagacttcctgtcttagtatgcatgccagtattttaagaataaccactaaaataatataaatatagtatgtaacttccaaaacagcggagaagaaaaggagaagtaaaaatacttaaatccccaaagaagacaagcaaggagaaaaataaaacaaaaatcagataagtagaaatttcagcccagtatggtagaaataaatctaaatatatctataatcataagtatagcttgactaaacttgtcagctaaaaaacaagttgtcaaactggatttcaaaaacaactctgtttacagggaacatgcctaaaacaaggatacagaaaagaccaaagtcaaaggagaagaaaagatataccagaaaataatctgaaagaaagctgcagtagttatgttaatataa

SEQ ID NO: 39660 - DNA, 1125 bp, Homo sapiens
tttttttttttttttttttttttttggagacagagacttgctcttttgcccaggctggagtgcagtggtgcgatcttggctcactgcaacctctgcttcccagattcaagtgattctcatgcctcagcctcctgagtagctgggattatgggcgtgtgccactacctcctggctaatttttgtatttttagtagagatggggtttcaccatgttggccaggctggtctcaaactcctgacctcaggtgatccacctgcctcagcctcctagagtgctgggattacaggcatgagccactgtgctcggcctaagtcagcagatttctgactgatgcaattaactacatacatgatgcaattaagttaggaaccaagaacaaacaactgaaaaatagaaatacgtttgaagactaaaactcacttctgaataatctatggtccaaagaagaaatcaaaggtagaaagtaaaatacgcttagaactgagtgatgatgtgtctcttggatgcatttcgagtggtcctgagtggctggagctgcttctgggtgagtgggtttctggcttggagggagaggtctgcatagctctcagacctgtctgtggagtgtggtggtgcttctttctgagcagaggtcaacccttgcaggcccacctagaactggacgccaggctgtccctgtggtttcttgtcttgctgatgttttagattgtttggcttaagctgaactttgagagcggcagcccttgcggctgggccgcgggttggcctgttgccctcaacctcagttctttgagcagccggcatcttcagcagcacaagatgcgccccgctggggttgcctcttatcaccagcagcacaggaggaatttctgtttatgtgatcctgttcctgtgtgtgtggccccaagtgacagagggccagagagattagaagtgtcaagtcgttacactcttgagtgtcatcttgctccctaagcgcaaagggaagtctccgtggttgtttctcattttctattattgtcccaactctgcttgagtgttcgatgtcatggaaacgcactgctttttcccacaagtgtgcatgtgggtcttgggtgggaatggtgaactccgctggtgaggca

SEQ ID NO: 39661 - DNA, 1030 bp, Homo sapiens
gtgcagatgggggtggggctggcgggggtggggctcctgcccatgccctctctacactggagtaattattgtctcctttttttttatagggaaacagtgataagtaagctgaccacttgctgtaggagaagttccaacgtgtcctacaaatactcaaaggtaattttctgtggcgagtctcttgaaggcctgcctccccggccccctgtgctgcgctgtccatgtcgttctcatcaggggtgccaaggaaagcagtcacaggctgactggaatccagaaaggaaagcaacacccgttgcctcagccacttacgccagcacatttttttgttatttttttccctcaagtttctctcgtggttacaactgatttccttgaagtatttaataattaggttgtttccactgtttttggctgttctttaaaaaaaaaacaaaacacacacacacacagtagtgaagatagttgtgcatgtagcatttggatgatttctttcaggtaaatttgcagaaaagaggcattatctggatcaaaggacataatgtttgtggtctcgatgggtaatgatgaattgctctctaaaactaggcttttgactggagtccctcctttgacattcctcccctgccatgcagtgggcacctttcagtctatgagtagcccggaagagccccttctcccccagctgcgctgggggatcactggtctgcttttcggtccaggccatcccgaacgccttctgcttggtcccacccttggctgtgagactcctgccaaatgaccccactgccaccctcccaaaccctcctgccttggtgcagtctcattaggaacaggaaggtgttgccagccctcgtcttcctttccctgggaactggagatgcagtgactgtgaggacagtgggccagttcttccccagctcgtgccagcagagagcatccctgatgtggtggatggtggagcagaatggggtctcttagggggctcacgtggtctctgctgttgatccctggcaggtgaataaggaag

SEQ ID NO: 39662 - DNA, 1244 bp, Homo sapiens
agcttccggcgggatgttgaactggtcattaatgtgtcccctgagttggagctcattctgtctcttttctcttttgctttctgtttcttaagggcacacacacgtgcgtgcgagcacacacacacatacgtgcacagggtccccgagtgcctaggttttggagagtttgcctgttctatgcctttagtcaggaatggctgcacctttttgcatgatatcttcaagcctgggcgtacagagcacatttgtcagtatttttgccggctggtgaattcaaacaacctgcccaaagattgatttgtgtgtttgtgtgtgtgtgtgtgtgtgtgtgtgtgtgtgtgagtggagttgaggtgtcagagaaaatgaattttttccagatttggggtataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcacttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacttttctcgcattgtagaattgtatatagactctggtgttctattgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaattgggtgttaccattttttccttgatagtgagacgttcccgagcgagttacccatctgcctgcctgtcttttctttctgttaagtgactgaatttgggttttaactctggtgttctcgttgaccctttatgaggcagcactttcatttttctccagagtctcctggtcgtaggtgttaactttgggtccaatctgccttcccttggctctttctagatccgatttctttaccttctccaggccaacctcggggtgtggtcctgttcatcaaaacaatgaacatggagttta

SEQ ID NO: 39663 - DNA, 1022 bp, Homo sapiens
acatacactcacacacacgtatatatagtcatttagccactgccatgatgaaaatagagaatatttccatcacccccaaaaggttcttcatgtctctttgcagttaatacccttttcttctcacctccagaccatgcagttttagcttttccagaatgagctgtaaatgtaataatagggcacgtcaccttttgtgtttggcttccttcacttagcatgatgaaactcacccacttgttggatgtatcagtgttttgcttgttgttgctgtatagtactccagcatgtgaatgtcagtgtgccacaattcatacactgtttagctattcaccacttgagggacatttgaacggcttccttcagagggattctgatgcagatgctatagacatttgggtacaggcctttgagtggatacatgttttcatttacgttgggttaaaaactcaggagtgggattgttaggtcatatggtaagtgtgtgtttaattctatgagaaactgtcagactgtcagaccgttttccgaagtggctgtgccatcttgcgttcccaccagccatgtttgaggaatcctgtcgttccacattctcatcagtgtttggtgttgtcagctttttttttttttgagatggagtttcactcttgttgcccaggctggagtgcagtggcgtgatctcggctcactgcaacctctgcctcccaggttcaaacgattctcttgactcagccttttgagtagctgggactacaggcgtgcaccactgcgcctggctaattttttgtacttttagtagagacagggtttcaccatgttggccaggctggtcttgaactcctgacctcagatgatctgccctccttggcctcccaaaatgttgggattacaggtgtgagccaccacacctggtctggtgtcagctttctaaaagtcattttggtaggtaatggtattattgtgacttgacttttcctaattactgataatgttgagtatctttgtctgtacttaattgccttctg

SEQ ID NO: 39664 - DNA, 1046 bp, Homo sapiens
atgaaaaaaaatatagtagaagtatggtttacagtgctacaatttaagcacattaattgtgatccatggttatttactctacaaaaattacttagtgctaaattactaaaacttgctagcatttcccttttaaaaatcacactggattattttatcgtttctgctggtttttgttcatgttaacagctcatttccaaatatatgttaattcagtagaagttcataaagaacttaaatgctataatgctaacaaacccctgtatcagaggaaccagcccccaatatttcagcataggttctattttccataagtgttggccagctgagaaataaaaagagtacaaagagaggaattttacagctgggccgctgggggtgacatcacatatcggtaggactgtgatgcccacctgagccttaaagccagcaagtttttattaagggtttcaaaaggggagggggtgtaagaacagggagtaggtacaaagatcacatgcttcaaagggcaaaaaggagaacaaagatcacaaggcaaagggcaaaaacaaacatcacaagacaaagagcaaaagcagaatgactgaaaagggtctatgttcagcggtgcatgtattgtcttgataaacatcttaaacaacagaaaacagggttctagagcagagaactggtctgacctcaaatttaccagggcggggtttcccaatcctagtaagcctgagggtactgcaggaggccagggtgtatttcagtccttatctcaaccgcataaggcagactctcccagtgcgactgtttatagacctccccctaggaacgcattcctttcccagggtcttaattattaatattccttgctaggaaaagacttcagcaatatcttccctacttgcacatccatttataggctctctgcaagaagaaaaatatggctgtattctgcccgatcccacaagcagtcagaccttatggttgtcttctcttgttccctgaaaatcgctgttactctgttctatttcaaggtgcactgatttcatattgttcaaaca

SEQ ID NO: 39665 - DNA, 2077 bp, Homo sapiens
ctatgtttctttctagaaaggtattaagttattcataccagtgtgaaagacaaaatgcactggataattttatttacaaaagcatattctaaattgtaatgaggtatagatcgcttaagaggaaagggctccttatatattcagaaaataaaacattaataacagcaacaatattctcaacagaatccacggtcatccttgattagttcattcagtcctgtgtaattctttttccacttgatctttagttagcagtctcatgaatttatcttcttcttgattagagttctagaaatcctgagtcagtccactggtatcttctcaaagttgtttaaacattacatcagaagactgtactgcaaggtacctggcatagtccttttccttgggtcccaagacagctcttctttgttgaagacaggcactgtggcctgtagctgattgtaagtgctgtcagggaagcagcaaggtagaacgaaaacctatctgtaaatgacaaaataacttaaagtggctgtggttaacttattactataattttcaaaagtgaaagatccaatgagatttcattataagaataaagcaattaataaggatatttggttgtttctttgttgtacaagacaagattaaagtcattccaaaatttttttaaacaaaatattcatataaacataaggattctattttcaagaaagagtggctattccatttttataaattagatggaatatccactctttcttgaaaataagagttaatctttactgggaaataaaagtatataaatataattactgagaaaaagaagtttagatataacatatgatagttctgatatatgccaacaatataccaagcatatagttaaaatataccaagaatatcagagaaagagattctgtaagtccggaatatgtcctgaacatctatctgtgcttattaatgaaacatcataggtaagtaatgtgaatatccagttgaaaaccactggcctggaagatactagattcaaattaagttgggaccaagtcaacatttaaaaacaaagctgaaattatgacccataatgctgtgttgtctaatatcgaacaaagtagcaccaggactctgataaatagcagtgtatcattgtcagtgagagcactgacaattttctgttaacttctatagcaagcagagtctgaaatatttacaacattttacctatacacatttaacctagagaaggctaagcatttcttctgacttgacaactcatcaataacaacatgacagataaacctaattattttctagcacttctttttttaaaaggtgaaagaacaaatctttgtgattgtttcggggaccaccatctgggaaatctcaaagacagttttaggtgcaaatgatatttatgatttgattttggtaaggtaaaatattaaaagttgccaggagatttgaaaacttcaattaagataggatcgtgggttaccaagaaataatagatgactttatatttaacccaagtgacaataaatattttgaaagtaaacataagtggtaacatgatcgtcaagaaactttcctgaaggagaaacttgttccttaaataatcaaggacataataagttggcagaaaccataggttttcatagtaaaacagagaatcttgctgtttgtgcagataatgtagaaaagtaaagaataacttttacagtctattaagagcaaaccagtaatctgataaacatttgacgttgaaacagagaaaacacgattttagttttgtatcagtataacatttgatactaaaggtctttttaaaaaccttatttaaaaccaccaaacttatccagtcttgaccatgacaaataaaattccctttccatgaaccttctacaactttctgtattcaaaatgaacacattcattaatggactcaagacacaaaagtatataaactttttttttttttttttgagacagggtctcactctgttgtccaggctggggtgcggtggtaccatcatggctcactgcagcctcgacctcctgggctcaagtgatcctcccacctcagcctccccag

SEQ ID NO: 39666 - DNA, 1025 bp, Homo sapiens
tctggtaaacccataaagagtagaaagaaggtagaaaggcagaaagtgggatagagtggaaagtgggatgcagtgatgatatttattatataatatttgatataacttcagtctaccagtaggaacctttgttgggtagcaattgcatactcattttcactgggtgttttctgatatttctcttctaggaagctgtgatcttaatttaaccagtcttttgtcggactcttaggatgtttctgtttcttttactgttatgaatgaggttaaaagcattgtttttagcttaatctttatgtctagtcaagatgttttattagagtaaaatcctggaaatataattactataccaaagtgtgtgtgtgtgtaaatatatgtaaaattataatccattttattctttacagaattttacataccgagttttacgtataatgggagctgtataagcgttgacataatgtggtaatagatgaaacaggagctggcagttgaccaattatgtaggaccttgtagtttcccctctactttgtgtttaaatttttgtatgatatttattgttgtataatttaacaaagacatacttgtgtatattacatgtgtagcttgataaattgttcaaaagcaaatacagtgttataaagtttacctaagtgaagaaataaaatgtgagcagcatcctagaaaatctcttcctacttcttgcacacactaccctttctttcctcattatcctgacatttactgatattttacatctactactttcactcagcatggtgcttgtgaggttcatctatgttgttttggttgatggtggttctttcattcttgctactgtaaaatacttgttactgcaaaatgtgtaacattttgctcaatgggtataatgtttatacccattgtataaatgtatcatggcatattcatttttttaaaccatctgaacctttttttttttttttgagacggaatctcactctgtcaccaggctggagtgcagtggcacgatctcggcttacca

SEQ ID NO: 39667 - DNA, 1135 bp, Homo sapiens
atgtgtagatttttgtgagaggaatgtgcccactagaggaagtgacttgaaaacagtatagatttgcttttgatagcttgacgtgttataaattccttattgtaaagggtggtaatactagacaagggcattttgtgggatatcattcttgagagtccaaaatagtactgtacaagtgattttgcttttctggtgagtttgcatgttcgtctggctaaaagtgaaacccaaatctttgaaataccttatacccgtgttaagtctgtgattctgaattttagtagctgtatacatacatatgtacaatccccttggtatcagaggtggtttggttttgggacttcccacggatcccaaaatccgaaaatgctcaagtccctcatacaaaatgatgcagtatttgcatataaccaatgcacaacctcgtatgctttaatctcgagattatgtgtaatgccttatgtaatataaatgctgtgtaaatggttgttaatactgtatagtttggggaataatggcaagaaaaaagtttgtacatgtttaatacagatgtagtttttcttcccaaatatttctgatctgcagttggttgaattcatggatgtggaacccacggatatggagagccaactgtatatacttgttatttttatttttttaacttcattttttttttacacagcctggcttgctttaaattcattaacgataaacaacttggaaactatggaaaacacctgaagagaacttgagtttgcaagattttaattttttattctgacagccggattatgagcccttaggaggaacgggttaagcattcacataaattcaggaagatgtttacaacatgaaccagtgctttgtagctatattttaagagatttactttgaatattattttgattagaaatcttaaacatgaatggctggagtggtttaatttcattaaggacatatgttggtaagacaggattgatgtttaatttgtattgtgaccactggttttgaagtaacatgagtgaagaaaaaagtcctggcagtaccaacatcccttggtatctcatcccagggggatttgttccaggacccccatggacactcaaatccttggatgctccagtccctcatataa

SEQ ID NO: 39668 - DNA, 1030 bp, Homo sapiens
cctaatacaatgtaaatgctgtgtaaatagttgttatactgtatcttttttgtttgtattattactattactgttttagagacaagatctcactacgttgcccaggctggactcaaactcgtgggctaaaacagtcctcctgccttagcctcctgagtagcttgtattactttttattgttgtattcttatttttaatgttttttcaaacattcttgatctgcggatgcatatcccagggtttcagagggccgactgtataacctcacctctaattcagtggttcttataggagagcagcacatgagaagaggccacggtggggcgggggtgagttggacatgtcgggcttccgtaaactgcttcacccaccctccctccccaaattgtcttccttcctctccaggctcttcgtggtgattaactattgctactaatgaggattgtatcccttagatatgttatagcaagaaaagattgagaacacgtgccctacatcttatattagaactcatgttgaaaaaagacagtaatagtttccccagagttctgaattctcatctgagttgtagttctttggtttgaccaattgagatttcgctgaagaggtcatctttgttatagaagaaaagaaacacgaattcaaagtttataaggtatataactgaaagactttattagaattttgtgtaggttgtttgcttttcaaaaaatgaactacagaagcccctgttgttttaaattttggttcataagatgctaagtgttcatcagataatgaaagagtaacagagagcgaaagtgggacttcttcagtattggggattaatccaaactaacaaaagataaggctctacaattctaattaacttagtgggaaagtaagattttatttttattcccactttaggaacataatttctataaagggaggcgtgtgtgtgtgcgtgcttgtgtgtgtatgtgtgtgaatatgtgtacagtcccccactcccaggtttgttttagtcgttttatttggtatgtcagga

SEQ ID NO: 39669 - DNA, 1054 bp, Homo sapiens
gctgttgtttttactttgaattataatccagtaccattgttactgattttgttgctcaggctgttcttgttttagcccattggagctctttcagttgccttctgtgtcgtttgatatgctcccctcttttgttgtattattttccttttgatttgctttttgaatcatttcttactttctggcaccacaagatgctctgggcttgtcttgtattttccctcgttctgtcctaggatcagccatttctccaaggagctctggttccttttactggataattgtatttagaaatgaagatgtgggcactgggtgtgttcggtgctgttggggtgtcattgcttttaggccttctcagtgatagaattagaacgtacaggtatgtcttctaacctgtgtatacacacagatttataattccctatctaaaataatcatgagttcatactgatgtctttcgctctgattcagcacaaggttcattccgactttcctcccttgcttatctgtaacttacttctcttatagtgagaaacctggctaccattactacaattaattacatgtttgttcaaccctaccatacgtgtaaagtagtttcagaattgctaaccagtacccctgtgaggaataaatttatcaactagggtgtagtgtttcagtcaagttccttttgtctttagccttttatagtcaaaacactattctccaaagtaacttaggtcagcacctttttccttcaccttcctcagtgaggtggtatcatacttttgtaatttaattagattcatttatttcatctgcgttgcatcctgggatcctccaaaatcctgattgactttttaaaatgtgcatactctaaagttcactctgtaatatatagttctatgggttttgtgcaatttaaaatgttaaatacaaaatactgtaatatggttattttgtgctcctcctttttgatttccttatgaactttattttcagaagaataagatgaatatattgtaatgtaatgtacaaaatgtataattgtctgactttgttgcctcaaatactg

SEQ ID NO: 39670 - DNA, 1027 bp, Homo sapiens
cacaaaaatcacagagctatagattgttagagggattcaaattcaggattctgggataccagactttatcctacatggtttcgaaacctggctgcacctcagcattacctagagggcttttaaaaatacgtgtgcctagccattctgagagtaggacaagtcagaatctcccagtgggggacacgagcactgacattgtaaacaaacctcctgtgtgcctcacgtgaagctagaccagcaacagtgtagttctggtactcactggaaacactgattaggctccagtgctcttccgccccatgcctttaagatcatgctgcttaatacagttgttagagttaacttattacttgtttcaatcattccctgtctgatttcataagattacaagaactttgtaattgaatgacacactaacaagcacatacttgctcatttgcctttaggttttctgttttcttaaacatacaaacatacaaaggaaagtaggaagttgtgtacattattttggactatagtgagcaaaccgactcaaactgatgtaatatcacaggtaggatagaagtcatcaactttgagctgagaactggatcccgtgataacaacagcacaatagtaatattgagaagactagtagctagcattaactgaacactcgctacatgccggggcaaggaagagggctaagtaacttgatcaggtcacaaatctagaaagtggcagagccaggatatgaacccagagctctggctgtaaagccatgtatgctcttgacagtgtacagtctcccaaagttacattttgtcccacacagtgttttaaatattttttttgacttagtgtctaatatttttaaatgggaaaatccagattttgggttttcctagaaatactgggaagtctgtcaacactgggtccacattcccacatgaccagcagcataagggctccaggttaccacagtatccatcatttgtcttatggccacccaagtacacctgtttacatgacttactgggcctgtgta

SEQ ID NO: 39671 - DNA, 1029 bp, Homo sapiens
tgacactgagcctgtttttcatgtttattggccatttgcatgtcttttcgtttgcttatttattttgctcattttctgttaggctgcctttctattattgatctgttggaactatttatgaattttattcatttttctatgatggttgtaaatacttctttcaatttgccttttaacttgtttaggatacttaacactgtatagaaatttcacatttttatatagtcatgtctgttgttattttatgactaccttattttatttgtactcagagattattttaaaattttataattgtcatggttttctttttacactttgaatcagtttgcaaataatgtccatgtgttatcattgttcattatatttctaaagtgttttagtctgtagattccccctgcctttttttttttgccatatatgaagaagcagggtcatttatcctgtagggtctgaatttttatgattgtatcccagttgccccacatgtttctattttctgtgtcttctctgtgaattggctgtaaaatagagtggcttgatcaaattcaggattttttaattggttggttgtattaacactactttcccaggacacacacatatctgactatttgtgccattagtagtagttgatgaacattgcctagattccttaatacattaagggctgaaaagtgaggatattctaattctctcatttcttcttcatttattagcttctttattattcatttcatttattagatattgctataaggataaacttttcctcacctattatatggttacttagtggaatagttgacacaaatggcaagattaatgtgcttgattctttaccttttatttactattttttaaaataatgatgtggtttattgatgactaattagtgttattagtatgattttgaactcatgaatttaaacatatttggtatgtttcaatccatggatgtcattaatgtattgaagtaattattgtaattaatgttcacgtcccatctttggacaatgggaacatatt

SEQ ID NO: 39672 - DNA, 1035 bp, Homo sapiens
catagggaggtggtcactaggaggaagttgtataaggcaggtatctggatcagccacattgaggaactgggaggcagtgtagaactgcaccctgtgtcaagggtgacagagccctgcttctgctatgtgaaggttccacttagattcaaagtgcataccaaggcaacataaaattatgagaatttactatgcattttatccatgtccttatattattgaatcttcctagtttggctaggcttgatctggggttttacactgtgtttgatgctgtgctcttcactggaataagatgataacagatatgtgttcctgcactgcactgtccctttctccgctcactggttttattgtaataatttggaatgcaagatccaggccttttctttatagtgtacttaaaattgtgtttttaatatttcattctagaactcgaattgtagtcagtaaccaaattatcatcatatagttgtatctgcctatacagattgaaaatcccttatccgatatgcttgggaccagaagtgttttagacttcagctttcttcggattttagaatatttgtgggctgggcacggtggcttacgcctgtaatcccagcactttgggaggccaaggcgggtggatcatgagatcaggagatcaagaccatcctggctaacacagtgaaaccccgtctctactaaaaatacaaaaaattagtctggcgtggtggcgggagcctgtagtcccagctactcgggaggctgaggcaggagaatggcgtgaacccgggaggcggagcttgcagtgagccgagatcgcgccactgcactccagcctgggcaaaagagcaagactccgtctcaaaaaaaaaaaaaaaaaaaagaatatttgcagaatggataccagttgagcatcccaaatccaacatgtcagtgctcaaaaagttttggattttggagcatttcagattttgggtttttggattagggatgcgcaacctatataagttttgttaaatttatggcttttctctttgtttgctatttttc

SEQ ID NO: 39673 - DNA, 1024 bp, Homo sapiens
atagtaataatttctgcagttaattctagattattaaatcagttttagcagtgttcattctattttcactgtcttcttgagtttatttcagaagtcttaatttattattttccagaggactttaatgagatctcgtattagagtatttttattgttctctcctgttttctacattaaatcggtattaattgagcccagctgttctgattcttccctttagtctcctcttaaggaaattgctgtttcctctgaagtgctgaatttttgaaacatctgctcctctctgtctggacatgtattgacataccaagctcctccagcaggaagggggttcctctgtgactgtggaggtctggctgttggctctcccaggcaatgtggtcttgcacttttttgagaactagggattgtgcctttggctcattgagcccgtaaacaaagtcagcaggctgggactgtttggaatgctgaaagaattatttagaattttatcttagaaagtttggtgaattttatagagctttatataaacattgttttctgatatcattataccagaggcggtggagggaagcatttacagcgtctaaagcctttacttacacataccttaagctgttaaccctgaatatctgagacaggtctgttaatttagaaagtttgttttgccaaggtcaaggatgtgtgcgcctgtgacacagcctcaggacgtcctgactatgtgtgcccaaggtggtcagggcacagcttggttttatacattttagggagacatgagacatcaatcaatatatgtaagatgtacattggttccatccagaaagacaggacaactcgaagcagggatggggcttgcaggtcacaggtaggtaagagacaaaacgttacatttttttgaatttctgattagcttccttatgcatcgatctcagtgagcagagggaacaggatgggaggcaggtttaccctaagcagttcccagcttgacttttccctttagcttaatgatttgggggctccaaga

SEQ ID NO: 39674 - DNA, 1024 bp, Homo sapiens
ggggtgggggcggacaacgcaacactagggttcccgggaagcatcacaaaacggataactgagtcatgccaaccaggttgatcttaacgattttttaatttttctgtcagcatcgttcattacagctcaggggaacaaatggacagaagaattagtggaactgattagtttttatgttttcataaatggctacttaggatgagctgttatttgattttgtaatgttttctctaatttcagtaattctctggtttttttcccagtctagagatagttgtcgatagtactgtatataacctgaaaaataaagtgttctgatcattttaagtgtgaggcaaaaatgttaaagatgaacctgattctttttctaatatacttctttgatcaaagtattgcaatttggttttggttctcattatggtttccagcattcttagaactttttggatctatgttgaaaatgttgaagttattaaattcattaaattattaaatattcttttccctgtaaaattagaatttttgtagatttgttagcacattgtagagaataagagtttataaccacaaccgtagaacgttgtctcgtatgctcttttaatctgtgcctgttgaatttttgttatagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcaggtttgcttcaaagactctttaaaatatttagcaattattatattatcctacaggcttatcatttttattttgagagttcctttttttttcttaattgtcgcaaatagtgaaaaatgactgtttgtccatggttttaagctgtatattttaggg

SEQ ID NO: 39675 - DNA, 1236 bp, Homo sapiens
ggagcccaaacaaaatcagtgtttctattaggaaggaaggaaagaacagcaattgaattggcagtcaaattatgtttaacacccttgtctggaaacccaccgaaaacagcaaatggaaaaattccttcttcagagaaggaggaaattggccacaatatcctttcccatacccttccaaaaataaaaagacttagaattattcgccttgaaatgtaaactaaaatgaaggtaaacccaagctctaaatacgtgtccgccttaggcccagaaggcccacccagagattaactagagccttgatatctaggggtgtgacagccatgaccgaagctgagcctgtctctccagggattctgttgttgactgaagagctgcccgacagaaggagcgcgagctataccgcagccttctctggttgtcaggaagactgccgaatgggagctctcttagcagggggaggggaagcagtgattagcaagttatgatgcagaaattctgtgaccttgggggctttactctgcgttaggacatccactgtactcgaaaaactgagacacttaagcatgtaggtcaaaggaagtaacttggtgagcatttggaacatcaaatctaaatcaaagctgtgaattgttatctcatttcctgggtccctggcctcagaagtaaccaagacaataaacataataatacatgatgtaggaacatgtgacagccttaaggaaaccacttaaaaagatttataaggattgaaaatatgaaaatgataggcgagatgtggtagttgtagaagagacacaagagagctcacatgtacacaatttgagtttctgcagaagaacaaagagcaaagaagcagggaagctcttaagttttcatcctacagataattattgggtatccactgtgtgccaggcaggcaccatgcggggaccaaggaactagtgccgagcgtaaactccctcttagagtttaagaataggggggtccatggtgattgtagaaccatgtgaacaagactacagctgagaaaaatgccctcaggaaaggcacaggtcttttgtggactggttaattcgattcaactttttgtggaggtcaggcttctctgaggggggagcattgcaacttatcggaaatttatatacattataatccagtttaggtaacagatgaaaaacgtagaccaaacaatactatatattgtagtttctgtaataagagattgttttaaaaagc

SEQ ID NO: 39676 - DNA, 1028 bp, Homo sapiens
gaaatgtgctcagttcatgatcattgttgcctctggggagggaggaaagagatagaagtgaagagagaacaaaggagaaactaactttctggtaccttatttcttattgaaaaaaatatctacatgtaccccggaacttaaaataaaaattaaagaaaaatcaacaagaacatatctaaagcaaatatgacaaaatactaacatttgtttattctgggtgatacttgtagaatactttttagaatttttttagcctctttgctttttaacttataaagagagggatcaagagaagcccctttttggtagcaggtgcggtccgcttgggaaaggagcctggcaagagcaaggcaccgcaggcagcctgtgggggctccagctgcaggtggagagtaggctgggggtccagagcagatgtgagaggaacagttcaaggccattccaggaatgcacatgcaagtccttggattagagggggtaacatacattcagaaagaagtataaggattcaaaggaaacgtaggcagtgaaatggcaggactcgggtggatcaaatgtgaacaaggtgttgggagtgactgtgggtgtccagctcctgcagctgtgtgagtggtgaagatgtgagtccggtgaggagttttaaattgggctgagggcatttgaaagccctcaggcttgactttgcaaactaagggaaagagatgggaaaaaaatatatatatgtattaatatgtatatacgagaaaagggtgaggttcctcagacttctggaggagatgggtctcaaactcaaagcacaagctttgggattaggaggaacagtagttcctctgctataaagaagggaggaagagaggatgtaaccctgtaggtttgcatgtttgggaccaggaagattttataccaaatgacttctatttttgtgtggagaggtagagatcatctgctgagaatgggtggtggtgggtattggcagttggaggaaaatggggaagtttcaaactggtggctctagacagaaggaaagt

SEQ ID NO: 39677 - DNA, 1010 bp, Homo sapiens
aaacagaatgtctttatttgtaggaaaatttttactaatttttgactagttcccagtatctttgctcaattaaagactcaccaaatcttttgtttttttttaacctttgttactattgaatttcttccatttgttactattgaatttcttccatttgccattgtaatagctaggataatgaatcagagacacaaattgcctgagggttttttgttaacaatcccttaagttttgttttgtaagttctgtaagggaacttcagatctctccatttttactacttctgtctctcttgtttccccttattaataggaaacaaaatcatgaagaaacaggatttccatttaggataaaacctatttgggataaaacatatataaactaaaattattaacatgaagagaaactatgacattaaaaaaatactaaggagggttaaaacagagtggtaaaagtgaagaagagaaaagcatgttacggagagtaggcaaaatatgacgcatgtccactaatactgacatctagttattgggaaagtggaattatcagcatatttgtaatcactaggtaagatctctaattttaaattttatctagttttaaatttttattttaaattttattcatatttacctattaccagaataaaagaaaaagagaagaaaacatgctcttgaaaaaaatgactcagttaaatctacctgatctggtttaaaggaactgaataaaactccatgcactcaggacaatgacagtgacctcaaaggcaggacctcttgaaatgtcgccagtgaccacaatctttttaacgtgtagacaacataaagaactcctttttattagggagataccacattttcatgtatctctaaaatgggttaaatcatttgtttagcttacattatgtatgttttactccaggatttttaaaaatgttttttgatggagaaaactgttaatatataatagggctttactgacttttaaaaagtgacattttccataatatt

SEQ ID NO: 39678 - DNA, 1050 bp, Homo sapiens
gaatgaagtccctaaggaatccactttttgcacagtattctgttgtctgttactcgtgaaaagatgagtgtagttaaaatcctgtaaccccattaacttcttagttggtgcaatttttagaattgattgcaaagatagtttctcacacctacatcaaacacactaaaaattaataaccagaaaggcaaacaggttgcttttaaccattacctttcctttcagttgttctcaaataagcatatttatttcataaatcttaatttgtataaaaataacttcctgcagaaccagcatatccaagaggagattcaagtgggtccacaagaagaagttgggaacttcggacactaatcagccagagtaaaggtgagagaaagagtgttgaagttaaaaaaaaaaaaaaaaaaaaaacacgattacacataaggggagcagtttcaggtaaaacttgatttagcttctgaattattaggcctcctccattactattttgtgatctcacagctctgacatcactttctatcatgtactgtgtttgtgtacatttcctatttctagtaacaaactacatgctcctttgggtctataatatgttttactcatctttatattcttaaagcaacttagcataattttttgtccatggtaggagtataataaacatttgtgaaataaccattcataaattagacattgagggaaagaacttacgaagcatgtgattaatattatcaaaagaacaaatagcagaaaaatcattggtctagtatttaatgatctataaaatgctttcatgtctttttttgctcaacaatattgagcagtaggcaaaatagatgttctctttttataaatgatagtttctaagcagcccaataatttggccaaggtagtaaatgagagggtgaggaccagaaggcacttgtctcaagtctagcgcactccatggcagcttccctttgaactttgtgtgactgaccagaagagtatttgtcttccaaggcctagagatgtctggaaggattttgtggagggaggagactgggctgg

SEQ ID NO: 39679 - DNA, 1032 bp, Homo sapiens
aaaggaattattatgcagcaatcttaactttgtgtacataccactcacctcccttaaaattcagcagaaccagaggtgccagaaatgtcaaaaaatatctagtcattccaatatgtaaaacaagactgccttgttttaaaaaaacaaattaaatgtaaaaattgtatgactcttacccagtgaaaagctttactaacacagccctgggtgctatttccagatactgaaaagatctaagtaggtgcttaagaactgctttttaacccattcacaaccttcatattaaactaggatgaggctgcaggagctgaggaaggaaggcctgggtgggaacctggatgtcctttcctggagaacagctttgctatttcactggtaactccgaaacttcaaaatattgactgtacaaattactcaagtttattttggcctaattattcttaagaaaggtggttcttttttagaaaagggaagcagaagctaattgaaattccattactcaggcctctagtaagtgcccccttcatgtagtcactattcactgagggccatgagggtgaggccctgctgggggggcagggcagggctgtgagctcaggagcccatccctgtgctcagagagatgggactccaatgaggagacacactatgtaggtgcaatttctgatttcttagtttttgaccaaaatagcagtaatttcaaacagttgaatgtcgtgatcgatactatgtcagttggtgatgaatgctgtgaatggtattgaatgtcctggaccaagaggaacagcaacatgtccttagtcctcagcctaagaagtccatcgagtccttctctcaaattgtacgtctgttgttttcaaaagccattgtgacaggtcaaaaccctggagtatttggtttgtgtttaaatgtacttgacactctggaaacactcaacctaagccctggatgcaggaggcagggatgctgaggatgtgaattagagtgctgggatgtgctaatgcctagggaggcatcaggcactgtgctggc

SEQ ID NO: 39680 - DNA, 1045 bp, Homo sapiens
tagtgatttcaagttggaggcttgaaatttataccacaaaaatcagcagctaccgctcatcagagctccccttcccagagccagttgttatgtcacaggaaaggggtccccttccagaccccaagagagggttcttggatctcacacaagaaagaattcagggtgagtccacagtgcaaaacaaaagtaagtttattaagaaagtacaggaataaaagaatggctactccatagacagagtagccctgagggctgcttgttgcccatttttatggttatttcttgatgatatggtatacaaggggtggactattcatgcctccccctttcagaccatatagggtaactcctgatgttgccatggcatttgtaaactgtcgtggcactggtgggaatgtagcagtgaggacgaccagaggtcactttcatcgccatcttggttttggtaggttttagccagcttctttactgcaacctgttttatcagcaaggtctttatgacttgtatcttgtgctgacctcctatctcatcctgtgacttagaatgcctgaaccatctaggaatgcagcccagtagcttcttcaagctgaataggcgcaatgatattcctgcctaacttctagggtctcttgtgttcagggtagagaggagctcagtcagaaagcatcagtatggcaagggccattcatgactcttgagttccaataagaggtgatatctggaagattaataagtactcagtttaagaaaatgttgagtaagcttattctgcattcttactcaaagagtacagcagcaatatattctacaacaataaagccaaataagtaaaattatcccaagtaaactaaattagaaggctttccatgaactaggcaactgttggaaccaagctggtagggggttgctagatcattccagtacatgcccagaattagaacactgatttagatttttacattacccatccctcttgtttcttctgagcagcagtcagagatcactggttggtttgcaggaataagcacggttagcctaaattgc

SEQ ID NO: 39681 - DNA, 1036 bp, Homo sapiens
ggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaaggtgagcgtctccagggccccggccccggcccgacccccgccggggcggcccctttccccgcttgggatggtggggagggcgggaaggtcacggccgggcgggaccgagcgccggggggactgggaggccaggagggcgcacaaaggaggtgccgggccgggcttgcggcgggcgggcgggccggggtggacccgccggtgccggacgccccctgcccggccgggaccccgcgccgctggcgtccaagttggcgcgttgcggagggctgcggggtgagccctgcggcccctctagcttcggcggtcacatttccgagaggtcggcgggggctgcgcggactcggtggtcctcgccgagccctcccgagagcaggcccacgccgcgccgccggcctggaggacgcgtgtgcccggcgcgggccccgctcctccgctcggcctcccgag

SEQ ID NO: 39682 - DNA, 1034 bp, Homo sapiens
gagcaagacactcacttctgccctctgttccattttgtggcgtgcctctccacaaggggaactggagggaaaaacctggaatatttccatatgctaaaaatctgctgctgttgcctcaagttgtgaaggtaaagaagacaaaccaaatgattttttgctaattctgtgatatgctggttttgaacaaatgatggtcagattcttagaactagaatttatttttaacgataactttctaattaagaggctaaaagtgagaaagccatttttagaggatttcagctcattcacttctttgtaagcaaaggctagagcctcagttttttgaataatgtaaaaattgttgctgctattatttttactactcaagaggaaacatttttggctgggtgatttaatagagaagtatgctattgctaagtgattcaagttaggaatgtatacttgtatcagttttagatcagcctggggtaaacagcccaatgatatatcaggtagataactgaagagtgacacccaggaggtggatggttatgaattgaatggaaacggtgctgcaccagatagccaccaggtagctactatatcgtattcctgatgccagcatctgggggatgattgctcatttcaaataattcaaacaaattaaatgtaagccacagttctttgctatgttacagcaattatatccctttgatacagttgttacatggcaggtgaatacatttttttaagaaaaaaaaatttcaaactgggatcaaaaaaattaccctgaaaccgcatctaattgtctattgtcgctgattccaccgtggttgcagtgatgccattatcatgagagtattcaagttttaactctgtatgtgtgtgcctgcacatgcgtgagccagcataaagatgaaatgaatttatgtttttgtgcatatgctaatgagaccctgtgatgaagtggtaagcattcttgtactatagacctgggatctaatcatgactccgcaattaactggtttggtgatcttgggtgagataactaa

SEQ ID NO: 39683 - DNA, 1702 bp, Homo sapiens
tgcctttacaactcagttgtttgaagggtttttgttttggtgggtgactgagtcacatatattgagaggtatcctgtttgtacgttttctttgtaattataaagtctttaggcagtttatttctgtttattaaaataaatcagaagaaaatgtgtcatagtttactatatgttatatgaagagaaagttcttttggggatcatagttttatcatagtaataaaaaattatcagcagtaaaaaagatagtcttatctcacttttattatagtttatagcattacgacatactgttagcttttttagtaggtaaatactacatagattgctttaacatatgctttgcaattgttgaaatactgctcatttaagttccttcttagatgtgattcagaagtgtactttaatgtatttaagttatattttcctagttcagttatattgagctttttttttttttaaactgtcaaggcaatttaaaatactcttgccttcagtgacttgaaattgaactctgcacaggagagaagaatatgtcttgtttctatatagagaaccaaggaggaagagattgactttgccacctttgtaactgataataacttgcattttagtccctgctccccagccccacttttttccttttctgttattcctaaaatgtagagaattggagatcgatccacagattttcagttcatctttggcagtagcatggtttgtaacttttttcattcctggaagaagcagtggtgagggcacagagatagcgtagcacattgtctttgaaccttaatgggaattacttcttttcagggaaatatagcaatggccaattttgtctatacattttaagattgtttcttatagttgttagagattttatgagaagcttgaatttctttcagtaatcctaaagaactgttataaagaacttatttatcagaagaaatattccttattgggaaaaactaaaatatatcaattaaaaagttaaaagtactcatcatgcactgatagctgctcttaatgtttccttgtagtccccccccaccagtgtttatggatgtagcaaaattggaattacggtttttaaaaaaaattatatcatgagcaaaatttttccttgccatttcatattctttgcaaatataatgtttatagtaatatatttcatgctgtcgaggtatattataatttacttaactaatctgttggacttgccactttgctttcaggaaatgtgtgtaatgatagcattaagtggctttagaagttacttttttaaaagccttaagttacaaaatactgtaactgggaattatgaataccaaactcttatttttgcaatgcagttaatctgaaataagcattttatgttgcattgcagtagaaactggttgttaggatgcaacgtgattttcgaataatgtcagagttgcatatttcatgtattagtttttagtgacttaacatacttaattgaaacttttcattctattctaggctgtttggttgtatgctattaatatgtgtgcgatgttatgagggacacactaaagcttcaaattcattccttcaagttatctcagtagttggaaagaatatgaaaataagagtaacaaaggaaatagaaacataccaagaagactaaagactggtgctaaagagggtgtttttggctgaggaggctatggaatgtt

SEQ ID NO: 39684 - DNA, 1030 bp, Homo sapiens
atttggctgaaggaagctgtggcaagttgagaattcagaggtaaagcctttgtgagagagatgatgtagtttaattattttaactctagttctcctgatccaggaaagctttatttttactttcagatgaaaattaaaatttgttgcaatttaacgtgtaacacgaagctagaataaggtatatacataagctatatatgtatataatttaaatgatacaagtgatgtatgtatacatatagtacttatgttaaaattttactgtttttctgtaacaggctataaatttagtgtatcgattatcaaagtataattagctgaatataattatttgtttatgagatgatactaaattcagttcccatagatactggtggtgatttactttttaaaaagagtttttcttgttatgtgcttaaatccacacccgaaatgtagccataatttagttcaagattgtttatgccacagtctggaaaacacctgaagtaattgagatttttgagtggttgtgaatggattttagaatcatgtgttgaacagtgacatcactaaattagccatagtaatgttactgtttcacattgagggtttcaggtgtgatgcttttcagttttttgtttttgtttagataactattttagggtttgagttatagttatgcaaatttacattacggtaatgcaaatataccttccaaacttgtgtcaatatgtattagacgctaaaatgccctcccctcccatctctgtttccctcaaattattcatttgtggttaaactaattttaaactccggaaaagtggttaagccaaaaaaggtcagatcctggaagaaaaagctctgaccttttaaaaagagtgttggaaaagtatttgacggtcattttcataagctaaatgtactgtgaggtttgtgtttgagtagcttttaaggttttctggattatgtggttgaattttaaggaggaacttagtaaaaatgagttgggaaaattaacctgttacattctaccttccttttgctatgt

SEQ ID NO: 39685 - DNA, 1073 bp, Homo sapiens
aagttgagtacacagtatttgctagtggatggaatatgaagtgtgagaatggacttgacattgtgtcattgcccgagatcaggaggaacaaattttggggaaggcttaggagtttagtcttgaatgtatcagataggttgagaagggagttggtgataggatttcattgtggagggttggtctggaatgtccattaccagggtttttgttggattgtattagtaatatatattttttaaatatagtatttagcttctaatcagttatacttttacaatctcaacacagagggctgtattctgcattgaaaaactgattaaatttgctttccaagtatgttattatatgatagaatgtacacttgaagaggcagtaaaaaagtaataaatgtagatttgccagtagcatgacatgacttagattttctgaatctttgtgaagtaaaccaactgtggtttaattaaaggagatcatattgcttaccatattaaaataatgttttcaataccaattactttgacatttgaaggcactgtgtaatatgttggtcttgttacagaccaagatatttttgctgaattttatttttcgaattcaatgtcagtgcttgttgtagttccttttggaatattgtgtatagtagattgtttcttaagcctttaaaaaactcttcaccgggtacagtggctcacgcctgtaatcccagcactttgggaggccaaggcgggtggattacgaggtcaggagttcaaaaccagcctggccaagatggtgaaatgctgtctctgctaaaaatacaaaaattagtcggtgtggtggcgggtgcctgtattcccagctacttgggagactgaggcagataatggcttgaatccgggaggcagaggttgcagtgagccaagattgcgccactacattccagcctgggcgagactccgtctcaaaacaataacaacaacaacaacaacaactcctcttggctttttcataatatgagagaattctcttgcaacacctgtgaatgtcttttgacatgtattttctttcctaaaaatgtcatgaagtgacagaca

SEQ ID NO: 39686 - DNA, 1028 bp, Homo sapiens
aatactctagtaacttgctttttaatctagttgctctctgtaccttgtgaacttggcctcttaaaaagagcacagtgaagttaaattccatgggtggttctcagctcaaaaataactttaaaactttctctgtatttagtcaagccttaattaaagtttatttctttttacagaagagattgttgttaaccctaaattcataaggttacacaccagccacctctttatgaagtgacagttcttcagttttaaatagattactaatattattgttttaagatttaatgagtattatctaaataaaaacgagtaatttgttattaagacctaaaataactaaatcttactttgctgtttgtgttagtgagctactttaatgtctagcaagaggtagggattgcagacagtgtggaaatactggagcctatttaagcttcagatgaaagcagtcattttaacttacctcataaaatgtattttatgtatatcaaattatgtatgtgtttatatatacttgtcgttttactgacaactaagattttccataagttaatggaaaatgttaaaaagcacagttatggtcaaatgacacagtgaccttttcattcctttattagctcctgctctagtacaatgataaggcagattttgttgatggattcaaatgtacaaagaaacagcagatagatacccagtgaaaaaatatatatgtctataacatcagcattgcaagttgagcaattgaatcagctaccacaacactaagtataagatgcattttatgtgagtttttcttcagtgttttaaaactgttttgtttttttacaaatcctgaaagtaattctttggtgcattttggctttgaattttacttttcattaatattttgttgcttatgattgagttagtaaatagtttttgtgtttcatttcctaattttgattttcttagtttaaatttgctgaaaaatttctaaaccagaaagtaatatagagctgtatttgattctttggctttccaacattgca

SEQ ID NO: 39687 - DNA, 2033 bp, Homo sapiens
tagtcattttatctgaattttctgataacttgcaatagattcttttgttttttttttttctaagtttgataaatttgtttatctggaaaatcagtattttttcttccctagatttattatattactatggttacttataatagtagatttttcaatattgaactattcttgcactcagggtataaattctactatatcttagtgcatttttctttttctatttatttcagatgtttgcatctatatttttaagcaaattttatctatagttttctttcatgctgctattctcaggctttgatattagtgtggtgctaactgcagtaagaataggtagtttccgaagaagatatttaaataataattatatggaaagtgcttttttagtccagagacctggctaaaggatgtatgtgtgattttaattagattaaatttttctaatgtcccttggttaattacttgctgtaattatgtaaatgatgtaaaggagtttaaattgttgcttggttgttgaaaacttgatttgagaattgctgtcatatgctaatttaagataaacaccaagttgatactggacattattaggaaagatttaattatgaagctagaagtataaaaagaaccttaggaaataataaaattctgcccttatcatgtagtcaaatccaaggtaatctctagatttttgttgattttatttgctattcagagaaaagcatttcgtaagctttgacaaacaaattgttatttaagagataaaatttgtaatatgaatattggtatcactgaagcagaaaatgtattacagtgccttttttaattgattaagattttataactgagtaagagtacctttgatcctgcctttttgctgtgttggattttatttaaccgaaactgatttaaataactagttagaaaaattaaagagtgccttcatatttgatagttcctaaggaactatcaataaattgaacttccccatgtttggaaagcatacaaaatacatttaaaaaatacattttatttttaaatactaatggatgcaagcctttctcccaaggaggacacagtctgtaggatagagagacattacatctgcatctggctaaccttaataatgacaacccttattgggcagtatgttccaaaggacaggagcctgtcttctggtgcatactagaagcttaataatttttgaaaagatccattttctttatgggactcggctcattaaaatagaattctcctacttttaaaaaaaatgtctatgtatatccaagaacagtaatacaggtctttaaaaacaggtcattgattttaggtattgctacttccttttttatatttaatatttcaatcattaacccagtgtagcttgatctgttaccctctttcccttgaaacttctctgatcaccagtggcttagtggtcaaatccaaggtaccatcttttgctgtttatcttacattcttttgtagtattcgatactgttggtcaccctgtccttgaatctgtcatttcttagcttctataacacctctcttctctagttctcctgcctacctccatttcttcttggtttggatcttcttttccttaccccttcctttttctcaagtggattccgtccttctttctcccattacttgctctaagacatctcttctgatagctttaaccattaaatttgtatatgaaactcagacttctgctgaacttgcagtctgttgtcttttgaacatctctgtttggatattccaaagatatctaaaaataatggaagtggtcccgtttaaatatccttcggacaaattagttctgaagtacaaaagaggctttggtattagttttgtctgacaggcattcttatagttgtttactgaagctatgatttggaatgactggcctcgtttagacttggaaaaattagatgaactaacaagtccatattataccggttaggaaggagctcgggctttgaagttaatttaataagatatgttatttgattcgtataaaaattggt

SEQ ID NO: 39688 - DNA, 1075 bp, Homo sapiens
acagtcttctaagtcaggacttgagtctagagggcacctgttcactatattcctttccttcctcctccagttgtgacttcttgccacggtgaactactattaccgactggtgtgttggagcatggcatttgtcttgatcggtgattctcaaaacacagtccttggaccatagtatctacgctttctgggaactgtaaatgttcaagcccctttccatacttattgaatcagaaactctggggtaagggcgaggcctagcaatttgcctgttaagccctgtagataattccgatgcatgctgaagtatgagaatcactcctctaatttttttttttttttttggagaggggacagggtcagccaggctgacaggtaggtgatcatgtacctggtcattttgccaggcatcgtttcaggaggcctgaaacagtaagtggtgaagtgatgaattaaacagtgtcactggtcttgtggagtggacatttcagtgacaaagacaaacagtacacaaatgaatctatagctgtaatcagtgttatggagaaacataaagtggggtagacagatgaatagtgactgtgtatggaaggaggtattcatttttaagggtaatcagggaagaaatctgttacaatatgatgggaatggagagacaggaacagaatgatgggaggaaggcatgaaaaccatctgggagaaaaacattctaggcagagtgaacagcaagtacagctgactcaggcaggaatgtgcttgggaagtgttgtaagatgtgaggttagagagttagcacaggggcagtgtcatgccgtggtcaaaagtaggaactcagattcagacttctagctagttttgctgcttgttttgtgactttggtactacacttgatcttaaccaaaaggccaggaagtgatgatgttttgtgactttaagcaaattacttttcattcctggtgttcgcttttctcatttctgtaatggagatattaaacctctcacaagattatgaagactaaagagttaatatgagtgaagcagttggaaaacatctttatgctatgtgtcacaagctcta

SEQ ID NO: 39689 - DNA, 1027 bp, Homo sapiens
taacaaatgtgtgacatctgatagagcaggcactctgtggtttttgtgattacacataagaaaaataatcctgttcttgaaggagttcagtcttgtgtgaaggataaacgattaaattattgaagactttaagtttctcatgcattcatgaaactacagacatgaaagaacattgaagttatatttagaccatcaaattgtttatttggctggtcaggttttcttgtttgaatccatggagatgtgttataaatgattatgaatagagttaactgatttatttaagtaaaaagtgttatattttgaatgagtcagtaataattttgtcattaaatttgcctagttatcaatttcaagttgttagaaattgttctataggatctgccagagtagtagacttgataaatattggcaaggtctagctgttgatgatactagtcgtcctgttaaatacatgaacagattagattggtaaactgcttcctttggacatgatgattaaattgtagtgagacttcttggagttttatgtgaatataattctgattttctgatgtttttaaaatgggatttaattttgactaatagctttgaaaggcatctcttgggtctaggccatcatgaatacccatattgtcaaaggttttgtaagacagacaaatgtcttttcaaggattgtgttttcagcctgtaggatcccagcctggttgctatagttagtagtttagattcataatgttattcacagtacactccactgtctctcttataataatacatgttgatgatggaacacgagttgtaagttctctttctgtttcattttcctgggtttgcaaatcagcttaggctcgtcatagcttctgagttagttagcatagggttgttgtttgtcagcagtcttgagaagttggtgtcaaattgggtgttgagctggcgtttgttttagagggattatggggagaggggccaattcagtaagttatctttccttaaagtctttgttcctttgaccattgcggccttc

SEQ ID NO: 39690 - DNA, 1035 bp, Homo sapiens
gctaataacagaatcttcctcatcctaacccctcagaattgtcacacatgaaatgggctatgaagcagtcaaaggttatactgcttgaactcttccactcatttcagttcctgtttataagtaggtgacctaaatttattttgtaagttaatgagactatgttttcttttgatttcagtttgggcggaaaagtaccttagtttttgagatcacgtgcctttactttagggatgttgaggttgagtttttcagctactagcttttgagataaattcagttaatcatttcattgggaaaaaatacatatatatttaagtaatttttgttttgttttatcttagagacaaggtttcactgtgttgcccaggctggtcttgaactcctgggctcaagcaatcttcctgcctcagcctcccaaagtgctgggattacaggcgggagccactgcgcccagccagaaaacatattttatgtcttaataaacccaggatttacaacaaggtagcttacaaataaattggggatttcttgaaatcttgttttgtctgccatagaacactgcttttcccaagtccaaaatcagtgtcatcaataagcagcctgtctatcataaacttgggcatctacttgtttcatattggtataatattttctttattatttggtagggaattgattgactttgaaaacttctatcctgtattgtttggggttacagaacaatgattgttttgattagtttctttgtacttttaagattgcatataaatagtataaatttgccatgttaaggacagattaaaacaaaactcttaaaatttgaaaagtagttagaacttgaacactaaaaaggatatctgaatataaaacagcaaaattttggtatcatttcttcatcctggaaatgtttgtgtgtggtctgtgctaggtaacaggacacaggaatatgaaaagatgtaattgctctcatggtactgatatagccacaatcctggtatggaataatgagagcttgaactcaggcaatggcagttg

SEQ ID NO: 39691 - DNA, 1470 bp, Homo sapiens
tacccacctcttaagctgttatcacatggtatgcagtgatctgcctgattcttgcaggtcattctctgaagtcaggaactcgctcttagtcttttattttttagaaatctatgatatctcgcgcaatacatagcccatagaagaaactatgtagtgaaattacatagtgatttttcattctcgcagtaaaaatttcctgggattttttttttttaatgggtgggaaactacctggaaatagtggatgccagagtcttaaacagaaggaatgaaataataaagatcagagcagaaataaatgaaatagaggccaggaatacaacagaaaagttcaacaaaacagagttggtttttgaaaaggtaaacaaaattgacagacctttagttggactaaccaagagaaaaaaaagtcaaaatacatgaaggagacattacaactgataccatagaaataataagatcataaaagactactctgagtaaatatatgccaaaaaattgaacaaactagaagaaatggataaattcctaaaacatacaacctatcaggaccacatcatgaaggaacagaaagtctgaacagacctataatgagtgaggagattgaatcactaagtcaaaacctcccaacaaatagaagcccaagagcagacagcttcacgggcaaattcctctgaacatctaaagacgaattaccaccaacccttctcaaacttccaaaaaactgagcaggagagaacacttcccagattcattttatgaggccagcattacccttaaccaaagccagataaggacattgtaagaaaataaagttacaggccaatatccttgatgaacagttgcaaaaatcctcaacaaaatactagcaaactgaattgaatagcacattaaaaggagcgtacaccatgatcaagtgagatttttcctctgaatgtaaaaatggttcaacatatgcaaatcattaactgagctacaccaaattaacagaatgaaaaataaaaaccataagatcatcttaaaagatgcaaaaaaggcatttgacaaaatgtaacatcctttcacaatgaaaattctcaacaagtaaggtatagaacagtatgccacaacataataaaggctatgtgtgacaggcccacagctgacatcatacttaatggtgaaaagctgaaagcttttcctctgaggtcaggaagaagacccttgctacttccattaaatatggtaagttctagccagaacagttaggccaagaaaaagaaataaaggcagccaggagtggtggctcatggctctgattcccagcactttgggaggctgaggtgggcggatcacttgaggtcaagagttggagaccagcctggccaacatgaaaccctgtctctactaaaaaatacaaaaattcaccaggcatggtgatgcatgcctgtaatcccagcttgctcgggaggctgaggcaggagaatcact

SEQ ID NO: 39692 - DNA, 1708 bp, Homo sapiens
agtgttgtgacattgttttaattgaatgaagctgcagaactggcgtgataaatcaacacagaatgaattttaatgcaaggcaaacgatattaacctggaaattggttgcagtagacaaagcagctgctgtgattagttttttttttttcttcattctctacttacaacattttgagaaggatgacctcgacaatttcagctgtactagagtcctgatggcttgcaccttaacatccttgagctgtttgtggcttcttggggcaatagtgattgtttcattttttaaggttagtaaaattttttaaggttagtaagattagtaaggttagtaagatttaatgtgattttaactgctttacaaatatttttaatttagtaaatcataattgtgaggattaattagctgtggtagaagcccttttctatgtaatcttgatgtggttccagccaaggagggttaatacttgaaaagcatggggtatgccaaacaaggctctatatgtggtcacagagtgtagggcagctggtttcacaaagggtacgggtcaaaaccaattacatattagtgatttgtactaaagtatctctgttcataatgcatttttccagacatttttgggccatatgtgaagtatataatgtgtatctagttagtgacaatttgggaaaagatctgtatagagtacaactattattgaagagtagctggcaaggttacttaaagaaatagccaaggtaacaaatatagtagaggcattttcacagacttcttgagagcagagtttcgttattctcaatccttcacatttacttcactccttgccacataataagccttaagtaaatgttttgttgaatttgaaaatgaaaggctgttctctgttttactgaaaaacagtgggtgagtgatagcatgtaaagattattatctctgtccaggttggaggagtggggaagtgaaatttaatgtaatctgtgacttacataaactggttaagtgatgatgttgtagaaaaaagtaggaagagcttattggagatgaacataaggccaggcatgttgatagattttctgttatgtttcttttttattcagatcctcatttcaacattgttacaccatactaccttatgtcaattctagacctctttagattaaaaagcaactgctcaaaaagtgccagtagacttgtgtttgttaaggactgacaagataatgcaggccagctgagcaattccaggaaaataggatacaataggaaaaaaaataactgaacacatcagagattgtgaatcagcaagattgtgaagaattactagttcatggtcttcaggaggtgagatgatcaaggatataaccgtgttttgggggatctctttttctgctgagcacgtttgcagaatctggagaggacagacgaaaggctgagctttgggggatagcgtttggagtctataatttgtctatgtgaacctcccttgccatgcccagcctagtcttcgcttgggggtagggacactgatggatacgtactttaggagtaagaatgaactaggaggttgcaggtcctcacagagacagtatctcagctcaaaattgtctatctcagtaagtgaaattgcattgatcctgggttgctagtaatagtaggtgcctggcagaagctgatatgtatctttcctggaggaagatattattgtctttggcc

SEQ ID NO: 39693 - DNA, 1039 bp, Homo sapiens
ttacttttatgtaatgatatactaaaagttggataaatgcaagaaaaaagtagaagaccatatgcataagaatcagtacctatttgattgaataagtaaatgaaaaccacctgtggaattttgtggaactgatagcaaactcttatattttggcctttatgcagataacatgcaaatgaggaaaatttacttttcacgatttagcccgtttttcctattggctttaaagaaataacttgtatatatgaatattaggaatttctgttgagggatggtaattttttatttttttattgtacagtttttaatttatacaattattgatatcactggcctatttagtgatattcagagtttaggtttcttataagttaaaggtagaaaggaatatgtactcttaagacacatttagtgtagccaacccatagttttcgtaacatatttctgaacagttgctttggagaaagtataatttttcttaggtaaataaaagaggactttccccaaaggattttggtagaaagggcagtgcctaacaatttcttcaacactgtcatgacaaagagacagttggacattttgtggaagggacttgtattcttggctggcatctaatattttgtcaaactctttaatactctctgttttaggttatttgttgatggacagttgtatctgttctagctgtatactgttcccagttcatagtttgtgttaatacttgtgaaaatataatgctaaacgatgagctattgtaattagacctgagacttagcaagaaattcataagggctctagattttatttcaacttagtattaaaaagacatttaacttcagtaagtaaatgtagatatactttatattttaagagctgtaagttccagcaagtgaataatgtatagtgatccttttttttttttctcagtttaattttgttgggagaatccttggacctagaggacttacagccaaacaacttgaagcagaaaccggatgtaaaatcatggtccgaggcaaaggctcaatgagggataaaa

SEQ ID NO: 39694 - DNA, 1611 bp, Homo sapiens
atgaagtcttgacaactggcagatatataaatctgtatgaaaagattagtatatattcatcagttaggctattctgtcagccagttaacaaaacccctttttccctgcttctgagtttctgtgaattctgcagtaatggccccccactcaaccttgcttactgtttcaagccctcacagacaatgagcattagagcttataactgtgtgattatactgttgcactcttataagtgtttataataaaagtaaagtcagaatggaatgcttggccatttggtaaagaacatgaaaagagatggaaacaaaaagaagtattgatgtaagtaataaagatagctcattgagatgtatttcaggagttcaagaggaaaagccatttgctttaaacttttctacagagttgtccatgtatatatagacatgtgtgtatatatatatatgtgtgtgcgtatatatataatgtgtatatctatatgtgtgtatatactgattgcctgttttacttttaacacaaaatgctacgatgggaatggtgtgtgctggtctgaatccttccctacactggtaaactcagtgagagcctaccatggctattctatggagtattaatttccttggtgtttggtgagtacctggcacagagtgcaggcacttgaaaaaaatacctgtgaaaggagtgactagttcaggtaataaatgaaaggcttaggtgtaccttccctcatgttccccgaaaaggttggttaaataaagaaaattgtaaatgctatgtacttctaatgctttggggaagttagtactatattattctaagctgctggtttttagcaagtaagttaatatgccactttagttttcattttcttggattgttattatttcagcattattgatgggctcaacagcattgatttagtgcataaatacccagtggaatggtactagttaagatcatggaaccagggcttgaaaactattatgaacttcttgtctgtaccagctattttgtaaatgaagagaccaaagccttggggaggttgagtaatttgccaaaggtcacacgccaaaatgtggcagtcaaatttgaaactaggctgggcacagtggctcacacctgtaatctcagcactttgggaggctgaggcaggaggatcccaggagttgaagaccaacaaggtcaacatagtgagacccccatctctacaataaaacttaaaaaataattagccaggtgtggtggcgtgcacctgtagtcccagctgctaggtaggctgaggagggaggatgcttgagcccaggagttgaggcaacagtgagctatgattgtgtgccactgcactccagcttgggtgacagaacgagactctgtctcgggggaaaaaagaaaaagaaactgaattctgagttctattctgtggtacattattttctaattataaaccatttctaagagtgataacttcagacatactagaacaacttgaatattgagtattagaaactttgactaccatttcacacaccacccagtacacttgtgaccccagatgttgtaagggtttctccccacaaaccaaacaaatctccagaaaacaccatctgaatgtcc

SEQ ID NO: 39695 - DNA, 1105 bp, Homo sapiens
tcatctcaagaaatcactttctctgctcatccataagaagcaactcctgatcaagtttgatcatgcagttgcagcaattcagtcacatcttcaggctacacttctaattctagttctcttgctctttccaccacatctgcagtttcttcctccatcatactcctaaacccctcagagtcatccttgagggttggaattaactttttccagactcctgctaatgttgatattttgacctctctccatgaatcatgaatgttcttaatggcattgagaatggtgattcctttccaggaggttttcaatatactttgcccagatttatcagaggaatcactgtctgtggcagctataggcctatgaaagacatttcttaaataataaggcttgaaagtctaaattactccttgatccatgggttacagaatgaatgttgtgttagcaggagtgaaaacaacattcatctccttgtacgtctctaccagagattttgggttaccaggtggattgacaatgagcagtaatatttggaaaggaatctctttttctgagcaatatgtctcaacagtaggcttaaaatattcaataaacctttctctgctgacatccaggctttgttgttccaattgtagagcacaggcagggtacattagcctttttttttttttttctttttaagacagagtctcactctaccgcccaggctggtgtgtagtggtgcaatctcaggtcactgcaacctccgccttctgggttcgagcagtcatgcctcagcctgctgagtagctggggttagaggcatgcaccaccacacccagctaattttttgtatttttagtagagatgcggttttgccgtgttggccaggctagtctcgaactcctggcctcaagtgatctgcccaccttggccttccaaagtgctaggattacaggtgtgagccactgcacctgtcccatttagcataatttttaagggccctagtatttttggaatggtcaatcagcatttgcttcaacataaagtcaccagttgcattagcccctaacaagagaatcagcctgtctttggaaggtttgaagccaggcattgacttctctctagc

SEQ ID NO: 39696 - DNA, 1049 bp, Homo sapiens
ttgtttcccaaatgtatttggccatagtctccccttttttgaagatgtccctataactccttgaagaactacagtgttttgtggaacatgacttacgaaatgttattagagtcatattgtataattgcagacataggtggaattcttgaattttgttttgcaggacttgtttaggtagagcatttaataacttcttttacgtgatgcttttcatatacattacaaattgttaagtatctcttatagcagagatttcttagctctatttgttatgcttaaaatatattttaattggtcaatatgttatatttttagaaaagtgagaaagtcctagagggtctcaagaaaattaaaggctcctgacattccattagtttagacactacccttgtttatagtttggtatgtcttgtagattgttcttcatgcagttatgcatatgtacacgtatggtatattaagtggatcatattatatttgctgctttataatcaacatttttttcctgcaactctgtatcctgtcctatgtcagttcaccgaatagtagagctttatgcctaagactgtgataggtgataggaaagtacacttaaaggacatttcaaggcagcattcatagtgatatgcaaaaataaatttccttgaatttttgggtgggggaacttacaagattttattcttatgaaatatgttactgctgtgtcaacactttgaaagagagaaattaattcagtcttgtgattgatacaccagagtggctttggcaattggtggcatgacatcaagtacaagtagggttccaaacagcctgttttatcgatcttgttgaatacttagctctctgacaagctctagcatggatatagttttttttttttacgttttcattatgcaaaattttaagcaatggaaagacaagtagtgtagtgaactctaatttacccatcacccagggtcagcattgcctctctcctttcaagagggaactctctcattccccattgcctcacttcaccttttgcctcccagattattttagaatcaaat

SEQ ID NO: 39697 - DNA, 1943 bp, Homo sapiens
tccatttctttttttttttttttttaaacataaacagttatgtaacagttttgtgtgtgtatctgtgtataatttctcactcttcatagattattatactctcagcactttttaatacctttattatttattttcacttaatagtatattgtggtcatttaatgggagtgtataaagaatagcctttattcgttttttttttttttgccgttacaaaaaggtatagtgctgtgttgaaaagtgtttcttgaagttgctagtttatgtttgaatagaattgtagaagcaggatcgtgtgtggttttattagttagtgctaaattcctccgtcttagggtgatggtttgcgttaccatcagcagtgtatgagagtagcagtttccccccagcttcacaaaactttgctctgttgtgcaggagattgagcatctgttaaaggcactttcaaagaagttatgctgtgtgtgtgtgtgtgtgtgtgtgtgtgtgtgttgtgtgtaaaagtcattactgttatgaacactgttaccaccttcagtttcccaactattgtttgtagtgcgttttttaatattctgactgaagcagtttataaataatggttagacttacttgaaatggtaccattacaacatgtcttaaggcacactaattgtaataacttctggctgggcttaagaaactacttcttaaatgtttttaagtggaaatatgctttgatttttctgtaagcttaacaagcttttctcagctagggttcctcatctgaaccacagaaaataggaattatttcattttattaaagatgactcatcaagagaaccattatagttacacaggagagaagttaaccacatataatttttatgtcttgggctgggcattgaaatttgattctcatgtggaattcttagttgagaaaggtgtaccctgtgagaaatggtttttttctcgcattttatattactgcctctccatcaaaccatatatatctccccctcttccttcagcctcccttattggtaccatttgacgagatgattagggagtaggaactgttacaggttgtttgttagagggttaatcttacaaattgtattcttatcaactttcatgaatccaattgaatagtagaattcgctatgaaaacagatgagttgctttagaaaagtggcaatgaaatgtatactcttgtataacctggtttagagggaaccttattaagtcatcgagtctaaaccatatttgtgatacttaattccatgatatttcagtaagtagtactataaatgactgttagtcagttttcattaccttctaccatagttaatttaatacaatctgcggcagcagttatgtttttgaatgcctgtgattttttaccctcaaggaactttcacccctggaagactgatatattgacagtgaactgatgcagcggagatgatatatacattgtgcaggaagtcaagaagtaatgtgttctttgaaggttgaaggtttttaaaggaagctggagaagattgaagtaggagtttaccaggcaaataagtaaaatggtattctagacatcagaaatagaatcaaccagggtatgttgctatgtggatgcttggtgtgtctcagtggaaggtatggggcacagtggagtgttggtattggagataaggctgaggtctgaggataaaggaccatgaaccttatatccaaatttatttcattttgaaagcagtgcattgacactcttctcttttaaagatgagaagttatatgatgtattaattgttttggaaaggtaacttgacagtagtggaagagatggacagaagtgggaagtgactaaaggcagaagacaaatgatcaagtctcacacaactctgcctagaaagttctttcttgtgttaggataaaatctttgaaacttcagtcctctgatcttaatc

SEQ ID NO: 39698 - DNA, 1042 bp, Homo sapiens
gtgatatggtgttgaattcaacttcaaaagtggtagattggtttgtttttaaagagaaaagaagacccgctatccttttcagtgcttttcaaactgtctgtggtaagagacccactaaaaaaattcaatccattatatcttttggtgaaatacaataaaattagttaccagagaagtggagttttaaaaagacatatatttaaccccatttaaaactgtcttttatcaagagacataaaattatcctgtcagaatgctcaaagagtttctgaacaggcttgatttctgtacttgtaggctgcacttccggccgcactggtttaaatgccaactgtgacgtggtatgtttgtttcaggattgtaaactagctccctggtgtccctcctcctctacttttgttcttctcactccctcatttttttttattttttatttttttgctctgtgtttataaaataaaattcattttagattattgactagattatttttaagtttgatttctggttacatgttcattaaggactcaaatggcttagctttgttttaagatagaagagtacaaaacagtgcaataaagattaaatgtttatttccgggttgataatatctcagtacatttatagagtggagtcactgctttttgcccattgttaagaaagattgggaagacttgaaataaaaaatttatttgaaaatacatttattaaaatttgtgagacaccctttgagaggtaaaaagatggacccaataagaatagacttttgtttttattagtaaagtaatactttaacctgtaaaacttcatctcattactcagccatagatataactccaggatgagttaattgcccatgtctaatgaaatgagacgtgagtctcagtgaaaagggagagtccattttatcactagatgctcttaatgagccttttaaaattaagtcttgattggattgcagtcaatttcgttaaggaatatttgagcatcttgtagttgtgtcttatgtaacattttctttttagaggattcagctctctgt

SEQ ID NO: 39699 - DNA, 1049 bp, Homo sapiens
tagttgtaagttctttctgattcagaatctagtccagatcacagattacatttatttgccctgtctcttacagtgtaatttggaacagttcctcagacttttcattatcttttataatttgtgtgtgtctttcttcatgactagattcaggccatgcatttttcacaagaatgttttaaaaagtgatgttgtgtccttctcagccatcacattagcagttagatgatgtcaatttgcctcatttttgatgttgataactgatcatttggttaaagtagtgtgagttatgtattgtcaccgtaaaggtaactttttctccttttaaatcatatctgaggagaaatactttgaaactttgtaaatattctttcctaacaaatttaggattgtaatgtcttttgtccaattttcgtatcattccctttacatttgttagttaacatttaattgtaatgaatatattgtctgacatttctaataggttaagatctctttcagtattacatgtattcttgcatatcccattcgtttgctgattttagagtctctctccttgacttttacactgcttgatatctttacttggttagatggtgatagtagtggttgtggtgacaacaataagttgatgttattgttaagggcttcaacacactgagctttgatttaggcattgttatcagtccatgtgaattaacccatctagtcctctgaaagccctatgaggcagttattgttctaattttatagatgaggaaatgaagcattaaggaggaggtaaagtaccttctgtggctggtgagttgcttggccccaagatatgaacccaggctggcttgagtttaactactacattgtgcctttcctctaagtagtcttctgatttccttatttccattcttccgcccttttctcttttcagcaaccagagtgaatttaaagaataatcttctagcatattttaatgtattcagttagagtcaggtctttactgtggctaaaggccctacgtggccttgtagcttgctcctccctagagttttctactc

SEQ ID NO: 39700 - DNA, 1050 bp, Homo sapiens
tctaaatatacaatgtaatgtttatatttattgtttgcttttgtttccttacccaggctgtcttcttcaggagggactaatttatatttccaatttcctcaatgaaatgtggacataattggtgcctactaaaaaaattatgttcttcctacagaattttacaggaaatttcttattttctgacgtagaggagcatcaaataatgcatacacttagaaatttaaataaacaactgaataagacttaaattacagaatagagaaaaaaccaacaaatactttatgaattagttggagtcgaagttaaggaaagttgaatgtaaaacctaaaagtaaaattaattgctaagctagaggcaatatgtgagcatattttgcaaagactttggtggccatattaggttttcaagccacgcccacacacataactgacaatttttgatacttatgaagtacaaattctcccctccaatgtatgcgtgattctccatagtaacacccacatgtagcttctgatagaaacccacaaaataagatgaaaatagtttctcagtcaaatggttggaatatttagtaatacttggcagtattttttattttgttaataacaggtgtcatttaatacaatgacttttaaattatatattaaaagaaatttttaaaagttttatggcaagctgtgaaatactcagatggataatgtgaattaaggcgtgttctttggccactcaaagtgctccccacccaacactggcatggactgctcactaggtggccaaaagagatttcgtttatggatgtgttttgaatgttttaacattaaaaaaaaaaaacccaaagcatttgaggcagagatttttttagacaatagttgtttaatgagctgcttgtacatacaagagaagagaatgggcctgattgctcacaatctgatgtttgaaaagtatttttctggatcttatgcatttgcatatctaattgctatgtaatcaaaactaagtgaactgtagctacttgaaactctaaaatgaaaggcaatcatcttacgggg

SEQ ID NO: 39701 - DNA, 1012 bp, Homo sapiens
gaaagttgattacatagaaatttttaccctgatactggtaaataccttcataaagaggaaaataaccattttttttgctccttcccccttcttaatttctttatattacatatgaccatttaataaaggggggggggaatagtattgtcctgtggagtttttgattcttgtatgtgtacacgtggacgtatgtggttacaggtttctacatattatgtgaaacagtataatattgattgtaagtaggccttgaaaagttaaagatttgtattgtatcccctatagcaataactgaaaaagcaatgccaaaaggtatatgtaaagagcctttaagtataacttaaaaactgaaatggaattataaaatatattgaaataatgtatatatagatatattgttcaaagtccggaagggaagctaaggaacaaaatacagaggctacaaatagaaaaacagtagtaaaaatggtagataaacacctaatcattcaaaaattccattaaatagaaatggaagaaccacttcaattgaatgaaagagattgtcagattgtcatcatggattaaaaattaaaagcaaggctggctgtggtggctcaggcctgtaatcctagcacttttggaggccaagatgggccaattgccctgagctcaggagtttgaaaccagtctgggcaatatgttgaaaccccatgtctactaaaaatacaaaaaattagctggatgtggtgatgcgcatttgtaatgccagctactcaggaggctgaggcaggagaatcgcttgaacctgggaggtggaggttgcagtgagccaagatcgtgccactgcactccagcctgggcagcagagcaagactctatctcaaaataataataataataataataataataataataataataataagtaaactaaaaagcaagccaagtgcagtggctcatgcccataatcccaacactttgggaggccgaggcaggtggatcacttgaggtcaggagtttgagacca

SEQ ID NO: 39702 - DNA, 1050 bp, Homo sapiens
gaaaatattttggaccgagtgattgtggaaatgcaagataacaatttatgagatgaagctaaagcagtgtttggaggaaatttatatatttaattatgttggaataaaactacaattatctaatttcctacctaattaaacatttaaagaaaacagcaaggtaaacccaaggtaatgtaaaaaaaggaaataataataaattcttgaaatagaatacggacaactagagaaaaataatgaaactaaaaagagttcttggaaaagttagttaagataaagctctaattagactaatccagaataagagagaagacactaattaccagtatatttaataaaataggagacatcactgtcgatcatatggacattaaaaggccttttaagagaatatcataaacagctttaagccagtaaattagacaacttagttgaaaaaaataaattctttggaaaacacaaattattacccaggagcaatagaaaattttagtatccctatattgattagagaagctgaatttgcaattaaaaattattccaccaagacaatgtgaagcctaaatggccacactaataaattttatcaaacttcaagaaagaaatattgtgaatcttatgtaaagtcttccattaagaaaaaaaaatgagaatacttcttaactcattttattataacaaattggtaactaccattgttactgtgatactaaaattcaacaaagataacagcaaaacaaagaatcagtattcttcatggatatagatgtaaacattttaaacaaaatttgagcaaattaaattaacgataaaaaaagaagatactgcattaccaagagaggtatattttgagaatgcaagtttagttttaacatcttgaaactaatcagtgcagttaatcataacaatagaataaaggtgtaaaactgtataattatatctaggagcaacagaagtatttgacaaaattcaatacacaaaaatgataaagcttcccagcaaacttagaaggaaacttcctcagtttgataaattcgccttatgaaaaga

SEQ ID NO: 39703 - DNA, 1085 bp, Homo sapiens
acatattttatttcttgccatacagataaccctgaggtttccagtttcttgattcattgactccttggtttcccacttagtttgcatggtgtaccctagtcaaaaagaaatatttcagagttctgtttattaaatatttactctacaaacaactttgaaacagactatacattttatttgtaaataaccacatttttactaatagcatttgtattttcttgggtgctgttcaaattctcaaactttggaatcagatttttgtactgccaccctcttttcttgttccacattgatttttgtatgttcttgatttttattacagcaaccgctaacaacctagctttgtaaagatatgacatcatcaaaaagaatgtaatgtgaccttatgttgaaacagtcagatattctgagctggtggttcacacagtgtcggacagatggtacccctgtaaaatgctgtgctgactcagagttcactctttggaaatacatagatggcccagcataggattgtgtctgattttttttttccctgtatccccttacaatatgtggatgcattttcatcctaaagatgtgttgattaaaaataaagcagaagcatttactgttaaaatttatttttagccttattggctaagctcaatcatgtgaattgttgcagaaagcagttttattatgcctgctttattttcttttactggaatctaacaattaggtaaatagtaacttctaaaataaaggtccaaaaacagcagatatttattgtttgtctgtggtaccttgctgtgtgccaggtgcatttatatttaccatttatatactacttatatattcttattttatttaaaaacactttctctaaaacttaaaacagcgattctgaaattatgccaactctacttaacctccctgtagcttaaccaggttttcaacatggggatatttcttactagaagacattaaggaaatgaaatatagatattctctatgaaactagtatttatgacttgatataattaaagagtagccttacagttaattttaaggtatggtctgatgggaatgtagataaaactattttc

SEQ ID NO: 39704 - DNA, 1047 bp, Homo sapiens
tatcacaattcttcccttgttttctctgtagaatgatacttgttgcctaggactcatccaccttccttccacctttttctctcctgccctggctccttcccatctatatcatcaccaagttctgtctgattctacctccaaatagcacatatcttttctccatctccacagatggagtaggtctgttacccatggtgctccctcctatccattttctacttgaggccaaaactatctttttaatatatagaaatgtcatcacactccttgttgtaggttttcagtgactttctatcaccccatggtaaaaatgtatggcattcatagcttatcttcatctaacatgtgcctacttttccaactttgtttcatgtcattcctcctttacacttacacccacacatattaaataactcacagttttcagaacactgtttgtttacgtagtgtattttggcgatctccagaaagaactccgtgatttgtattctgtactaatattatagtagaatgcattgtctatgatagtggtgtagaattattagaactgaatgtttgtttgtttgtttatccccttgcccctgactgggcatttcagtgacatgcatgaagtctgtttcatcttagtatctctccctcactgccttgcacatacatagaaagtgatcagtgtttgttgaattaatgattgaatattagtcctttaacaaagcacttgttgtttgcttttcatagtaaaaatggaacctaaaaacacattcatgtaaaatcttccacaagtcacttacccctttttgcctcattttttaaatcacctcattaggttgctctgttctaaatcaattaatatctatatatgtgtgatggtcatacacatacgtaagcctacccaaaactattaaattttacactttaaacaggtaaatattgtggtatataaattatggcagtaaaactgttttttaaaagattgtaatagaacatggtcagtttggtaaggaactgaaagaaggtatgtgtgaccagagtgcagagtgagagagattg

SEQ ID NO: 39705 - DNA, 1031 bp, Homo sapiens
aagagttttaagaagtgagccaggtttattttcattttgtcaatatcactctggctacgaggtgagagaacatcttaatgggccagagtggatgtgtgaaaggagacccggaaggtgacagttgagttagaactgggcaaaataagcagttatttaagtggtaatatagactggatgtggtgaatggtgattgactagaaggtatcgtttgtaactccagaattctgacttgtataactggatggatagtgctgtattcactgtaattatagaatatggttgctgactgggtaatttataaagaaaagaggtttaattgactcatagttccacatggctggggaggccttaggcaacttacaatcatggcggaaggcatctcttcacagggcggcaggaaagagaatgagtgccgagcgaagaagatttgaccagagaaatgtgggaggagaggccagagaggttgaggggggggacatgaggttggtgatgatgaaatttgagcagagccaatgtctcattttccttagcagtcctggaggggatatgcaggaagtatggacaggaaagggtaggaaaaggcttgtgaacatcccagagaaagtgttctcctgcactccagtgctgtgaataacttaagactcagtaaaagaccaacagctagaaaacttacttcctgaaaacactgcgctgggcatggtggctcatgcctgtaatcctagcactttgggaggctgaggcgggcggatctcttgaggccaggagtttgataccagcctgggcaacatagtgaatccccatctttacgaaaaatacaaaaaattagttgggcatggtgacgcacacatgtaatctcagctactccgaaagctgaggcacaagaatcatttgaacccaggaggtggaggttgcagtgagccgagatcgtgccactgcactccagcctgggtgacacagtgagaacttgtttcaaaaaaacaaacaaaacaaaaacatactacatggtgttctttacttgtctgtggttttta

SEQ ID NO: 39706 - DNA, 1086 bp, Homo sapiens
aataagcagcatgaatttataaaagcaagaccagtatgcgtgagagttcttagaaaagcctgcactcaggagaatcgcttgaaccagggagttggaggttgcagtgagccaagatcacgccacagcactgaagcctagcgacagagcgaaactccagctcaaaaaaaaaaaaaaaaaaaaagcctgcactctgagagaaaacgatgatctgtgttattgaggaacacataggatgcttccaataggagcctaacttggagaggaaagtaccaggtctactcggggattgtggacagatgattttgactaatgcaaaacatttgcaagcaaggttgctcatgtaaactgttcaatgccctgaatgctggagaatttgggcctttgtgataggcagtggttcgaattatttttttagttgacatagttttaatgatttggaaatacacatttgtttcagctctctggtgattactttgttgtagtttttttttaaaagtatatagatctaaaaatactaaataaacatgattttcttactttctaacatgtggtctgatgaattcaaaagatacttccacttaaaggcatcataagactggagaaggtataatgtaatggttaaacatgaggactttgaatcaggtattctgggttggaagccaggtttgcaatgtgaacttttgtggctttggataagctgcctaccctgcctgagcctcagggataatgcactgccaataccacacatttgttaggaagcgtaaatgattggataatgaagatctagtgtctaagtctagaaaagttgaacaatgtataaattacattaaacgtgacctgtttgtatccttttaacatagctgttaaacatagttgatgatggctgggcacagtggctcacgcctgtagtcccagcactttgggaggccgaggcgggtagatcacctgaggtcaggagttcgagaccagcctgaccaacatggtgaaaccgcatctctactaaatacaaaaaattagctgggcgtagtgacatatgcctgtaatcccagctacttgggaggctgaggcaggagaatcccaggaggc

SEQ ID NO: 39707 - DNA, 1026 bp, Homo sapiens
tatgagattgcggataatcacttgagttcagtattacaaaatatgattttaatgacccattttacaaatgtaaaagttagtgttctgtctctgtagagttgctcattcccgatcaaggttctgcaggatactttgtgaactatctggagttgacatgtacaacttcaggatgccctgtttgatcagttgtaatttttgagaaaaaaagaggtcagaaaaactggtctgaagactggctcatagaagctctagagcctctagactgtagaagaaacttagttttctcatctgaacttatatttgaaaaagaggtgatatataccttcaacagtgtttaggcaggtacgtactaccaaatctcattgtcaaaaccaggacagtaacattgaaataaccacttcgatgtgaaagtaattctataattaaccctgttgtctcttctttttttttctttttctttttttttttttttgagacagtctcgccctgttgcctaggctggagtgcaacggcgcgatgtcgactcactgcaacctccgccttccaagttcaagcgattctctttcctcagcctcctaagtagctgggattacaggcacctgccaccacgcccagctaatttttgtatttttagtagagacagagtttcaccatgttggccaggctggtctcgaactcctaatcttcatgatctgcccacctcagcctcccaaagtgttgggattacaggcgtgagccaccacacccggccagtgaaccctgttgtctcttaagacacacaagatcatgccctgtgaatacagagtggaggggagtggtcaggacatgagggtgaagcccatcctggactgagaccacctagaatcaaattccagctctgccaactaaatcctgtgcatttctgggaggcattagtgtaccctgccaaaatgtggctgtgatctggtgtaacataccatcacctccagcaacaccatatggcagactacaccaggatctcctcctatgccactcttatttttattc

SEQ ID NO: 39708 - DNA, 1024 bp, Homo sapiens
ataagttgaagttttattataatggatttgattcttcttttccaatagtagcttacttatttcgtttttaacaaataatttctgtgtctttctaagatcatacttactttttgttcatctttgtacaagttgataggagtcaaattctacaggcatgccagtatccactccctgtaatcttctgcaaagtaggtttttaaaaagttggcagtagcacatcaaaacattgtctttatgtttcactcatatttttctttaattcttgtgatttactaaaagctcactgaacagttctgtttactatatattatagtataccattcaccattgtaatgccaaaaacagaattttgtgtgtcattacagctataatagaaaggagcactgagaagcctgtgtcctggtcgtccttcccgttttatgaatcagagaggaacaagactatgtcagaaaattgttgcattgtgttactttcattgtaaatatcacaaagtcatgtaaagttactgggattcgatgatacataaaagtggggggcagttagttctatctctacacagactttgatagatggaccctcatctactgcttgctttgactgtggctaaagtttatgttggactgagacatttgggatttggaaataaagttaaagacttctcataccagtcacttataagttctagtaagtaacttgggggtggccgtgggaacatggggttaggcagtggtaacaaagaaataagccctattctcatggagcttactttgggagtggtgatactcaacagactgtaatttgaagtagaagcaattaactttgtcgataggttcttggagatacaactttaaacaaaatgagtatattgcagcctcttttttcatcaatgttataatgaaaccatgttgaaagcagtggcattatttgaggacctgctgtctgtcgtttcacttaaagttagttttaaagaatgtattgaccacattaagtgaggatctactgtaatctagggatggcccctgga

SEQ ID NO: 39709 - DNA, 1049 bp, Homo sapiens
ggtaggaggatggctcgaacctaggaattcaaggtggctgtgagctaggatcatgccacagcactccagcctgggtaacagagcaagaccctgtatctaaaaacaataaaattaattaaagtaattttaaaatgatagatgctgaagagaatatgttatgtttagtcttatctcacattttcattcatttctatttaaaagtaaagctttttaggggaactttaataaatcggtgtaactgacaaaaaatttacaaatacaatatgctgtatatcaacatgcctttactgagaaaacagagaaagcaggctccattatgttagcaccttttggttcttgatctttttttccccttattaaaacaggtgactgtagtcacatgatacttactttaaggcttgtgtgtagatatagctattatatttgtggacagtctcaaatgctttcatctcatgtgttttccatgtataggcagaaggagaagacagcctgaagaagatgcagctgatggagcttgcgattctgaatggcacctacagagatgccaacattaaatcacgtaagaatgagctctgaggcccagggttactgctgtctgcgttgttttgtctacagacttttttccttttggcaacacaataatagttcatacaaagtgaacagttgaaataactgttctgtcacttgatatggggctgacagtcctatttttaatgctttcatgaattgaggacactcttgattttattttatgtcagcatgttgaagttttaggttgataaacttacattattttaacaaaatcacaatctctaaattcaagtgtttaagaaattttctgtttggttaactacagatgtagggcttgcagcttatcttgttaaatttatgcaaaagacaacatattgaaagcttattttgaaaaagtgaatttgaagtgtatctgactgaaatgaccctctgttgagttctgtcctttcactttgcttgcatgttttccctctagtatttttccctgttgatttcatatgtgagttcacagagatcag

SEQ ID NO: 39710 - DNA, 1040 bp, Homo sapiens
ttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtata

SEQ ID NO: 39711 - DNA, 1026 bp, Homo sapiens
gcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaa

SEQ ID NO: 39712 - DNA, 1048 bp, Homo sapiens
tttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaa

SEQ ID NO: 39713 - DNA, 2051 bp, Homo sapiens
atcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatag

SEQ ID NO: 39714 - DNA, 1028 bp, Homo sapiens
aagttaaacattacacttttgttttcatagtggttacagttaatatgaagcctgtaattatgtgtatttacccatagtaataaacttagcaatgtctacagtgctttcaagtcaagaatttttgcacatgattatgtccattaatctccctcttccctcagcccctgtgtcatgttgatattttaattctgggctgttatgaatacagtcattttccttttttgatctgttaaattaaaacttggcctgaggctgccatagcttaaatccctgagtagggaagtataaactggtttagtaggtaaacaaactgaaagcctaattaaggagtattcttcgtaacaaacagctgagtgtcagccgatctgagcagtggccttcagccaatcacaggcttcctgctgatcagtccgcatccaaatacagcaaacacaaagctgaaatcattcacacccattctgcacctcacttcccttttctgtctataaactctccctgcccactccgaggaggagagttttctgaattgccactggtttattgctgctgattcatgaatcgtccttcgctcaattaaattgtttaatttgtctaaaaacttcttcttttgacaggtcctataataaactttacctaggtattcagttacccttaatttttatgtcttttgtataaatatcctggatttgctgttttctcatttaaaccttcctttaagagtgttttcaacatgtggcaaaattttggaaatatatgaatgagaatattgttattatactttcacatttaatgacaatttgattggataaaacttttagtattcaaagttcttttcttttaatattttaaaaacattctactgtttttctcttgtaccattttgctattgaggagtccacaatcagtcttactcttattcctttgtagacaggatgatgatataacttatcattcaactaggacactttggagcgtgaaggggatactagtaataattacgcttgtcagtgggtgtaacccaggactgt

SEQ ID NO: 39715 - DNA, 1125 bp, Homo sapiens
ggccgcgtagcccgcgcgcggagcgtaccctgctgcggccgttggccgttagcgcggcttcggcggttgtcttggagaagcaagatggcggcgacggcggccgcagtggtggccgaggaggacacggagctgcgggacctgctggtgcagacgctggagaacagcggggtcctgaaccgcatcaaggtgaggccggaggctggggccgggcctggcggatccgcagggcttgcgtggacagcgggcgtcacaacggtcgcggcgaggaggccgcctccctggcgagggaccggggccggcgggcactgggggcgcgccccggcatggcctccgtcctgcccgccccacagagggggtcggctcgttcgttcgtgtggtcccggagggcaccgcggactgggggtgcctggcccatcccctgcctcattccgtgggggcgggaccgcggggcttgggggccacacgggcggcccgcagctgggccctggagtgcggccccagcgtctcttcctcaggctcgggcatgatccgcggcgggaaagcagcgcgtccagccgaagcctgggggtcggagagcttgtgtgactgagaacgtttcggaaggcgtttctgacctttgcacctgccctcccagctcgttggcttgctcgtgtttgttgctggataaatgtgagcttgttgtgaaaattgtcttgaaattataatttcctgtttcttaacttttttttaaggctgaactccgagcagctgtgtttttagcactagaggagcaagaaaaagtagaggtatgaagtttccagattttaacatggctgtattcgttaatacttaatttcttattcattaaaaaccgtcttaaaaatagtttatagtaacatatagctagggataattttgaactgttaaggattacattactattgagagagagccaaaattattcttttttcgtgtagcttttgaatttgggggtaatcttaaggtaccacagtaactctgatactaatgcttaatctgaaacaaatggtcataggagtttcttgaagaaatggtgccattgtcaatgtgttaagtgcaggttcactcagatcctttagtaagctaatatgttattaatccctatga

SEQ ID NO: 39716 - DNA, 1054 bp, Homo sapiens
ctgtccctccattctcttaaaatatttcagttgactccctatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaaatgatcatcacaatcaaggtactgcgcatatccttcaaacttttgaccttcaaaagttttccttgtgccccttatgtaaccctctcccccaccccaaacctttttaagaattatataaatggaatcgtatagtaggtactctttttttttggtctgtttcttcaacataatgcatttgaaattcattcatgttgtggtatgtattaataaatcatttcattaatacattgtacagatatgacagtttagccattacctgctgacagacatttaggctgtttccagtttttgagtattacaaataaggtttctgtgaacagtcacatacaagtctttgcttggatctgtgatttctcttgagaaaatatgtagaggtgaagtgactaggtcacatgctaggaatatttgtgacttttaagaaacactaccaaattgctgtccaaactcgttatgccattttgcattcccatcagcagtgtatgaggctgccactgtagcagcaattaatgtggtcttaaggaagcttaccatgtgctacctactgtagcctcttctcagcaacaatcacaggcttgatggtctagaagtattttttccatacttattcaaataaatgtataattacaaaaataagttggcctatgggccgcataagatcatctcacatttcatggataaactgggaattacaagtgtataattaaattcctgttcatagtaagtatgctataaatggtagatacctgagatgacaaaacttttatcaaacttcatgtatttgaaataataaacagttgttgacatttaattgtatttcacacaggtatttgaaaatatctagcttcaaaagca

SEQ ID NO: 39717 - DNA, 1047 bp, Homo sapiens
aaaactatttatatagcatttacattgtattagatataagttagacacgatttgaagtacataagttatatgcaaatatgtcatttcacataagagacttgagcatccttggattttggtgtccacaggagagtcctacaaccagtcccctgtggatactgagggacgactgtgttagtattactgtttcttgttattgtatggatgactctttaagttcagtgtagtctgcctaagctcagctcagtcctttatcctagctccagactagaatttccagctcttcacaaaacatacctccctggataacccaatagtatattcgaatcctgtgtggaaaaacttactttcttctctttacctctaaaaagtaaaaacataaagacaaaagcaaatcccaccttactccccgcaaataaccctcttcaagttcttcttgctcacttctgtgttttgattgattctattcctgtgactccttggtttcatcccaaggagccacctcttcacatgtgctctggattcagttcttctgtcaggaaggattcactctccaccttgcaccccgtagctttggtaacaggctgtggaagaaagaataattgctggagggctttctgttctctgctagataggagtgtacctcaaaatgagacccagtagcatgcctgtgtagtgggtgtgatgtgaaaatggacacagaatcactgttcttcagtacttcattctgactcgtggatttgaggcctcccctgaagtttgccctgactttttcatagctgtgattctgtcaaatagagccaggataggaattctgtatcctcaaaaggtagttgttttactcccccaagttgctgaaccagtaagttgggcatctcatctccattttttgctagttttcccttcctaatatctggatatttaattttaatagtttgtgcatatgtatataaacaaatagataaaatatttaaaatagagacctcaaagatgtatgttttggcccttcattatttattagtgttttctattactttggaagaaaac

SEQ ID NO: 39718 - DNA, 1129 bp, Homo sapiens
tgcacttgatctatctgatgtacattctccaccaaagtcaccagagggaaaaacaagtgcacagacaacaccaagtaaggtgagttagctgtggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaaggaatgtgctggtaagtaacagaatcatagaatatttggatttatttggtacttcggacattttctcctattaacaaggagatttacttacttttcatttataaattcctagcttgagaatattaagctagaaatatgtattataggatataatattgaatgaatattttagacttctagatgggtgatgagattcagaattgtaaatcatgatggtttttaatatacctgggctgttttgatacaatttctaagaaaatgtatgtactttggttacatttgtgtgtgtatgcatgtgtgcgtctgtttgtgtgtttatgagttgttaaaggtaagacttgatttcagagattaagcataatgggaaaaaaaatgagctctacactttgaatttaagatccaggatatgtaggaatggatagaaagatgattgtcaggaaatttgttttctcaagagcacagcatgaattggtagtcccaggcggtcttaccaaaggataggttggggtctgtcttagtctgttcaggctgccaagtaccatagattgggcagcttacaaacaacacatttttcctcacagttctggaggctggaagtccaagatcacggcatcactgtggttaggtctggtgaggtccctcttctaggttgcagagagctgccttctcattgtgtcctcacgtggtggaaagagggtgagagagctctctggggtcagggccctaatcccattcacaaagccttcacccgcatgatctgctcaccccgcaaaggctccaccttctgataccatcacattgagggttaggatttcaacataggagctgggggtttgtgg

SEQ ID NO: 39719 - DNA, 1496 bp, Homo sapiens
tcatttctaaccaaagaaacaactattgtattgtttatagttgctccttctgagatttctagttggtgtagggaaggcctttttttaaaattttttttttcctaaatactcataggaggctataaccccagtgatagagtaaggtcatgagtaaatttttaaaatttctttaaattaattgcaaataaaacagcctatgtaagtaagctttacttttcatgaaaatacctggctttagaaaaattaaaattaatgaatattccaaaatacttatcagtacctatagcatttgactatttggaagctctttttagcaaattattactgtttttaaagcaaattagcaatcctaacctatatataatgtatgtcttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagatagtccttgtgtagggttgcatctgttctaaaataaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacccaacctttaggaaccagctttgtgtgctcctgagaaaggtcagatgaggtcaggacaagtcttcaaggaagttgcctaggaactcaagtgaggcttatttagaatgctgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtataaaggacaaggtaagaagaagacaagcgggcagaaggctggtgacaaggtaacatgcatgagggcagaggagaaaagcagcctgtgggcatcaggtctcgactctggggcctcctggagcgctgggctcctgtcagattgggttctcagttttcttatgaaatgtcacttgaggctgggctaggtggctcacgcctgtaatcccagcactttgggagtccaaggcgggcggatcacttgaggtcaggagttcga

SEQ ID NO: 39720 - DNA, 1056 bp, Homo sapiens
gaaagttattgtgtgttaatgctttgggcaacacatttaacacagttctcacttaaggagtttatagtttaattggagagatgagacataccttaagtaagatataaaacttcttaatagattttaaaaatcagtttcttgggcttttctaaaatttaaaagcatattttatagtattaagcttttataatcttactgctattgtgggtttcaaacaacttaaacattttcaagaagtttatacatagagccaaggcatcctaagagatgtggttttcactttgtgtgatgtgaaataactgtgatgggcccagactttagctttcgcggtactttgggcagagtgtagtgtgtgccctgacttgagaggggattgaagaatctaggtgggcccatatcccaggatttagtccataatttgggtctcttctatttcattgttgtgttcctgaggccaggatgcttcctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttggg

SEQ ID NO: 39721 - DNA, 1144 bp, Homo sapiens
ctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaatgttacaacagtttgatttatgcttttttgactttatgatggtacaaaagtgatatagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacacatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagttccaaagcagattgtttcagaatttatttttactccctggattaagagaactatatttttaaaataattctgttatgtttacaagtatgtgttgtgtaatatagtaatgcccttctccgtaaaacttgtcttcctaaaactggtctttctgtctatagcgggaatattggtcaaacct

SEQ ID NO: 39722 - DNA, 2509 bp, Homo sapiens
gctcagctttgatactagatagttcattatgtggatttaagttacattggcagtgtgaattcttggggaaatcagaataattattgtttctcataatattgctttacatttacatttttcagtttctgtcatgccagttattctttggcactttctcatgagtgtttagaaggagagaatctgtcgtggccacaggctgtgtcattgtacatatgtttaaatatcacatcagggtatttatttccaaatgcatattcttttaaaaagacataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaggagcgtcttgttcggtaatgtctaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccatgtatggtggctcacggctcacgcctgtaatcccagcactttgggaggccgaggcgggtggatcacttgaggtcagaagttcgagaccagcgtggccaacatgttgaaaccctgtttctactaaaaatacaaaaattagccaagcgtggtggcacgcgcctgaaatcccagctactcaggaggctgaggcaggagaatcgcttgaatctgggaggcggaggttgcagttagcccagattgccccactgcactccagcctgagtgacagagcgagactctgtctcaaaaaaaaaaaaaaaaaaaaaaaagattatacgactgggtgtagtttgtgcttgtaatcccataaacccagctacttgggagactgaggcaaggaggactgcttgagcccaggagttttaagaccagcctggatgacatagtgagagcctgtttcttaaaaaagaaaaaaaaaaaaaagaaaaaaaaatggagttaataattttggactacattccagattccttgtttcagttgagtgctttttctattattccacgggtattttacacaatactgctctctttagtatgcaaggctgaattttgggaaattgccatttttaacccataaagcccacaaattcattataatttagcttaatagcataaatattgagttaacctctggaagcaggctttgactttgatattgacctgaccacttaactctctggagactttgacaagtgacatcaatgtctgtctctgtgtttcctgatttatatccacagatagaaagccatctccagatcctagggccattttcaagattcagtgagataaggtgaagcatttgaatgttctccataaatgtcagctgcttttattattactagcattattttttgttttcattattattattaacatagacccgtctaagggcagaaagaaatctgaccaagaatggagtgaaagtcggctgtgaaggttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaatatgagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaatggtattaatatatttctctaatatttttccccctttgaaagtttgccatgttaggaatcctggggatggagtgatgaattgtggcattgctctgcagttcacgctgctgagagctgccccaacacacacacacacacacacacacacacacacacac

SEQ ID NO: 39723 - DNA, 1437 bp, Homo sapiens
ataagactcatgaaaataattaacagtctatgaattcatacctaacagggctgtttatggaaagtgatgtcttataatgaggcaaaaaatggtttttggtggttgtgttccaataaagtagtattgtttatggtttaaaaagggatgtagctgggtgcagtggctcacgcctgtaataccagcactttgggaggccgaggtgggtggatcacgaggtcaggagttcgagaccagcctatccaacatagggaaaccctgtctctactaaaaatacaaaaattagctgggtgtggtagcacatgcctgtagtcccagctactcgggaggctgaggcgggagaatcgcttgaacccagaaggcagaggttgcagtgagctgagaccgcgccattgcactccagcctgagtgacagtgatgagactccgtctcaaaaaaagggttgtgatgcatagcttaagcgttcattaatcacagtttattttttccttagttttaggttattatgctcctgtcataaagaagccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgctgatcgttttaaagtgattatttttagggtaaggctgtaaaagaagtgactccgtctgcctacgctgagcaccttcctgctgctgctcattcagcaggtgtttgaatggcttttatgtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtacatgtataagagagaagggaagatatttcagttcagactgagaaaaatttgggcagaggcagagccatttgctagatgctggtagtacatggtccaggcctcagagaattcagtctagtggggaaacagacttattgaaagaaaaattgtgagatgtgttcagttctgttctatggagcagaagttggtaagcctgccatgtaagtacattcattcctatggaagtaagagtgtcgatgtgaacattaccgagccctgggccatatgttgagagcacatttctcattcagtgttctgttctgtgcaagactgtagcagtgtgacaggcatactttaggcaaactcatttatgtaaaggc

SEQ ID NO: 39724 - DNA, 1293 bp, Homo sapiens
attacagatgtgcgtcactgctctgggctgcactggtggtttttcaaaccaccgcaccctcccccacctcagggcctttcacatgtttcctcttggaacacactgtccccagtaatttgtacctctgcaacctaggtttccactcagttgctaccttggagttcttcccaattgcactagcagtatttggtttgttccactgttcctcttcactagagtgtttgctccctgagatcagagataccatcttagtcattgctatacctctaggggacctagtcatcactcagctggttgataaattaatcatatgatttggctgtaagagaattacattgtctaactgtctggacagagcttgaatcccctcagcagtctgaccgatttagagacagtccagccttatctgagggaagatcgaggacaaggcccgcagggtctttgaacggctctctgtcatgccaggtcttctttttgtgatctgcatcttctgcatgtggctgtacatgcttcctgggtctttcataggccatccattcacattttaagttggctctcatgtgcctccaagtctgctttgaggctgacaactctttttcctcatctagccctcagaagtcctgggagggaagggctgctgatttgcaaatttgtcctttatagccttaagttgatctgaaggtgccccctctgtcagaggcttgtggtgcactttgagaaactggtaacactgcctcactattcaccatcccaccttcattcagttgccttttattaagatcttactgtggaccaaggtctctgttaagcacatcatgtacctgaatccttatgttaactctgattggtgtggctttggctgtacgtcagagcagaggacatggcccagaaagggcacctcacattcccaggtcacagagctgttgagtggcaggtctgaggcctgagcctggctctgtctgactgaaggtgcccttatttgctgtgcttcatggcctcttcacacctcatgagtgttttttaacttttataacaaaacaattagcatgttgaaaacgctcagtagttcatctagtacctagaggggattgatgatgacttgctattgctatacgccattaagtcaagggaccttattaatggtgagtgtgccccatgttaattgccttagagtacccggagtaaagatgaggtgttaaccacattttatagtcacttgtaacagtttattatttcttaggtatttcatttgtcatttgtcttcatattatatatgcttaaaatgttatttct

SEQ ID NO: 39725 - DNA, 1025 bp, Homo sapiens
cgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttcaccctgcatcatcctaaagaggcctgaagaatgttgctttaaagttataccaaagaaactatgaaggattctttaaatatgagggagaggactcgaagaaatgactgttaaactaggatttgtgaaatgacgtgggttgaagaggaggtgtggcatccctttgccattgggggccttggatggcgtccaggagtctgggctttgttagactgcttctcactgggtcctactcactgggtttggcacatcaatgttcctaggagttttcacttaaaagcttaaatttagataattttgccatttacatagattggactttgacagtcactgtacttcatcaggaagcattttctaaagccttctgtgtagagaattgctactgggcacctggggaacacaaaagcatttgtattctttgcagtaagaatacagcagacaatctggtcacctttcagccaaggtgaccaaaaccagtgtccattaagcacctactatttagagagcacagggctggggatgtgggggtgtgaggaaggagatagcccagtggaatgggcaagttctgtaagttcatcacatctgggtttgagttctggagctgctacttaccactcacaaatttggccaagttatttaacttttttttgttttttttttttttagacagagtcttgctctgttgcccaggctggagtgcagtggcgctatctcagctcactgcaagctccgcctcccgggttcatgccattctgctgcctcagcctcccgcgtagctgggactacaggcgcctgccaccacgcccagctgattttttgtatttttt

SEQ ID NO: 39726 - DNA, 1840 bp, Homo sapiens
tccctttcaagactcaaaatgtacgttttagatatttttattttgtgatgtaaaatctatttttatagttttgaactaagttggtcactttgagttcttattctaaaactaaggaggcatgaaagccgcctttattagttttgtttttgtttttgtttttgtttttgagacagagtctcactctgttgcctaggctggagtgcaatggctggatcttggctcattgcagcctctgcctcctgggatcaagcaattctaccttagccttctgagtagctaggaccacaggcatgtaccaccatgcccggctagtttttgtattttgagtagagatggggtttcacctatgttagccaggctggtctcaaactcctggcctcttgtgatccccccgccttggcctctcaaagtgctgagattacaggcgtgagtcactgtacccggcggaaaggctttattaaatagccatttatttctagttagcttttgttcattcagttttctttcttggtaactactttaaatgaaactgttcttcttggaagtttctggttattattgtggtcttttctttgccttaaagcaaaactaaattaatgatctccaataactgaattatctagattaagatcgttttcagtccacgatttttcctgtattcactcttgtctgtagtttagcatttgtattaatataacactcaattactttgtaaacgagatggaataccttactgatttcactctgtaataatgatgggaagagaaaattacagttccaaggtatcagtttgttttacagtctgtctgcaagcttttctgacttttcagtttttgtgtaaattggatttgaattgaatgcataagaactgtaattaagattcctaataattttctttgtgagatagttttacagcaggactatgtttggaccaagagaaagggcaaggacttatttgttgaaaaggattttacttacaacttaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatatagtgaatattttaggctttgcaggccataactactccaccttgccattgcatggagaagacagccatagacgatgcctaagagtgtgtgtgtgggtgtggctgtgactgtcccctggtctgttgccacaacaatgagtctaggtgggactgggaaggttgggttctgtccttgttcagctgtcagtgggacctgcccagctgtatgttctatattctggagcctgtatattcacccgtggttttttccttagttaagaaatgttttcccagcctgcattatgcttacatatctattaatatttcctttctccattatcatgagttgtttatacaaatgaatagatataagttggttaataggttaactttctagtttacaagtagtttaaacagaagtagaaatgagtcgtttcttacaacactttgtgaacccggggctgggagtctgagactccatgggccgtcctgtctgcccttctgttttcacttcatgatctggcttcaggtggcacagtgttaaagtgtgtcacaccatgtcgagtttgatgttagaaacttaacgttctataccgtcatatgaaaacataagaagggatcgtttccaaattatacattttaatgaattttcgtgaaatttaacgtgggtaaattatggttttagagttagcaattca

SEQ ID NO: 39727 - DNA, 1026 bp, Homo sapiens
agccactgcgcctggcctatttgttcctttttatggctgagtagtattccatggtatgtatataccacaatgtctttatccagttgttgattgatgggcatttgggctgggtttcatgtttttgcaattcggaattgtgctgctgtaaacatgcgtgtgcaagtatctttttcatataatgacttcttttcctctgggtagatacccagtagtgggattggtggatcaaacagtagttctacttttagttctttaaggaatctccacgctgttttccatagtggttgtactagtttacattcccaccaacagtgtaaaagtgttcccttttcaccacatcttcactgacatttatattattttttgattttttgattatggccattcttgcaggagtaaggtggtatctcattgtggctttgattttttaaaataacttaagactactcacattctgacacttaattattttctttcttttgaacaacaaagcttgatgacctcacacaagatctgactgtatcccagctcagtgatgttgcggattatctggaagatgttgcatagacacgaagaaggaagtattctaattaacaaggacagaggactgaccggttccattttttttttttccagacaatcactcagctggaatgtctgctctctattggtgccttgcatttcaaaaacactgcagatattttttaaaagtaattttcattttactaaacaaaatacttcctatttgagcccatgtgtggaagatttaatattcttaatttaactgtacatttctttatggaaattgattatctacactcagtttcattacagggaaggaacccatgaaaacatcagtgttaagagcatgatgaaaggtgtcaataaagccgtaggatcgcgcaaccctttgtgtgtgtggctgctggtacgtgtgatctttgaaaaccttggctttagccctctggaatcagagcttacccaccatagtatattttgatattaggtggttctacacatagttgg

SEQ ID NO: 39728 - DNA, 1107 bp, Homo sapiens
ttttgcttgttttaaagaaatctagaagtggttatgagttttaattcatagaattgtcaataacataacatttgcaatcgtcattcctcctgttatccatgtaagcagctttagtcgtaggttctcttcattataatttattatctgtaaagattccttgaaacttaaatgcatctgaaaccattaagcagtgcttttatttcagatctgtaagttaattgtattaaaatccaaattggaatgaaatagtagtaatggcctaagaccatgttcagtttgacaagctttatatactgtacataatttcattgtaacccttaaaaatagagccaataatagaatttccacagtctcatttatacggttaaagcattattgctattatgtaggtcacggatgtttataatactaaagtattttaaaatgtgcaagtagaaaaaacagtagaaagtgatgcatgcatatttatatataagtaaagcaggattgtgctgtttttgcactttataatttcaattaagttgcggctttttactacaagttaactttattagtaaaaggagcaaattagacctaattcattgatctcggttaagtgagcagactgcatgacttgtgtaatgccagtttctcatttcatattagcctaaatattacagaaattactccttgggctctaaaatgtagaggaaatgaaaatgtaaggattaaggctgtgtaacagaatctggctttttaaaatttaagtgaaactaagctgtaaacatcaagaggaagtaggacataaactgggccggtacagcctgggagccctgtgtatttctgccctccgtctgtgagctgctatctcagtctccttcagctcttcatgtcttagtaaacagcaccacgtgcagatgtaatcttgttgcagtcccccagtgtggttgttataaaatgcatttctttgtaagtcatctctgtaaacagtcactttctaaaagcactatagttctggtcccctggaatctggatcacatgtatgatttatttttaatatttgataggaactaggtttcagtgaaatgatttgaaagcatagcaggatgtggctttttaaatttatga

SEQ ID NO: 39729 - DNA, 1031 bp, Homo sapiens
ttgtgtcgttcacgtcttttatttccttgttgatcttactcttagttgttctatccatcattgaaaatggggcattggccaggcgtggtggctcacgcctgtaatcccagcactttgggaggccaagaccagcagatcacttgaggtcaggggttcgagaccagcgtggctaacatggagaactcctgtctctactaaaaatacaaaaattagtcaggtgtggcagtgcgtgcccgcctatagtcccatctacttgggaggctgaggcaggggaattgcttgaaccctggagtcagagtttgcagtgagctgagatcatgccactgcgctccagtctgggtgacagagtgagactcaaaaaagaaaaaaaaaaaaaaaaaaaaaaagaaagaaaatgagacattggatttgtaagtttctgacaggttcattttgcctgctgcccagatagagccgatttatgaggacagggaaattgcaatagagaaagagtttaatacatgtagaactggctaaacaagagactggagttttattattactcaaatcagcctccacaaaaatttggaggctaggtcttttcaaagatagtttggtgggcaggggtttgtgtactaagaaactaaatgtttcttgtgtactaagtcagcttctgggtgggggccagaggaccagttgagccaagaattcaagaggtacaggttcaagtagggccatctggttgtcagaaatgcaaaagcctggaaagtcatctcaaatgttaggttctacaatagtcaagttatttatagtaattgggaaagttgcaaatcttgtgacctctgtagaaaataggtggtaatctttacacctatatcttagtagaattcaggcccctcacttcctcctaacctggtagcctttcattagttttacaaaggcagtttaattttggggggcagggctattatcatctaaactataaactataatcgtttgtcccaaagttagcttggcccatgcccaggaatgaccaagggcaatttggagat

SEQ ID NO: 39730 - DNA, 1046 bp, Homo sapiens
ctccccaaatcgttacacaggttaaaagcaatccctatcagaatcacagagattttttgcagacatcgacaaactgattcgaaattcatatagaattgcagggaatccacaatagccaaaacaatcttaaaaatgaagaataaactaggactcatacttcctgatttaaaaatttactacaatgcgatagcaatcaatcaagacagtgtggtactggcataaagatagaaatacaaatcaatggaatggaattgagagtctggaagtatatccatacatctgtggtcaactgagttttgaaaaaggctccaggaccgttcaatggggaaagaatagtcttttcaacaaattatactaggtggaatggatagtcacatccaaagaatgaagcttgatccttacctcacactgtataaaaaattaactcaaaatagatcaaagatctaaatgtaaaacaaaaaaactaaaactcttagaagaaatctattagttagggttccctagagggacagaattaataggatggatgtagatgtaaaggggagtttattaaggagcattaactcacacaattacaaggtgaggtcccacaatagcccatctgcaaaccgaggagcaaggaagccaatcccagtcccaaagctgaagaacttggagtccgatgtttgagagcagggagtatccagcatggaagaaagatgtaggctcagagggtaagctagtctagttttttcacattcttctgtctgcttttattctggctgagctggcagctgattagattgtgcccacccagattgagggtgggtctgcctttcccagacccactgattcactgattaactgattcaaatgttaatctcctttggcaacaggctcacagacacacccaggaacaatactttgcctccttcaatccaatcaagttgacactcagtattaatcatcacaagtccaccccttgtcaacttgaacccatacacatctcctgaaatcatacataatctgcaaataaagacaataataaggtaataataattatgcct

SEQ ID NO: 39731 - DNA, 1045 bp, Homo sapiens
ccaatggaatcagtattttatttttatcatcatctgtctctttagcatcagatatttggggccagattcccttttcattgatttttaattattaacttttcattttatttgaccatttgttctttgtggagcaccaacatacagaaacaggcaaaaaccactgaaaaattggctctgagctctgagtggcccctgtctgaatgtcttcatgcgacagatgcttagaaatttaatcccaagaaataataggattatatttgggaatgacagtgaccatgtccagcttagtcagagtttaagtaaggcttcactttggcactcttcctcaggagagttggaggcagggatggatgaaagactgaaccttttcattctaataattaagactttgcttttgattaataagaatgtcaatccaaagcataataatagataccagcaggtaatatttctaaataatcagatttaaatatgcattaaaggaagtaattaccatgatgattaccatgactaaggttgattgttcatgttcacactgaatctccagattcctccatgtggcgcattctcaagtctttacagtgccagtgtcagtgatgatgggcagctcttatttaaaaataattgagttccatagcacggttccatttggctatagtagggaagaattggacccattttattccttcagaataaatgaatgttggtactaatactgttttctgcagcaaacatgaagaaagtttatttccaagtggctgttttgctcactctgccagcatcccaccggcatctttataatgtgtatttcagtaagccaaaacaaaaggcttacctgtaaaatatgtgtgtgtgtattgaaaaaaatgtacatattagaacaataaaagcagatgttgatcccaggatggaacaggcagtgtttacaagtttcctaagttctgccttagtttggggtttgctggcagcagcccctgcatttgagtgtgggtgtgttacctgggaggcatcaccagggtcctggaaagtgacggtgagggtggga

SEQ ID NO: 39732 - DNA, 1075 bp, Homo sapiens
ccaaacaggaatcaagaaattctgctttctcttgtcttcagaacatgtgataaagctcagtcaatgagatatgccttcctggtgaaggagatactcaggggatgagacatgatgagtctctcatttggtgtcatgccatagtgtgcccgccctacagggtaccccgggtcctgtgagaggctaacattcaggtggggggtgacaatgagttactgagacagcaacaatcgacactttacttgaggcagctgaatattggaaaagaagcctcttaactgcaaaaccgaattgagtcaaatgacatttctaaagtgtgtcattagatgactttttcttagagcccctgaaactcctcctccaaagaacagtgtgtcctacagaagctctagaagtattcctctgcccacttgtttgggaaatatctaaattccaaagacaagaaaattacactttaagaatcagttgagctgaatgtattttacatgtgatttaatgacatcaaagtgagatctggtgagaatggtggtcatagggaccacgtgtgagataggaagtgctgaacctcaaagagacagtgtgagatgtgttgcaggtggctgctttgcaagggtaggttcactggttcaccaagaactggacacagggctcagcacatttccctgcatctctcatctgccactcgtagataacagggtgtcttattctcagttcattaaagaaggaacagaaatatctactaaaaaacttcttagtgtcttcacatcaacattttcttaatagaaaatctgcagcctgtttctccaaggagctggtgactgctgcctgagatctgagatgatagagcaagttgtgaacaggattctttacacgttgaggtgatacccacgccaatctgtcaccaaaacagtttccttaaaacaattcacacagtttttcctgtgaaaacagtggcttggggaaggccgaatcattttcaatgactgtggctggcatacaggtgaacctgacaaccaccgtttttatggagaatcctgattcttaaccacagtgacattaaatttgtcattatctagaa

SEQ ID NO: 39733 - DNA, 1057 bp, Homo sapiens
gtttagtgatgagttttagggctgatttaaaaaatatgtgtgttctaaggtagatattatgtggttttccaagtaaggctataatataaacgtataatatttaaaatgtaaacatagggctcattattatggaagtatacatttcaacatttattttacgcattatatattttctgtatttataaatgcctccttttaatttttagttatcagtgctaagatgcacacatttacatttttgtgacttgagaatactggccacaagctattagagtgatgaccatcaagttttattacttgaattcactcgggatgtgacctaagccacacctacttatgggacattttcaagttctacttatagatcttgtagttcagggagcagtggcgtctcatgtattcagcacaatgtggagttatgctgttgtttaatgtggcttaggccttctggcacttgtctgccccttcagtctccgtctcccaaatataaactcttgagttagccaaccatcggctgtgtaaagacgtctttttctcctactatgtttagttgtattttcccttggcttatttcctgagaaacagacacacaaacacagacagtattttatgttctaagaccaatcacgcacatatggatttttaatacttcaaaataatatgtggatatattaaaaaaatacgtgtagtaaaaacaaaatgtcagagtactgcatttatatttaagattagcatcacttaagattagttttatttctacgtagtggcaccttgttttgcacaaaatatattgtgttgttaatttatggatgagtgcaaatgcattttgagtttttaagtcaccaatttaattgttatagatagcattactaaactattatgatggtacacaatttttaaccgtttagtgcatcatgcttattagcaaacattgttttaatttatcagaacaatataatacagataaaaaattgtagttggtgaatatatgaatttgtaatgattcttttgtaaagcagctaagctttcgttgattcagaactctgccaggagtacc

SEQ ID NO: 39734 - DNA, 1074 bp, Homo sapiens
ctgcaatgaaaccagtgtttggaagttttataggaaaataatatccaagtagaaaatttggaatgtaattttcaggaagaaccacaggcataatgtaataaaacatctcttctgttttatttggatcatatacttatgtgcatatatatttatttcatacataaatacatgatgtattgattttcatctagactttttaaagccctattataattttatcattgtgatagtagattctgtgttttgtagccaaggtgacacatgccatattttattttgtaactatatacaaaccttgtatcttatatagcatccagaaattggaatatgaatgaggagttcagtgaagaagtcttcatagcttcactgattactttcttaggcctataggaaagaaaggaggtcaagacctacccaaggttcagatgcctttttgacagcattggctgtgacgctgcgcttgtggagatcgttgtgcctgctcatgccatctcgccatctcgcttagtccctgtcctcttactgggcttcctcttggtgctgccttgcctgactctgctctggatgttgccctagcccttccctggtctgtgcttacaattaaacaataaacaaaatgtgtttattctgtgactcttggagactctggttctccttactgccatcactcagttaattttgtgtcataaagttttatttacacattaactagcaatttttccccagataacatttgaattttaacaatcttcgagaggttatctttattaccaacagttcctcaacatctactgaacaaatacttgcatttccaaatgaaaagggtgaatctcagacacagtggcctgttgtaccttcttacatcctacagcccatcttctctggtgatgagcctttgtttttccttcttgtaagaaacagtgaagcttggcgagtaaccctggaggaggtttctaggtaggaagttaggaatatttttctttcatgaatcatgggtgctctgaatatttgattttaagaaccacatattagcctacctgatattgtgatgagaataaactaagactactcact

SEQ ID NO: 39735 - DNA, 1025 bp, Homo sapiens
caggcacagcaagcaagcagagtgtgttcagggctgtgaagaggggagacccggtaggtagctcatgggcggtggacctttccaggatttgtcaagtcagggaagcttaactgagttcattttaggaagtgatgtttattctgaatcctgaaaaatttgtaggaaatagctgggcaaaggggtaaggcttgagaccttatttaaaaacattcaatttggttgaatctgtgcgcagacatgtgtgaatatgcaggcccattttgtggcttgcagattgtactgttcctcgttattcactgtcctccttgtaagaggattatatggcctttgcccttttgacatcaagtttgaccatgtgactttctttggccagtgacagatacggtttctgagcagaagcttgaagtccatttcatggttctgtcattgcctttttctgtcatccgtgaatcagtgtgtcccatgctggggctcattcttgaaccatagtaccagaatgaagatgactagatcagagctccagctactcacagaatgatatgttattgtgagaaagaaatacagctttgttgttgtaagctgctaagatcttggggccatgtgttttcatagcatcatgttgtgactgagaagagtactatatgtgtgtctgtgtgtacatgcaagtgtacatactagttggtttggggctgaggagccagttgccagttatgaaaccaaaggtgtaaatcatggtcagttcttatgggccttgtaagccaagttaagaacattcaagatgaaagaacatgaggaggttgacagttcagatggacctccctggcagccgagtctgtggagtgaagggagggaagttaaaaacattcgagatgaaagaatgtgaggaagtttgcagttcagatggacctccgtggcatctgagtctgtggagtgaagggagggcacgcttggaggcggggccttcaggccttcctgcgcttgtgtctgtgagataaaggcctgaactaaggtaacagggaaggaga

SEQ ID NO: 39736 - DNA, 1022 bp, Homo sapiens
taattgaagaatgcatgcattaagaaattaatgaaagttgatcggtaaggacataactgtcatacacaaactcagcacagtaaatttgaagacttttatttaaagctttgaaagtctggccccttgctgggcttgtgtagatttctttagaaataggataacttacagcaaaaatttattaaatataagtagctcattgcagatattcatgatttggtagtacattgtaagaaataatagatttattctgagaatatgctgctgcttttcacctggtactataatctgctcatataattagaaccttttgtgttaacatttcaatatctgactaaaggagaaacaccttgggatagttaggctgttgaagactaatgtaagctttttcaggtgggcagtaactgacctgttttactcaaagggaaacttaagttttatagcaagagatatggagagcttgtatttattaagatttatgtggataaaatttagttcgtgttttttgaattgagtctgtagggtaaatttgaaggtctccctttctcctctgaattctagctatccagacatagccactgtaaggaatttttacagtgtgtctttcccagttttgctcttgtagactcaaaaatgaagtgtgtgtgtgtgtgtgtgtgtgtgtgtgtgtgtgtgtgtgttttgagatgagatcttgctgtgttgctcaggctggtctcttaaatcctgggctcaagcaatcctcctgcctcccaaatagctgggattacaggaatgcaccattgtagcacagctgtatttgaattttgttttacaaaaattggatcgtaggatatacacttttctgcaacatgctttattaaagaaattctcccatatttctataaaacaaaagtatgtataaatataattatctttttagtagctgtataatccatgtagtaatcattttcttaactattaatgaacactttgactgtttccacagtacactgtttcagtaatgctgctatgaacatttttat

SEQ ID NO: 39737 - DNA, 1056 bp, Homo sapiens
gagaacttccttgttttccagcataacaagatgtcccaaactcatcttgtacattttctgacctagacctggattaagccatttctccaagtagctgtggtttcttttagtggtatttaagagactacagtctaagtgctagagatgttcatttttacagattgttgtttgcttctgggccttttcagtgggaaaaactaggaggtatttatattttgtggggagaaaaatctgtatatttctactgatgtttccaattcagaatggccttgtatggcttttacttaatttatttaattttatatctcttttctcttacattgaaaaccttgtcactgtataaacacaactacctgttggctttattgtatcatatagttattattacaacatattgccagtattattactaacaacaggatatctgaatgggcatttaaaaaattctgcaaaattatttgcagatactgacttgtcagtagactagtctgctggcaatttaaagtcaaaagctgttgtccaaaatcactcagaaaaaaatcttttttctgtatgctaatatgaccaacttgatagagagttaagactcattcatttcagtttgttttatgtttccagcgattgtctttttttgttaaatagttacatggttccagagctgaaactgtgtgataaagtacatttagaaaagctttgcttccatcttgattatgttttggtttgttcatgcatggaaggcatctctttgaagatgtaaccaaatacaggttgtgtgtttgtgtcctgtcttttcatataatagatgcttatgacacatgctgttgtgcgttgtgcttttttcacttaactgtgtatcttatgcatcatgccatatcacagtataaagagttttgccctaactcttaatggcaccgttttattccactcagtgaatatacgagaattttttcaaccagttccctactgctggatcattttcaaacatttgcttttataaacattgccacagtgaatagcctttcgcatttcatatgtattttttttagtgtatctttg

SEQ ID NO: 39738 - DNA, 1010 bp, Homo sapiens
ctctttatctgttaaagaaattatatttctttctgtgaaacaagttggaaatttttttcccccagtgtgttacttgtcttggtactttacctattgtgtgctttttgaattttttgtgatatcaaagttttacattgtcaaacttattaacatttctttaattgactttggatttcaagtcatggttaggaagcttttcttatttctaagttttcatggagtttatccattttttcttgtacttgtgttgtttcttttttgtatcccttgaccatttgaaatttatcttaatgtacagtgtgatgtatagatccagttttctctttgccgtctgtctgtcccaacacatttatgaagaacttcgtcttttccacactgatttgagacccacctaaaagtctagactttttctttcatttatgtcaaggtggtgttttaaatagagatttttatagtttttttaaacatctagtaggctgacccttcatatttataattcttcttttcctggattgctctggatttcttgcttattttcctcataggaaataaaatcttttaaattagcttgtttagttccaggaaaaaaagaaaaaccaacaaaaccattgtatttttagttactgttttcttaaatttataaattaagtgtgtaacttgatttttttcagaagaaaataagcaaaaggttttgttaatattacaagagaaattctgttttgaaaaacaaactgttcaatgatgatattcagtgtaatttgacttcaaatttgtcttcatgtccttgataactataattttttgttgaaattgagtttagttgacacagttttcaaggtattctagtttacttaagtatttgaagtgacatggaattcataaattaatcttttttaaaactattaaaatgaatacagttgtgataaattgtttttcgtgtgcttgacaatactgatctagttaattggacggttgaactacttgttgaaatgagccaagttgtctcctgc

SEQ ID NO: 39739 - DNA, 1056 bp, Homo sapiens
tttttgttttgattttcataagtttgtatggttgttaaccctgttctaatacaggttaagtgtctctaacttgaaaacctgaaatatgacatgctccaaaatctgaaatgttttgagcgccaacatgacactcaaaggagaaatgcatattgcagcatttcagatttcagattctcagatcagacatgctgaagtgtatcatgcaaatattccaaaatctgcaaatactcaaaattcaaaatagttctggttccaagcattttgaataaagtattctcaacctgtatcccatttctcctatttttcttcaaataagtacttcttagttcatacttattagtcaaaaagaggctagtggattggggaaaattaaagaaaggcttcattcagtgtgatgggctttgaggaccaaatggtttgacttttgagaacatgaaagccattgcaaaatgtaaagccaaggaatgatgtgttgtgacttagtttgaacaggactttggttggattctgggtgtattttgatggatcagatgtggaaccaaggatgactttagttgaacaactgaatctttaatcttgcttgagacagtaaaagtgacctaggagttagaaatattctctggaatttttgttgggagttgtgctttttctgtgtgcaaggaaataatgggaaaggacatcccacagttgtgagtgtcagcccacattgcagtagatgatacctgtggaggggatacctttggctggaataccaatgtgctttttctctagaggtaagattttgagacaaatctaaaatgcgttcattgattatgggcaagtagttcatttagaaaattagttacaactattaggttggtgcaaaagtacttgtgctttttgccattgaaaataatggcaaaacccacaattttgcaccaacataatatattcttcaaaaattaagagttttcatttattcacattaatggttgggaccaacatttccctcttgctttttaaaaggaacttgttcatttaggcttttgacccttggagctggaaagggacctcacg

SEQ ID NO: 39740 - DNA, 1098 bp, Homo sapiens
actgccaccactcaagatgtaatcgaaacgctcgcggagaaatttcgacctgatatgcgaatgctgtcctctcccaagtattcactctatgaagtgcatgtcagcggaggtcagtgtatacaggaagggtttgctagaggcatgacctgacctgtgaagagacagcttgtccagggtcattgtggtcatgtcaggtttactgctcgtctccatctttcttctcttttggtgggtaggagagtagctggcaggctgagaaaactgttttatgtctgggaagtgttcttataaatccctggcacatatatctgttggaagttagaatgaatatattaattttgcatatgcttatttctccaaagataagtaacgttacatttatccaacatatctgggtgtcacatacattgtgtagtatgctacctgctttttgagaatgttttatgtggctcttatgtagagattataataattgtaacacagttaaatattatataggtatgagtcatcaatcttgctgtaatatttttgccttctgaaacaatacattttcattattctttgggaataatttagggtatgtatcttaaggaaacctccttatgtatttagtaatttctgcttgtattaacattagaaatttctgaaaatatcttatatagcaatatcaaatgacaactaaaattagactgattaagaaatgtggaaatttaggtaagtgccatggcttatgcctgtaatcctgacactttgggaggctgaggtgggaagattgcttgaggcaacatagtgagacccgtctccacaaaaaaataaaaaaaaaaagttagctaggcatgatggcacatgcctgtagtcccagctacttgggaggctgaggcaggaggatcacttgagctcaggagtttgaggcttcagtgagctaggatcgtgccactgcactccaccctgggtgacacagtgagactttgtctctaaaaaaattaataaaatgaaatgtagaaatttttaaattttttcattggtgttttggaaatgttgagtaacctgttttaataaaatacagattacagttggtgcagcaaataaaggatttat

SEQ ID NO: 39741 - DNA, 1024 bp, Homo sapiens
ttcataaaagccaatttattatggctactcttaacaattcctttaaagttaaaaactactataggcgatttgtctattattcactctttgtttttataattttgttaggtttcttttattcaagttactttatgtaaattacttggagttttatttactgaaaatcagatttcatcatttctcccccagttttctaactggctttgatttttgtttcttagcttgcttgcttgctagtttttaaatgaggtaaaatatagattcggtgagatgcacagatcttgagtgtgcagttcaattgattttgataaatacacccatgtaactgccagctgaatcaagataaagaccattctcattactccagaccttcctgtgtttcagtagctttgttcacatgttcggcagcatgtgagatgaagttacctaagccgtaggcaattttatgtgattctgcatagtagtcaatatggtgataatgttactttcatcagaaggctcaaagtaatggacctgaaaagcaggaaaaagaaggggttatccagaacttcaagagaactctctcaaagaaagaaaagaaggaaaaaaagaagagagaaaaagaggcattgcgacaggcatctgataaagatgatagacctttccaaggggaggatgtgtaagtcagttttggaaatgttcccctttctttgtgctccaaatcagatgtttttgttgcaccaaaattgttaaattttcagataaattatggaaaggatgagtatcagtcaggaaatgtgtttgggtctactcccagctcttctgtgtggagggaggatagagggtcttacctaagcagggttcattgctggcagtgcctgtcttgctgtgcttgggaagaatctctgcacccacagtcttgctagtcttaaataagcaaactctagttaacattattatttttctttttcatcttcagctgggttttttcctcatttctgtggttttggccatgaggcagcagttgtctcatatgtacctcaga

SEQ ID NO: 39742 - DNA, 1021 bp, Homo sapiens
tttcttgtggttggaaggtcatggtaaaatattggtctgttttagggtaacactggtggaagttactgaaatgtataatcaatatatttttcttttagcattattcatgaataaactcactattaatgtaaacttttaatgatagatgtctgcttagttcagtatattagtttgtgttgagagaaactatattctttatcatatagtaattagcatgtggtaaatagtacgtaacagacctcttaggtacagatgtagccaaatagcacctgccattttgatttttgtgcggttgcaatgtgtctatttctaataagaaaacagtgtttaaaatatttttggtatttttttttcttacagtgaaaattctcgactggctgctgaggtttacaaagacatgccggaaaccagctttactcgaaccatttctaatcctgaggtggttatgaaacgacggaggcagcaaaaattggaaaagagaatgcaggaatttcggagctcagatgggcggcctgattcaggtacaacttggtattttttctctgttctacctgttacaaagagcattgtttaattacactgtacgtgcgtgagacttgctttaactaaagcaatgggtggtgtaaccttttcataacaaatgtgtaccatatacttctggtacaaaatcagcctaccctatgtacaagagtcctgttcacatagggatatgtttagtttcatacttttacccaatacagctcttaaaaaaaaaaaactagaaaatttcaagtatatacaaaaaaagagaaagatacaataaactcccgtgtacgtatcactgaggtttcttctgttctccaaaatacattgcctccattctcaaactattattgggaagcaaatccctaacttctcattctttcaactataaatattttggtatattttcctgaaggataaagattccttaaaaacaaaacaaaatataaccatagtatcattatcatatataaaataattgataataattccttaatac

SEQ ID NO: 39743 - DNA, 1029 bp, Homo sapiens
ttcactttttaaaaatggatttatttagtgggttaatatttaactttatctgggtttttagtttttttcagattgatgatcaggaagtaggaaaatgggagaaataggtatataataatatataggtaaggaaatcgcaaagcaattgaataaagagcagcaccatagagaaattctggagttccttccttttctttcctcactatagatacggaaatcaattcattgtttttaaaaactcctttagcttgaagagagaagatgaaaatggtctttgtcatgctggattgttcatggtttctaagtgtcactagatcaactagttactgctattatatgttatctaacaggaaatgaaacaatagttattaggcagattgtctttacactcattttagctagaatgcaggtacctttttctcaagtgactgtaaatgttagctatctctgttactggcataaagtaagttgtactcaaagatgtcaaaatgttttttcaggtggaacattgagaatttatgcagatagtttaaaaccaaatattccctacaagacaatcctgctgtctactacagatcctgcagactttgctgtggctgaagctttagagaagtatggtctggaaaaagaaaaccctaaggattactgcatcgcccgggtaaggaactttatcaaatcagtagttctttctacttcacatttaaatggtagattttctttaaatcaaattaaacctagattttcagcctaccatatcatttagaatctgataatttacaaatcatgtgctaaatatatatttttaaaaagcagtctcccttccattacaaaagcaatacatatttctattataaaataagaaaaatattaaaaggcaaattaaagaaaatgaaaattaccccaaaatcaattgaccacatatacttgtggttcttattctggtctcttttctgttccattgatacatatgtctatctttttaccaataccaagctgccttaattactgtagatttataagtctaaaatt

SEQ ID NO: 39744 - DNA, 1032 bp, Homo sapiens
tgtgcatagcaataaaaaagcagacaacaagcccagcactaaggaatgcttctaccactcagtgacgtgttgctctgcaacgtcagttaaatctctactagttgacctggaggtatatacaggcacacctcagagatgttgcaggttcgatgccagagaccgtcacggtaaatctggcatcgcagtatagtgaatcacaggagtgttttggtttcccaatacgtataaaagttatgcttttagtaaagtgtgcagtagcattgtgtttaagaaaaaatggacctaccttaatataaaaatgctttattacttaaaaaatgctaacagtcatctgagccttcagcaagttataatctttttgctggtgcaggggcttgcgtggatgttgatagccactgactgaccagggtggtggttgctgaaggtgagttaggttggctgtggcaactccctaaaatacaacaaatgaagtttgctgcattgattgactcttcctttcacaaaacatttctctgtagcatatgatactgttagataacattttatgtacagtaaaatgtctttcggaattgaagtcagtcctcccaacccctgccactgctttatcaactaagtttatataatatttgaaatcctttgttttcatttcaacagtgttcacagcatcttcaccaggagttgattccataagaaactactttctttgcttattcacaagaggcaactccttgtttgttcagcttttatcatgagattgcagcatttcagtcacatcttcagaccccatttataatcttagttctcttcctgttttcacctcatcttcatgtacttccttcactaaagtcttgaacagctccaaatcatccatagggtttgaatcagtttcttccaaactcctttcactattgatatttttccttatcccgtgaatcatgaatattctaatggcatctagaatggtgaatactttccaggttttcaccccagatttatcagagaatcactatctatggcagctatagcctcatt

SEQ ID NO: 39745 - DNA, 1020 bp, Homo sapiens
ccctgacagttacttgaagtgcaagagagctctgttacaatcctgggccttataagataatcccttaccattcacaagaactatatagcaagtatgattgtatatataagagagataatttacctatagaataattaagtccatggatatgatgggttttttaagtggtccgtatacttagaattgattagtaactgctgtacaaagttttctaagtcagaatactattagtaaaacagcagtgtacatagggtctgtactactgaacagacgcctgatgctttctgagctgtgtccctcagctgttgtggtgtgaacactgagggcaggaacttgaagccctgtctctactaaaaatacaaaaattaattgggcatggtggtgggcacctgtaatcccagctactcgggaggctgaggtgggagaatcacttgaacccaggaggcggaggttgcagtgagctgagatcgcaccactgcactccagcctgggtgacagagcgagactgtatcaaaaaaaaaaaaaaaaaaaaagaatgcctggtgttgcatctgatacctggtgttgctccagtatttgccaagggaatgttgatgttgataagtgtatataagtctatttaataataaactgttctataaaattgcatctgataaactttttaacatctttttcttttcagtaatttttggctgatttttactgatgaaaatgagaaagtgaaagagcaccttaatcggggttttaaagttataaaagcctatcttgggattttattgacagtcccttatgaagtcatttgataatttccattgagtgtttcttctagttttggttttctgttctgttatttcctaaccagttttcttttgcaagattaggcaatacaaatcaggaggtaattattgttttaccttgaaattctttatcttctcagcttgcctttttttttttttttctttttttccttttggagatgaagtctcgctctgtcacccaggctggagtgcaatggcacga

SEQ ID NO: 39746 - DNA, 1027 bp, Homo sapiens
tttaatcgtgtcaatatggaatgtagattggtagttttaaaacaccaaaaaaatctttctcagcaagcaaatttctatcctccttaaaacacttgtttagtattttttaaaaacagtgtaaagttaaaattttattaaaggcaaattgcctaaattctttaagttgaatttaataaaaatcaggtcaactaaaaatatacacatatattttgttagtaatagaattgttgttttatttcaataggcttttgcgggaacaggcggtatttggttacatgaataaattttttcgtggtgatttctgagattttagtgtacttatcaccctaaaagtacatttttatatgtgtatttgtgtgtgaatgtggtttttatatgtatgaatgtatttactgatcatagagttgtttactaatgtaagcatttattcttaacctggtgtttttttttcaagcttatgatgtctttcggtagctgttaatttagagtagtctttggaaattgcttgctagagcttttcaaacacaccaagaggctaatatttcctctgttgagtgaaagtatgaattgggtaagctgtacacagtgattccttggcagatgttcctaaattacatgcatctttttgagaaagttttgcacagttgactgccagtcagcgggccatcctgaccaacctgagtctgcctgatgatttcccatgctgctgttctagggattttagtctttcagttgaagaggaggccaccagaccacatcccaaagaaaaccaagaaacacttggaaggcaagacacccaagggaaaggagagagctgacgggtctggctatggctccacccttcctccggagaagctgccctatttagtagagttaagcccaggtgagaaaactggtcacaccagcacacattattaatgtgcatttttagcttcaaatctttgtactttctaatgcatcttcaagtagtcttctgttggctgacttaacatttttagccatttatttttttaaaagtaactctcat

SEQ ID NO: 39747 - DNA, 1048 bp, Homo sapiens
gaaagtttacttgaagctttattatctcactgtagtttggaaacacatcccagtattgttgtgtgtctataatgtgtgtgagagcattgatgtttggttgtctgaggtaatgaatggcaactatgaagcagccattagtttttgaacttaaaattttttaggctcttttttgggtattgggtctgccctttaaaattttatattaaattctagaaactaatgattgttttctccaaatccaaatttttgaggatctaagagtgttgagttctgagagaaattaataaatagcagctgacagaataattttcagatgagtaatggacagtttattttggtagatagcagagacaggatgaggattcattcattcacgcatgcatttgataaatattgattgaatacttgtgtgtcataccgtgttctgggccttggaggtagagcaccaaaacagattaaaccccttcaccttggggatttctcttctagtgagaattgttatttcgactgcttctttcatacttatagtctctcaggtaatcaaatacatagaatttttttttgtaggtgtggagtagatcacagttctgtactacttttcaccaaatattggcaacagcatttgttacatggttattaatacactgcatccctcatggcactctgctgccttcagtcagcattcactgacccttctactttaggcaaaacaatggatacaaaaggattaagttccttcccgccttcaggtaattcacacagtgggagggaatcacagtgccatgtgacaagtgactctgcctctagtcccgacttctcctgagccctgtgcctgtgggatagcttaacttgttccacaaatgtctgaagttcaggtctggtgccactattttaagggtgacctaagggttggtggcaggcctgaatgcaaggccagggtcttccctgcaccaaagccatgttctttcactaagtcatgatgtcgttttaggttttcattattatgcattgctcacagtcagcatgctgaatgaaattgatctatttt

SEQ ID NO: 39748 - DNA, 1106 bp, Homo sapiens
attggtttaatgaagtatgatgaatagacaacaaaatgttatacagccattacaagtctgtaatataaaaataagtgatattgtaagatgtttgtaacatctgaaaaagtgtttttttatcaagaagattgtaaatcccatttatggaaaatatgaaaagctggaaagacgtacagtacagtaataatcgctaggtgataagagaaacatgattttttatttactacttgtgcccagtttctgtagtaagcagatgtaataagaaattttacatgaaattttttctacagtgaatttcattgtataaaattttttcttttctggtgattttcttaatgtaggtaactcatccttttgtctgcctacaaattccatacaaatggttagaattgtatactttttagaagtatttaaatatacctgattgggttaccatataatatgtgttttccccggtgttgattaagggcaagaaagaagccagtttctgtactgaattcattaggtattgagctataaggagtaggatttctaaatctgttctgagaaataataaactttaaaaagaccctgcctcttcatgttgtacatattttcttatgtcttatcctgattttaaaataacttgttggaatcgaattactattaatgtactttcagaaaaatcatcatgtgtgtgttaccagctttgcctgcctgtgttttaaaggcaactcctagctctttgagaatgaaagtggctgtgcgtcttcctatgctttaataccagtgtgctttgggcactccccgtggacatagtgtccccagcattgctttgttatttcctggtctgtgttcttgcctgccctgcttggcagccctgtatcagatctctgcttgcaacgctgagtgtcaagcttggttggtctgtgtgaggttctaaacccgttgtgctttctctccatgtagagcaccactaggctggacagcgacagagtgtcgtctgcctctagcacagccgagcggggaatggtgaagccgatgatcagagtagaacagcagccagattatcgcaggcaagaaagcaggtaggaaacacatcatttttcaatggtgaaagtactgaa

SEQ ID NO: 39749 - DNA, 1122 bp, Homo sapiens
atgcaagcttttttctattttgttttccctgtaaaacttcagcataagtgaagttaacttgtagtaatagttgtgagaaagtgctgagactgttgtgggcttttgtagaattttttctgtaaataatttgttgagatgaagttcatataatattaaccattttgaagtgaacaattcagtcgcatttggtgcattcacagtgttgtgcagccaccacccctgtcggttccaaaacgtctccatcacctcagagcgatacccctcaagtagttcctggggtttttctcttcccccgttccctggtaacgccttcttagactttttaaaaatggttctcaaaagtcacttgctcctgtgtaatgagcctagacgttggtagtaattgggctttttgatagcacatgtgtaggtgtaatggacattgtaacatacttctcacttaaaatgaaattctgtcataaacctgttttcaaaatttcagaagataaaggtattttgttggtagaatggtttgactcctttacgtactttctgtcccgatctacagttgataaaattttcatagcagtttttcatctacagatgatttgaagatttaatctttaaagttcttaaaagtaaatgtacagattttttcagtttttctgaatcacttgtcaatgttgttatttaacttaataaaactctagttatataatgttaataacatagatagattggttgcttttctcctggcaggatcatttgagggaaactaagatcttttagttccttcagaattgttttcaaaggccagaatttttcaagaaatgtttcttttatatttgagtgattagcatgagtttgatagggttatgcttcttttacccaagttaggaaataggtaaaaaagaaagtcattttatttggataccgttttgttactttcatgtcattattttataaacaaacatggatttccttttcagttgtcattcaaagccattgtctgtcttctatcatgtttggacttactaagcctgtttcgagttgtgagacacctatcataaaactacccttgatagccttttccttattgatgtgaactagtcagtgaaatcaccattatcaaacaagtctttt

SEQ ID NO: 39750 - DNA, 1034 bp, Homo sapiens
ttgtccacaaataacggtcagaattttctccttgttgaaccactggaatgggtgagactgtcagctactgccagggaaaactcctcaccagtccaagccattagaccacttgagactgtggtgaaaagctgcgcagagtctgtcacacaggacgctcttgatgaatgttaggtgctgatagtgggaagaagatggcagtagagaaaatgtaccgaggattgttcagggcccgtgtgatagataggagttggtcaaaaacattgctgagaaacaaaataggatttgactaaatgaggaatgacctagtttgaattgaaaggcttacttttacaaagcatgtcatttgtccctgatgaaaatatcagagatattcttgaaaacattataaaatgattctgaactttatttgtaagaaatttaaattagtatgaccttaaaagtaaatttggacagagtaatgaggaggactcctagaattgttatacaagttacccagtaatttgaatgtaagtagttgaaccgagagtctgacgtgctggcagacaccccatgctcgtattgttttctggctccttccctcttttctttccctttgctaagtaggtattctgaatgttattaaggatctcttagtgtagtggagtaaacggttctgcaaggaagtaatgacaaggctatttggtaatttcttataggagtaagaaaaaagttcttttggaacacagaggagtgggaggccaattttactttactgcttggtgctgaaatgctcttggaccaaaacaaatggataattttaaatgtctggtaattcagtttgcagaggggattaaaggtgtagagtaagaagaatcaataccgtgtgttggatattaagcaattggtaattaatcttgcttcctttatcttgacaagatgtgctttttcacttacaatttgcttgtttcctccttaggattttgcaggttaattcctcacacacgttcaccaggtacttggacaatatattttgaaggtgcagattatgaaagtca

SEQ ID NO: 39751 - DNA, 1067 bp, Homo sapiens
catagaaaatgataatttgtagagtttacctggatgtagaatattggctgtggggtagcccagaggttcacactgccccaggcttgccccatctctctcagtggaatcttaagtgatccagacccatcccctgcacaggccaggactctggggagctttgtcaggagtgtcaggctcacctccagtggtctcttgtgcctgaaaatctgctgagtcgcacaccgctttgcgaggctaaggagagttgtgcactctaccctggtgaaattcacacacctgcaaatgtcgcgtgcggtctttgggggtttatgggcttcctgcatcccatctgtgggaccaccttcgttcccttcattttatggagagggaagagatagatgtggtctgttgggtttgtattttatacaaagcataaacgaaacccagagctggaactacagccttgctcatagatatcaagctcagttaccttgctcacagcaccaaacctgctgggggtaacttaccatggacttccaaggttgctgaatgtagaattcatatacaaagtgaattttagaactgattatttcacaattaaggtaattcctacccaagaagagagatctttagaatgtttttaaaacccaagcctggatttacttatctgactagaagtaaagcagttgaaaaacccagaggagagcagcgagcgggcagagtgtcaacagaagtatgcctgatgactgaaatacttctgggctctgaggtcatttcagccacttattgttctaaaatcaccagccagagaacccaggctaggttttcttacctgagaacaatagggttggattcatgatgatttggccagcatatctttcttcctcctgctcttttttttttggattgtgttttaatgatgtctttatgctgtttatcacgttgtactcccacacgcactcagggtttgctactggaatgtttgaagcctaggctccgcctgaccgagcctccctgtgcgtgtggggagactacctacacttctataagccctcttctgaaaaggtgcagtaaaagaattagagaag

SEQ ID NO: 39752 - DNA, 1032 bp, Homo sapiens
atgatctcattctgtatacagtcatgctcacctggcaagggggatccattctgaaaaattcgtccttagtttatctcatcattgtatatacgtcacagtgtactacacaaacctagatggtgtagcctattgctcctaggctgtagacctgcacagcgtgtcactgtactgaatactgcaggcaactgtaattcagtgggaacatatcttcacatagaaaaactacagttaaaaaaaaaaaaagtggaagagtaacaatgctagacccatagaaggccacttaaccctgagtggagcttgtaggatggaagttgctctgggtgcgtccacgagtgagtagtgagtgaatgtgaaggcccaggacatggccatgactactgtggactttatcaacactctacacttaagctacactaaatttacaaatatatatatatatttctttaatagtaaattaaccttagcttgctgtaactttactacataaaattttaaattaaaaaaaaccttttgactcttttgtagtaacacttggcttaaaacacaaacatgttgtacaactgtacaaaatattttcgttctttctatgcttattccataagtgattttctattttttttttaatttatcttttcatctttttggttaaaatctcgtacataagcacacacattagcttcggcctgcacagggtcaggattatcagtgtcactgtcttccacctccacatctggtcccacgggaaggtcttcaggggcagtgacatgccatggagccatcacctcctgtggtgacaatgcctttttctggaaggcttcctgacagacctgcctggggctacttgaccattaactctttttataagtaaagggagtacactctaaaataacaataaaaaatatagtatagtaaaatatataaacaagcaacccagtcgcatattacattatcaagtattatataccgtgtataattgtatgaactatacttgtatacagctagcagtgcagtctggcacgaccacaaacacga

SEQ ID NO: 39753 - DNA, 1897 bp, Homo sapiens
gggcgattaaaagttcagatatttttctacaaagtcagggaaacatatatatctttattgattttttttttaaagatactttaaaaatggttagatttgttgcttaaaatagtgaagtttcagttaatgagaaaataagctttgaaagtgtttatcttcccatcattactaattaagtaaaaatattttctttattctcagtatatttacttaaaagctgttttatgattctgtaggaagaattgacctttatcaccttatttcttatgctaagaacaattcttatggaattttaatgataatcagggtgttgaaaataaaatcttaagagatactgaatatgctttgattccagtttcagatcgtcgtggctcaggtaaaccccgaccaaagagtgaaggctttgagctctataataattcaactcaaaatgggtctcctgagagtcctcagctgccttgggcagaatatagtgaaccaaagaaattgcctggtgatgacagactgatgaaaaatagagctgatcaccgttccagccccaacgtagcaagtaagagtgacacttttttgcttcctaagtacacttgtgatcacagtctgaagtgagaggaggcactttgtggtttgttaattattaaaattattctctgcaaacattggctaactaggatatggttttcataagggatatcataagtaacatttctctaacaaaaactaagatggaaaaactttagattcagttgatcccataagcaaatacattaataacatctctatttggggttggtaaattaccaagagaaactaaaatatgttttacatttttttttttttttttgagacggagtctcactctctcgcccaggctggagtgcagtgcagtggcgcgatctcggctaactgcaagctccacctcctgggttcatgccattctcctgccttagcttcccgagtggctgggactatgggcgcccaccaccacgcccggctaattttttgtatttttagtagagacggggtttcaccatgttagccaggatggtctcgatctcctgacctcgtgatctgcccgccttggcctcccaaagtgctgggattacaggcttgagccaccatgcccagccaatattttttacatttttaaagggttgttaacaaagagaagaagaaataatagaaggatatgcagcaggagacaaaggctcacaaagcctaaagtatttactttctggcctattaccaaaaatgtttaccagtccctggcctgatacacagagctacaaaggtttttttgtagctctgggctctgattatttaaaagatggatgtggatatgacaagacctgatttcttacctgccttgatttttttttttcatctctgtgctggatactcactagcagtatgaagatgaatgaggtctttaaggaaatttcatgttatatataggttgtttatttaatattacacttttttttttcccccctgacttgagcagatcagcctcctagtcctggagggaaaagtgcatatgcctctggaacaacagcgaagataacatctgtctctactggaaacctctgcactgaggtctgattgattgataagcaaaaggcttctactgcatttccatccttagggttccctttggacatctcagttatctagtacaatttttactctgaattagcattgattataatttctaaatttgcagtgttttatcttttgatttttaatatactagtcaggtaaatcagttttaaattaataagtctgggcaaaatgaaatgttatttattctcagtatggatcaaacactttttaatgcagtatttaacatatactattttttaaattttaaaacagatcattgaaaatcaagttagtctgt

SEQ ID NO: 39754 - DNA, 1049 bp, Homo sapiens
ttttgcgtggaactgtagaaattggacatgcccctcttgagcatcccaggtatagaaggggttgaattaaaagccttataaaaatttcaagcaggaattagtaggaagcctaatttcagaattgtttcttcagagaaatctatctgggggaagtcagactgtattttgtctattcaaattggagtgcctctagaatgaaaatgggccctgcccagaatatcagagccacagtgtagtcacagtgcatcttcaggaagtctcagttttactcaaggaattaggagaagaaatatgtattaaaaccaacacgtatatattgcagaatggaatacaaagtttgtatgattgcgtaaaacagttgccctaaaagaacttcaagtttctgttgtaggcctctttgagccacactgtcttccttgtggattacggtgttaagtctctgccacaagggcgtttcaccagctaagctctagatcttacaacttctaataaaatggtcattttacttaaatctgaaaaaagtgtgtgggctgtgctacaggaagggagctagcacttactgaggaccaggtgctacagtggatggtttttcctgtgtcatttaatacattctaccactgtgagagaggacttcagtttcctaatgaggaaatcggtccctaagacatagagtagacttttgcttggtctaaaaaccaggtgttatgtcacttaccagaggtactccgattcaatcattaatttgtaataaatgatcaggtgttttcttcatgtttttgtccctaaaatttttttagggtggacatttttaaagggagggagcataggcagaaaaagtctgtagagtaaaaggctttttaagggctttaacagagtcgtgttttcagtaatttgtcaaaaagtaaagggtattatgaccccattttatgttcagataccagtttcattttcatgatacaaaattataaacacacagatctcaacatatacacacacatatatatgtatataaaacctgaaaatacctgttttggggaatgtggactacc

SEQ ID NO: 39755 - DNA, 1066 bp, Homo sapiens
gttaactaaatttgttccagtaaaagaattgtgcttgttgaatgtgtgaatgtagatgataaattccatcttatagccatgattaatggaggaataactgggatttgtggcaaccgtttttaggtaatttattttaaaattgtagagctaaaaaattgtaaaaagttttattttccaacagtgattttaacctggtattttatatttaactttctgtgtgtgtgtgtttgtgtatatgtgtgtctacttgtcttaatgtgtgcattttatgtcttgtgctggtggagtttgtggagggagattaatgtcagcctgttgttagttgcaggacgaggagcggaggcggcagcagcagttagaagagatgcgcaagcgggaagcggaagaccgagcgaggcaagaggaagagcgccggcggcaggaggaggagcgaacaaaacgagacgctgaagaaaaggttatggtcctttaagggcagctagaattttaccaagttagcctgaacgtaatcgattggctggggcagagcgggctggaagttctgtgtttcttaagaagcacgaggcagagcagggcctggctcccccagctttgtgattggacctgcaactttaccccatctggcccacctacctctcttctggactgtctccagatccccttatctgccaagttttgtctccttcaaacttctgaactcttgggcgtgtgtagcagtgagcctctttgcaaagggttcgtttcctcgggcactcatctttactgaacatggcccagcttgtcattgtgaaggtgacattggttcagtgattgcttaaatggcatgtggaccgtgggaagcagtaggagcgtagtaagacagttggctgccattcaacatttcaaatagatggtttactcaaatcactcacttctggttgatggtaaagagagcagatggcttagaaaacatgatacaggaaaatttagtatgtaatccagtaaatatcctaagttatttattttcatgtgtgtgtgtgtgtttaaatcaagtaacccttttaattgaattttaaaatgacagcga

SEQ ID NO: 39756 - DNA, 1572 bp, Homo sapiens
tgcccattgctatagctgggcccagtcctggccacgccggagcctcggcgggggcagctgggttgtcacggcagcacagtgcacatgcagagaggaccaggccatgtttttcctgtgctgagaaactcttgggttatttaatttttccaatgtgttttcataactcatgattatttgaaatacacttgtgttagtaactgcttctataattaagtggtcactgtaaaaaggcgaataacctatttttatatcagaatgtccaaaactcatgggtttgctttgttatagaaaaatgtgccattcatttgttgggtagaataaagttgtcttgtaattgtatctgctcttggtataactaaaagaggatattttgatttcttcctaaaatgttaccaagcaactgttcttcatgttaatactaagattcttgatagttccatttaaaagccacaagaagtcattctggtttattcctcactccaagggaacacttactttgtgtagacaagaagatgagagtctttccttcaggatttctaaacacagagcaagaagattcaatgaaaaattgggctcagggcagtaattggggctggcatttattcttaagagttttctccctcaaaaggtgaaggagtgacattgcgtattcactctgtgtgtgtgtgtgtgtgtgtgtgtgtgtgtgtgtgtgtgtgtgtgtagctctagagggagtagggagaaaatacaggatgaaattgaaaacagggactaacaacttttcactgaatgccagcaagctctctaaaattagttttctttggttgaacaaatttacaattcattgtacttcatttcacagcattaaacatttactcgaggcagtttattctgtttgctctttcatcccccttcttatttacttttttcttgtgctctaaaacttttgtcaatctttaacaaaactgtgctgttaccttttttaatgttaaaagaattttaacactgtcaactgtagtttgtgcagatgtatgtcagaaaaaaatgtacagtatgtgtcaaaatatatttgaatatcttgttgctgttgctgttagttcctggctctctaattttctgtctgttagggagtttcttaagatttgaaatacaagttaagaactatggaaagcatatttgttagattgttactttgggagaatgagtgtttttttttttttcttcatttctggtttcctgttaatctccttcctgataactgaagtaaacagggtggttcactcatgtcctccttgtccaggaaggactgctcttctgcattcatgggggctcagtgaaaaagagtgcaagtttgccttttggaaagtgctggccatagaaagccagtgacagcctatttttagttttgcattatctttaaacacagcagtaacaggtaagttaatatcctgccaaaatcagaagaggagagagagaaggaagtaacaggagcgtggaggaaggaaagaaggaaagcagaggagaattcagtccactgggataatggaaaggcataagtgactgggaagcaggaggctgagaatccattcc

SEQ ID NO: 39757 - DNA, 1107 bp, Homo sapiens
gtgaaaatattgtactacttttgtggcctgtttaatccaatattcattgctgtcagtatttgctaaatagtttgagcatttattactgcagcctgtattacactgtcagatttttccagtgtgaatttttctaatgctacaattaatagaaatacattaacactgatttactgcattatgattttaacaatataacattgattgttacttggatacacttagtgacattattacttggatacattgaaaactttgtatctgcatcacatcttttgatcctcaacaatccaccgaagccagtaggaacagggcaaatgttgccgatgggttgatgttacactcacccagagttgctgtgccagtcagaggcagagctgggccagtgggcagtattcctccctcatagtgaagggcgtcaggtcaacattttagcaccttttgagagtagtaattggattactcaggccaccaacagggatgaatttcaaactgatgaaactttgatacaatatgaggggtcttttaccttcctacttactcagtaaaggtatttttgtattctctgagcactgcatctttatcatgagtaaagcttagaaataatcaggtactttaacttgtactgtttctttcatggaaaaggaccaaactcttacccaggatctactggagcagctgttggagcccatgacgcctgtcgggatgcaaaagagaagcgctctaaaaggtatggacggttgcactagacgaggaacttcatctgtacctgatgagccctttcactcttcacgacaccttgagattatgtaaacagacttcatggcttcactctgtgacctcacctggattgtaattaggaatgctattgccccaagtgttcttaaaacatggaatttgaactcaccagaaaaatcatcagtactattctataacttattattaaatttggcatatttatagatgcctctcaggtacatgtaagatgccttaaaatgctgtattttaaaactgtacccctcaggttacacttaactggtaagagtcacctgcttgctaaaatctaacttacaagttttttgagagttgactatgactgggaaaagttaa

SEQ ID NO: 39758 - DNA, 1030 bp, Homo sapiens
gtttcaattccaagaaattttattttactttaccatgagattgccatttatgtaatttaaacactgtctagtttcttaattatctaactcacacgagggtaagttttttgttggtttcttttttggagtcctgagttcaaaggggacagaactaagggcaggagaagagaatggatgtgtcttctctcccatcttcccctcatcatcgaccgaggagcacaaagaagttctgtttctgtttttttcagaaactttattttagctgtcaagcagagaatagcttgaactattcagactattgttggcactgtttagtagtgaccacacgctcttctacccgggaaggaacatatgacgacatgctcctcccatgtcccctgatggtgtctgttcccacaatatccttctagtctgcatcgtgaagtggcttaggccaaagcttcctgtgtgatgacgcacgtccgagactgttccatctcattcctcgcaaatttgagctcttctgatcaattctaaatatttgattaattttaattctgaaagaaaattttgaggatttaagcttaggggattttatttttataaataccagattattgttagacttaataaatcactgttaaatttaaagatgacagttaccttggaaagttcactaatacttcgctccaaggcgtctgtaaaagaagatatctttattggagcaatgttcatgtgactgggaatgacagaagaatgggagatgagtagggacccctcaagcacagctgtcactcagaaattttaaatttgaaaaagaaatcgattttcatctgtatgccgtcaaggaaggaattcagttacagggcatctgtaacttaaatattgtaagaataactcatatggaagttcaagctatttttatactataatagagttatttaattttaatttgttgaattattagttaccactgtcatttcttcagctatggatatgtggctgatgttggggagacggacctcagtgtgttttatattgtctggtgtta

SEQ ID NO: 39759 - DNA, 1038 bp, Homo sapiens
atgaatgttaaattggagacagtggttccaacttcaacttggaacttttaaaaatgattataagatattaagtaatctaagcccaaagagagacctgggaaaccatagagtcaattgtatggctttaaaaatgttccaccttcctcccgtcaatcttttttgtatgagaatagatcccaaaatataaaaacagcctagttcagttgagcaaaatacgtaccatgttctgaacaggcgaagcatagctagggagtctcgggactttgggtttgtctgatttctgtaactgccattacctaaatattggaaaattgctgacatcgatgcagagactgtccagagccctctaagtctttgtggacaaagagtgacttatttaatgaagcagcctctccttcctgtgatgtgagatgtttatttctctttccagttttttaattatacgtcacccatcgcagactaggcacccataaatatttgttgggtaaattcttctcaatctgaagtctagtatgtatctttggggttgtgtgactttttggaataaactggatgaaatcgtggaattaaaaattcactttttgcatatactttccctcctgcaagtcatccagttacatcttgcttagtgttactaaatataactttctgaaattagctttccatgcaagaaaacatagaggaatgctatcttcagtacagtagacggattgctcacagacagctggaggctgcagtctataaatgatttgatcagatctctctcaagaattcttgtagcaagacaagaaaagggattggtggaatacaaacaaaaataggaaatgaaggaagaggagagtgcaaaggtgaggaccacacaggccgactgcattgcgaggccgtgctgcgcggggaggctgggtaccacataccagttgcatgtattcagaagaggagcaagacgcaagcaccttccggagggaatttgtctcagcctcatattctaagaggagtttctcaggcagcactggacatgggccgccctgaatattcttt

SEQ ID NO: 39760 - DNA, 1033 bp, Homo sapiens
acatattcgtagcactttgagcaaggatggaaacgtgttgttggagtgagtagactaataattctaatgtctttgggcacgttttcagttttagaatggtagggttgatattacctcaatggggtccctgtgttgggcagacacatatcaccaaatattttccaattttactattttatgatgccctgcttgcatttggtgttgtgggtctaatgtgccactcaaaatctaacccccatgttcagtttttttacacctaattacctggttttttctttcttcgctcacatggaaccacatttgtggcccatcgcccatcttcagaagtgaacgcagacctgcctgtggctccctgtgtccagcttctgttgtctgattcccagtgtctgtgcagattgatccgtcttcacatgaatccacccacacgcttgcccccttattcctctgccatggcgtttcttataacgttgagaaaaaaatgtaaatctgaagtcgtatctcagaaccatgtgtacaaactttcctcacatttatagcggtcactgtaatattcttcctgacattagcaatcgaattgagggaaaatgacttcataaaatatagtcaccttttaaataagagaattacttttagataggagatagaaatttcaaataacaaaggaaattccatatgtgcttataattttaaaaataatttgagagatctggatgaaaaagaatcaggccaactttagggtatatttttggttttggttgtatattaattcatgccacatgggatgtgggtctatgtaatcaagaatttttttaagtacaattaaaactaacctaaaatgtaccttggaaaaaagaagttagtatcctttcattttgcggtggctggcagcttgggactgtcagataaaccgtgcatggccattctttggcattaagattctgggctgtccagctccctgtgtgtgacaagcacttctggaccctctagaaggtttcattacctttaatgaagcataaaataaacacgtgctttt

SEQ ID NO: 39761 - DNA, 1052 bp, Homo sapiens
ctacattttgtttcctacacaatttgagactaatacacttaaagaaattattacttaatgcttcgatgtacagaatgtatgaagatgtgattttgtaacatagtagcagaatgaacagggtaaaaaacatgatctcaaatagaaataaaacaacaatcgaaaggtaggaacagagctgctaaaagaacagagtttttgtatgttattgaagttaagctggtataaatttaaataaaaatgttcttattttaggatgtaaaatataatcctcatggtaactaaaaacacacaaacagctatagagtatatatgaaaggaagtgagaaagaaatttaaatgtttcactacaaatagttaactaatcacaaaataagacaggacatgcaggaaatgagggacaaagtccttataagatatgtaagaaataaatagaaaaatgaccaaagtacatcccttttatcagaaattaatttaaatgtaaatagattaatctctccaattaaaagacaaagactgtcagaatggataaaaagtttaactatatgatgtctacaagagacttgttttagatcttatgtaacttgtgtctaaaggcaaaagtagcttgaaaggaaagaatggaaaaagattccatgccaaaaaaataaccaaaataaagtaaccaaaaacttaggaaatgcagtaaaactagttgtaagggaaaaatgtatagctattaattctaccctttaaaaaaataagaaaaaaacctaactttacaacttgaggaactgaaaaataagaacaagctaaacctaaagctagcagaaggaactacataataaagatgaagacagagatgaatgaaatagaaaacagaaaaataatagaggaaaattagtgaaacaaaaaattggttctttgaaaagatcaataaaattgataacattttagctacatagactaagaaaaaaagagacgtttcaaattactaaaatagaaagtgaaagtgggttttcctaagaaaaagaaagaaataaaagtgggaacagtactaccaactctacagaaat

SEQ ID NO: 39762 - DNA, 1033 bp, Homo sapiens
ctgcagataacatgagaattaagtgacatggccctcgctggcctttgggctcctctcccagcctctcctctgccctgtggccatctcagcactcaaacgtccccctgcttcttgttgctggttgctcggaaaccttgggttccagacaaatctttttccccggcaaagctgcacctccacagggccccttaaaattctactttcccctgtgttctgatctcagctgcggatggggaaagctccaacttaaataaactcacagtggacaggaacgactcatatttggcttatgaattagtcaacttgattgactactcgtcagggtgatgggcaaggcagtctttatttcagaatataagagatgctgtgccaacagtatttgggaattgcttctatatggtgcattttagtatttattgagctatctcatgcaccgaaaattatcgtatgtaggaaagaattaaatattgacttaatttaaaaattaccttttttctttttttgagacggatcttgctctgttgcccaggtgctggagtgcagtgtgcgatcttgactcactgcaacctccatctcctggattgaagcgattctactgcctcagcctcccaagtagctaggattacaggtaccccaccatgcctggctaatttttgtgtttttagtagagatggggcttcaccatgttggccagggtggtctcaaactcctgacttcaggtgatccaccctccacagcctcccaaagtactgggattacaggcatgagccactgtgcctagccaaaaattaccttttgattaaaaaacatacatggcacacaatctatacgttgatgtagttcccttttaagtattttttttggcaatttacatgtatattctatatgtaaagcagtaaaatgctacaatcattctgattggggaattttatgtgacagcatagtttattagtaatggtgatttcgagagcaatatttgaggaggagtattttactgcttttctctccggttatagagcaaggcaatacatct

SEQ ID NO: 39763 - DNA, 1044 bp, Homo sapiens
cgctggggtcgctggtgttggacctgtgctccgaggcttgtttcgggaccaacggcagatgctgttaggaccccctggaacctcccagtctgtgactgtggagagggctgaggctcagtattttggctccctgtgggattctaaaccattgcagttattgaggaccctgataaagatgcctcaactcctccctacaaggaggaagaggaacagtttttctacctacagcaatccctgcctctgagactggtacaaacaagagctgaacagaacccttaaccttaaacatcatgtcgcagcctgcaggtcctgtttcggggtctgcggggtctgtcacatgcccaccatgacccccctgggaaagtctccatcctcttctctgcccttgcctcggccaacacccttcagtaccaggacacatttctgcttttctcttacatcagcctttaaagtcagacgttgttttcaagatgagaagaaatactttagtaccaaaattttaggtacttttcttttctagtgtaggttacagtgtaatgaaccagtaacaaacaaaaataatataaacacagaccaggccgaggcaggcagatcacctgaggtcaggagtttgagaccagcctggccaaaatggtgaaacgccatctctactaaaaagacaaaaattaaccaggcatggtggtgcatgcctgtaatcccaggtagtcaggaggttgaggcaggagaattgcttgagcccaggagatggaggttgcagtgagccgagatcacgccactgcactccagcctgggcaacagagtgagattctgtctcaaaaacaaaaacaaaataataaaaataaaaatcggagttttattcaaccaatcccttctgcatgtgtggaaactgtggtggggcccatccctgccctggaagatcctttgcaaaaagagttctgtattactaggacactgacattttggagggacaagctggcatgaaagtaaatgtcaggctttctgtccagagggtgcctaccaaggatgaggcaggactggcttcct

SEQ ID NO: 39764 - DNA, 1104 bp, Homo sapiens
tcgttctcctcatcgtcttcacgttgagtgggctgaggaggaggaagaggaggaggggctggccttgctgtgacagaggcaaaggataaatccttgtaacagtggacccatgacatcaaaactctgttgttcaggggtcagctgtaaatattctcacttggttactcagtcatgaaaataattcttattatttgatcaccggcatatatttttaaattcggcattttaaaattaaattttctaaattctttaacagatttctctgtggatgtcaaactatagctttagttaataagtaaataattataaatttgcttttgacctaatttcagagatgttaaaacactttgctaatttagtttaaaatcctccaaattgtgtgcattttgtttgctataaagcagtgtttgagagaactttcaccttttaaagctgactattttgacattttgaagaccagtaatgggttgcttcatctttggttaatgattttgactgttttcatggaagcgggtttgttctgtaattttcatttaggctctcagttgattgcttgtgtgtttctcattgccttttcaaataagaatttcacagattcttactgaagggaagtagctctgtaggtttaaagtagttcagctgctgaggaaatacggagttagtaacagcttgaattttctgcgatcagctttgggtgaaaaaattgcaaacattcacagaggctgcttatgcattaaaactttatctgtggttatgcatccatatattcttctgcttacaaaaaaaatcaaaaggtatattaaagttcaggagactaagagtggttcgattcccccttcacccagctcttacacacccaacctgaaaaggacccttgagggaagtgcctgagtccccttaagccagcagccacctcagaaccccatggcgagtctatggtaggcccgtccactgatttccacctgcaaagctagcgcggtgcaatgccagatgagctggcacaggtccaatgtgtgatctctgccccatgatgctctgaaatcactgcctccagccccggagtcttagctgtgtggcatcttcttgttactttacccttctggg

SEQ ID NO: 39765 - DNA, 1047 bp, Homo sapiens
ctggattttgtggtgagaagggcactatgagttccttaatttaaggaaaaaatgtaaacttaatcaatgtaatcaatgccatgcaaaattcattgcaagtcaagggggatgggagagatgcaatgccatacggtgatacggacctttaagaaagtacaatctttcctgaaattcaaacactatcatacttcaaaaggtcaaaacccattccggaatttggcttttttaagactttttctctcctgctcactggcagctgtgtgtcttaacagcattctttcaagtcctggtgtactctgctgacagcactttaaaactttaacagcacaatgataacttgtactacatacttgatctgaattactacagaaaaataattatgttgcttgcttaatgattcccaggaaacttcgttgtaggcatatattttataagagtattatacagtgttaactatgcaagtaagttctaaaattacacaattatctgtgtaatgttttagtccaattactgtgatttattcaactctgttctaaagttatctggaattgtcatgctgcctcaatttacagaaatctataatagatttctatagaaatgtataaagacgtagcagtcattttgttgtttctaaatagataacatataaaaataaaggctttgttactttagtatttcagtagaaaaacaccagctcattctatagaactatacttccaaaacttagcaggggcattctggcctttcacttatcctttagttggaattgtctagggatgaaaagctggtggacatgacctgtataatcacagctttggtcatatttgcacataagagtccacaagctcttcatgtcatgatagcgtttatgcagccttttggagtgctgggagagtctcatcacccaaagataatgtttgctctttttttaatctttacctgatggaatagcaccaaggcccacacaaaaagtatgataacctctgtcacacatatcacagaacatcatttcttcttcatggtggggttgtccacatataatgcatg

SEQ ID NO: 39766 - DNA, 1051 bp, Homo sapiens
ttcattatagttgcctacactcaacaaacaaaagttgggaaagataaagggattattctagcgcgtcacattgacaaacaccgacgttaacacgctcagtccagcctgactcacttgcctcaggtcagagaggtcaccactgacgacgccgggccctcaagccgatcctaatccagcttggttctctcagcctcagccagaccatccgttcttgcctctgtcccaccacgtgcaggtgtaagcttccgccgcacttcttgtctgaatctgccaagaagaaactgcatctttcagctaaattcttttcactgatcagggtagagtttagcggttttttttttaagaaaaaaaacaaaaacaaaaaaaaactcttaagctatttggtactcctctccctccgggattctgtctctagattgtgaaagctgtcagagaatggagtcagggaaagccgtgatgggaaagttctcactaataattgcctgatataaagaattagcacaaaagactgccaaaaccacaaccttgcacaaaggccacaaaactacacaaaaaaatgcttcaaggacatttgcgcagcaactgcctgtccaaccttggactggccatcccctttgttactgatctttgtagccaaggataattgtttcaaaacaacttacgtaatcctcctcgtttttccttttaaaccccttatcttcctttacctccctgaatacacctatagtttactatgacaccatattctacattgcaatgcccactttcaaataaatttgtcatgtttggcaaacctgtctgttatttaggttgacaagatcaaatgcaaatttattctggagtcaacaaataactgattcagtcttccaatgtgcaaggcaaagaagaatattaaggagacactgtatagattagatccctgcctataggcagcttcaacactaatacaatatggtacgaatatataattgtactttaaggcagcttaggtgggaaaacaactagcaactaaaaaaaaaaatggagtttactaccaactaaaaaaaatgga

SEQ ID NO: 39767 - DNA, 1501 bp, Homo sapiens
gaaagtgcaacttctgggtgcaggaggagcaaacagggcaactgatagcagtttccacattaggaagctgcccagagctaattatgactgtcacaacacagcccccccttaactcaacacaccaaaataaagagcttcggttccgctttagatcctgaatttgacttctttgcaggtttatacgatggtcttagtgtcatgtggggtaattgtgaggatttcgattgtatttaattctccatggaaaaccagtacggtttgctactttttacatggcagggaaggctaaactttacctctgcccatcttagttcggagtgacccctttaacaaatgaaaggataacaagaaaaaagtttattcttggacagagtacacatcacaagggataaaccttaatgagaagtaacttgaaatggtggcttagaactacatttgtataccatcttcaacaaagaactgtagatttgcagagaagtgacaggacacaggagagcagttttaggcttcaaagggcaggaaattgggaaggtagatacatattcggaaactaatggagtaagaattgtttgcagattcccctggtaccttaactggtctggtaagtctaaagttatccccagtaaagaatttatatcctgtctttgggcggaagagggggaggatagagagagcttttccttcatttgctgcctcttgtcttcagctcaaatttgttgttgtttttatatcgaagaggcatgttttgggatgacattgtggttttcttcaacaccgtttaggtagtcagaggtacgtggggttctttttccttcttgttcgttatacttggtttctgctctcccattccccatttaaaaaaattgcttattttgataactctgggatagtgaaggaatgctgagagcaataatgctctggtcgtaaaacacattcagcttccgtgaacttgtattttttcttttttttttttaagtgaaaggcaagtttattaagaaagtaaaggaataaacaatggctaccccatagacagagcagtttgcaaatattatgattgataattttaggtctttaagcctttatcatatttgagaacatttatgtaaattatctttaatatttaatcactatgttttaatcatacagctctcacgatatccagaaagcatgttaacagcaactatacctgagtgcattcagttcttaagagatgtgtctgaaatatataatactctatttttctttctgttaagcagtgccttttattttattttattttttaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcaggtttgtgctgtctttgtactccaaactttcataactgtcccattgaaaa

SEQ ID NO: 39768 - DNA, 1028 bp, Homo sapiens
gctttgaatttggagtgaaggaatcatcatgtcccccttgtactagcacttttaaatggcaggatgagtgccttgtgtgtatctgtttgagggctcagccaaatcaaaaggagaaacatgatggaggtcaaaatgcttgacttttccacttaaattgtgccagatttgttgctttcaataaacgtttaaataaagaaccttcaaggaattctttagctattaaaatatttttattgattctttaggcaatataattatacagaaaatgtttacttattcactgaaaataaaatatggcagttgaaatctctcgaggtttgaatttcaataaataatattgttgctttgagaagtagtttcagagtgtacatcctaatatgtgttttattgtaaatagttatttcctgaaatatttgatgccttggaaagtctacaatctcctgctatttctcttagcttaatgaaactgacatcgtgtctagaacgagccttgggtgatgtaagtgtgagaactctttcattattggcccattaaattatctgaatgaacatgaaactattttacagttgtcctcagttttcttgattattttcctataagataaaatcatttagtatgaatttttaatatttcccttttgaatgattatgaaatcaaaggattggtgtctaagtacttttcacccttcatttgtacaaacagttgcttcatggataatgtttttaatgtttattggctcataatacaactgttacacaatttttgtttgaattttaggtatttttactgattgggaaggaatgcccctttcttttaagagatctgctttcatctgaggagcttgctcaagtcttcagtcagtctgtggtaagcttgttcatctaaactcatggagtatattagtccgttttcatgctgctgttaaagacatacccaagactaggaagagaaagaggtttaattggacttacggtttcacatggctgaggaggcctcagaatcatggcaggaggagaaagacatttct

SEQ ID NO: 39769 - DNA, 1031 bp, Homo sapiens
gttaagaaatgactttggaagtgactctaatgtgtacacaaacaacacacatgcacacaccacacatacatacacacacgaacacatacctccatgctgcatatacacacacaggcatacacacactctaatgtgtacacaaacacacatgcacataccacacatacacacacacacatgaacacatacctccatgccacacagacacacacaggcatacacatactctaatgtgtacacaacacacatgcacacaccacacacgaactcacacatccatgccacatatacacacacaggcatacacacatgcaggcacatacactacacacacacacacacacacacacaggcacagttgcatataaacacacaaatgtacacacccccacaccacatatgcacatacacatatacacaccacacatattcatagtcacatacacaaacacacatgtgtatacaattattaatatagtcttaaagtcattctgttggttaagaaaatatttcctgaacacctgtttgctgaattttaaagactgtccatttaatttgcttagaccttagataacaagttaggctaaaagtactatatccatcaactctgaaagttctgtatgtttatgtatggggaccagttaaccaatgtatttatttttgatgttttagatattggcaaaacacttgaatgatggtaaaatcaatcagcttcctcttttccttggagagcctgctatggtaagtattaggtattttccaggctaatattcttgtatttatggatgtcgtcagcacttctctaaaattaaattaattttggcttgtggtttgctcaagaaaaatacttctgaaacattgctgtgctgtctcagcttcagccaccaatcagctgatgtttgccaagctgtcactccttaaatgtgttttttaaaggcctgatgatttagctgccctgtccctaagcaaaatttgtatttgttttttacatgtatttgtgctgtagaacggacatatatttgtgccttgtt

SEQ ID NO: 39770 - DNA, 1045 bp, Homo sapiens
gttttgttttgtttacttaattcaacttcttcaattaatataggcttactcatcatttctacttcttctttgttcaggtttggtgatttgcatggttcaaggaatttcttatctaaagttgttcaaatgttcttttattccttaactgcaggtggtttctgtagtgacactgtcttccattgctgggatgcgcaatgtgtgtcttctctcttcttgagagattatgatcagagtattataggcttatcagttgtatcagtcttatcaaagaaccagtcttttgtgtcattgatttttccctgctctaggcagagatggggcagccactaggctcacctcatttgttttcctcctttcaagattctccatcctttacttcctgttgtctgttgtctgaaaatagtaattttgtatttttgtccagttttttagttatttaaagtgggaggaccagttctgtaggaattattccttcttggatggaagctagaacaggacacttttggttgtaacagaacatcctgattcactatctgactatgtataaagaagattctctctcttataatcaggaaagaaggtggtttgagtgctggttgatgtagtggctctgccacgtcaaggcccaagtgctctccttctttctgctctgacatccatgccctgtcagtcactccatttcctgactgcatgatgtctgcagcagtaccagacatcttcaccattacaatgatcataagaagaggaacattgtctttctacatgataccttttatcagcaataaaacacttcagcagcatttaatgtgcattctctatgtagaaatcagtatgttttcatggttttggctttttgtctttcctaatttttggacggtcaattgttacctgtattagtctgttctcatgctgctaataaagacatacttgagactgggtaatttataaagggaagaggtttaattgactcacaggtcagcatggctggggaggcctcaggaaaccttacaatcatggcagaaggggaagcaaacacatccttctt

SEQ ID NO: 39771 - DNA, 1047 bp, Homo sapiens
aaactcaggcccggacagcagctgagcagctgtgtggtgatacctggagggcagccatgtgaacctgccagccaaccagcattcgattttttttaagcaggtatatcgatatgatcagatttttggtttttgaaacattacagtgcagtgagtggatttaaagtggccattgtagtaactcaggtaaaatacaaaagagctagaattaggaaaatggcagtggaaataggaagaaacaaattcaagaaatgtttcagaagtgaaactaataaataagtcttgctgtggaggtgaagttcctccttgagtaccggcgatggtagatggtgttaatctaaagaagaaggaggaaaggttttacagggagaagaagattaagtgggttatattttaattgagtagatggcacctctaacacatgttctcgtagtgaaatatggacctaaagttctattactggcaagagacagacatctgggagttatcctattttatgtgtaaagtaaaagatgatgtgggatggagacttaaggaacagtccactgagagatcaggagtgagcagaggaggaaggagaataaggaggggataatccccacaaaagtccaagggggcaagtttcaagaatgagaaaagaaacggtcaggagtatcacatgctacagaggtaaagaggtagaataggactagacatagggacttgggtcagtaattaggaggtcctgatggcatcagagagttactgcagcacagggttgggagtggaggcaaagccgacagggagtttggcagtggaagagactttgttggggaaggcagggtcaaggagagtcctcacaggaagggagtgcctgggcaaagtggtgggtcgagagttgttcacatggattgaacttaattgtatctttgaaaacaattttgaagtttcttacattgcccttacattttctctataaaatttttttgcaatgtcatcttcaaaccctaacaggcaactaaaattcaaacgtgtattttaaccatacatagtcaccctggaaaaatgctc

SEQ ID NO: 39772 - DNA, 1148 bp, Homo sapiens
ggagtcttgctctgtcgcccaggctggagggcagtagcacaatcttggctcactgcaagctccgcctcccgggttcacaccattctcctgcctcagcctcccaagtacctgggactacaggcacccgccaccatgcccggctaattttttgtatttttaggagagacggggtttcactgtgttagccaggatgatctcgatctcctgaccttgtgatccgcccacctcggcctcccaaagtgctgggattacaggcgtgagccaccgcgcccggccaacttgaattttatagagtataattttcaggagtcacaaaatattcttaaaaacatttttttccaaccattaaaaaaatatgaaaacattattagttttcagactgtaaaaaagcaggcagatttgacccatgagctggtagtttgccaatttccactttaaattataggctttatacacactgcacacggaggctgctccggtgagtccatgagtgagtggggagtgagtgggaagaccaggatatgaccatgctgctgtaggctttatacacactgcacacgcaggctgctccggtgagtccatgagtgagtggagagtgagtgggaaggccaggacatgaccatacaccgctgtaggctttatacacactgcacatgcaggctgctccggtgagtccatgagtgaatgaagagtcagtgggaaggccaggacacgaccgtatactgctgtaggctttatacacactgcacacgcaggctgctccggtgagtccatgagtgagtgaagagtcagtgggaaggccaggacatgaccgtgttgctgtaggctttacacacactgcacacgcaggctgctctggtgactccggtgagcgagtgggaagtgaatgggaaggccaggacatgaccatacactgctgtaggttttatacatactgcacatttagggctataatacattcaaaaaatatttctttcctcaacaataaattaaccttaacttactgtaacttttttactttataaacttttaaatttatttaactttttgactcttgtaattaacacctaacttaaaatacaaacacattatacaactggacaaaaaattctttctttatatcattctataagcctttttctattaga

SEQ ID NO: 39773 - DNA, 1048 bp, Homo sapiens
tcttcttctcttcatcaaggcctgcttcccccagccctggaccaagcccactgcctctttctgccccgcatcgaagccctctgcccaacttgagcagctgtctgactgatgatcacctttgtgctgggatatctggcatctagggacaccacctcttcttcccttcccccttaagcacctgttctctgctgacctcctcccttcagagttcctcagttacacccactgtcttctttacctggtcttgctttaaaaaactgtatccatgttgactgtccaattccagcagttttctttaagtgttttctggaacagtgtgagggaggtagggaggaaagacatcgtaggagtcattaacatggtaaactctctctcccatattattgtttacttacccagattatcctgaggattttgtcggttccacagggtatggttcttgatggaatgaacagattaccctcagattggaggataagaaattaattgttggataacttaaggttactcagtcaccttggatttgagagctcacctttgaattggccacctgggcagagctgggtctgtgacactgtgagcctggcgatgcatgccctcatgcatctactgacccaactctttttcttcagatgtcaccagcacctgcctagctgtcaaggagtggtttgtgtatcctgggaacccactgaggcacccggacctcgtcaggccgctgcagatgaccattccaggtacaggcagcctttctttaaatgaaccacagatctttccattctatgataaaagtctaagaatgcatcagttatggaaagcatcttttaccagaattgcacaaatactagtttttatttaaacccttggctcatgattaatgtatccatctaacaaagtcccaaaataatggaaggatgatgctgtggcaggtttaccctggaccatctgcggcggtgctctgcctctttctccatccaccctggtccaggtccacagcagtggagagagaaaagagacagaaggatggccgtggtcagcgcatgttgctgcc

SEQ ID NO: 39774 - DNA, 1158 bp, Homo sapiens
agagacccacaaagagactcccacacaataatagtgggagactttaacacccaactgacaaatattagatcatcaagacagaaaattaataaagacattcatgacctgaactcagctctggatcacttggacctgatagatagccacagaattctccacccaaattcaacataatatacattcttctcattgctgctcggcacttactctaaaatggatcacataatcggaagtaaaacacatctcagcaaatgcagaagagctgaaatcataacaaacagtctcttagaccacagagcagtcatatttgaactcaagattaagaaattcactcaaaaccacacaactacatggaaattgaacaacctgcccctgaatgactcttggttaaataatgaaattaatgagaacaaagagactacttaccagaatctctgggctgcagctaaagcaatgttaagagggaaatttatagcactaaatgctggaaagatctcaagttaacaacctgacatctctactaaaagaactagagaaccaagagcaaaagaaaaccccaaagctagcagagcacaagaaataaccaagatcagagctgaactgaaggagatagagacacaaaaaaccttttaaaaaaaaatcaatgaatccaggagctgtttttttttaaattaatagaccactagctacactaataaagaagagagaagaatcaaataaatacaatcagaaatgataagggggttatcaccactcacctcacagaaatataagcaaccatcagagaatactgtaaacacctctgtgcacataaactagaaaatctagatgacattgataaattcctgcacacatatgccttcttgagactgaaccaggaagaaattgaatccctgaatagaccaattgaatccctgagtagaccaataatgagttctgaaattaaggcaataataaatagcttaccaaacaaacaaaaaaaaatccagaaccagatggattcacagctgaattctaccagaggtacaaagaagagctggcaccatttctactgaaactgttccaaaatattgaaaaggaaggactcctttctaacttgttctatgagtccagcatcatcctgataccaaaacctggtagacatagaacaaagaaaga

SEQ ID NO: 39775 - DNA, 1023 bp, Homo sapiens
agcccagatgttttctgttcgtgaactagatgtgtcctcctgagggaattcaaatcaaagagttggcaaaactgggtggtggcagtggtagagaggcatgagcacgggcctcctgacacacacacacacccctccctcccccccctcccccctgccaggctgcctggagcagggctcggcccctgacaccccgcctcccccacaggctgcctggagcagggctctgctggaatcacggaaggaacacacaccctttttgagactatcagaattgcaaagcctggccagttggtgcaagtgtttatccgcctgccatcaccatcgggtggggtggtctgtgacaggctcagcaggtgttggtaaaaggacccttggccagaaatgcaaaggggacagagcaggaactcctcacaatcataacagcagtgagctgtttcttgttctctgtgggaaaatgcttggagcctaagtcttgtacgaaaaaatagataaataagcaaaatgtagactcagtggcattctgtcattcagtggcatgttgcacatccagactctcaagatataatacaagtttctctgcagctgttgggaggtggcactaaatcgttgttcttgggagttagattctgctgcctgaaagctgaaagggaagcaaaggcctccccagttatcctggtgagacgagagcttggtgtgtggggagctgagagctgggactcatgggtgggggaagcggttaggttctggccagttgccttggcagagccttgctggctcctaggaaagagtaggagtctctccattgcatctgggaagtgggggtggccgggaaggggaatggcaagtggggaggggcaggcagctgagtctatttggctggacctgtgctctgaggggcaggtgccagggcatgagggagagtggcgtgtgagcgcacctgagtggggttcccctggtggcctacacccgtcaggggcccatgtcacccacaggaggggaagcttcacttgggaggtgaggggt

SEQ ID NO: 39776 - DNA, 1344 bp, Homo sapiens
tatgtccgaaatggttttcttggcacatagccatgctcagtcatttgcagctgcctttgccctgcaacagcagagttgaacggctgcgagagacatcatatggcccacaaagccaaaagtgtttccatctggctctttccagaagagcgtgctgacccttggctggagccagcaggtaagtccgcggggagacggcaggatggggagccccatgcttttgtctctgtgcccctcctgcagccaggtctgcacgcacacacagtgacagtaataaccccatgcgtgaatgtagcaagttttaaagacattagagggctttggtagttagttttcatgtcattcctttgaggtaattaagtcctatcttattcttagaaaaatgaagatataattatgtgtcttggcattggtccttataaaggagctgaagtgaggatataaattccctgactcttggttccacttccacctaattctcctacacaaagaccctcgccatgataaaacctggatttgggagtctgtaggggtagggctgtggctgactcacatggatctcctcacacctattagggggccttacaagcatcaagtgcctttttaagatgaagtcatgtttccagttgacataataattgtgcatatttatggggtacagtgaaatgtttcaatatgcatgtatgttgtgtgatttaatattgaagtgtaatgttgcctgttggttcagagcacagtggtaccttagagacagttcagtcaagcacttttgtcttatagaccagggttttaggctcagattagtggaacggtttgcaccaggtcaaggtatagtgcatgtctgagctgatcaaaaggccaaggttccgagttccaccatgcactccctttacttcctgtcttctcaccagacagtgagacacctctaaagtgataagcaggtatgccatgtgtcaaaagcagatttagaaaccttctcataaaagatctttactcagtgctgctcttggtgaattctcactttacaaattgaatatttttctgtaggcagaatcaaaatgctttgaagacataatgagatcaagccgttaagatggcgctttaccgattaaatccctaagacaaccatgaaaatacaggattgtgtaatatgttttcaaggagatatttacaaaaatgtttttacttccctacacaagttcacagaagaaatacaatttttaaagaaggaaaaatgctttcattattgggcactcaataaaaatttggtgaatgaatgaatagtagatgtactggtcagtttgggctgccataacaaaacaccacggactgggtggcctaaaacca

SEQ ID NO: 39777 - DNA, 1015 bp, Homo sapiens
cctggacttggcagcagggccccactttcactgactttgcccatagtcctcataattgtagtaggtgtctcctgctacagatcttgatacgtgtttgagaaaatgtgatctctatgaggaagcaagaaaaggtaagaaggactatagcagaaagcagagaattccgagtccagtttggagagagtgaggaagtcaactggaaaggtctctcatgataaaggttccaggtgttgccagcagtgctggggcaggccccggggctgaacccgccactggatgtagcctgtggcactcctcgggtgacctttgcctcagcaaacttagggtagtttttttttttttttttttcctgctcccatacctgactcctagataggaggtttctcttgtcctggagaatcttaagagaagtatgtctatgttcttggaatcaggagagctcagttacttgggggtggaaactgagtcttttataatttccatggaacctttgcaccttgtaggtactcaataattaattgtcagtttgctgaatatgtccataaatcttatacttaagagtttatgctataatgctggtagatggattttatcttcgtgaataagaatctttcacatgtaacttatttttctacagcagaagcaaatttcaggatgtaatttcaattttacaaaaaatgtaccttttttgaatatagcaatctaatttctcttttaaacccattctgtgagtcggcagaaatttatcgcagagacattgcagaggtgagacggagactctcagttgcccttgagctttcctggccctgctctctgcacctcacagacttccccagcggggcggcccccaggccttgtgtcctcctgctcccacatgtgctaagtggcaccttagggggcccttgctgcccagacagtccatgcagacctttcttttctgagacgcagctacgtccccgagctctttgtggaagacagggaaagtgatggtctgctctaagatgccccagccacc

SEQ ID NO: 39778 - DNA, 1024 bp, Homo sapiens
tggttgttttgcccattttggatttgatcatatgtgtaattctttgaggtagagaaataaaagaggtaaattatacgtaaattgtgaaatgggagcatggaaagtttggttgacttttagcttgaatgaacctgacagaagtcggtgtatttaggaagaacagggtgaactggtgtggacccagcaagttccatttcagccatttactctgcccgagacgagatctcattgcttcttgatgctcttgcaccaggagtttgcaagttcctgcttggaacagaattgtttaatgtttattattgactcgttgaggctttctttcactgaaaaacttacccacacgtaacactcgttcagagcacaccctgacttctaagaatgaacacgtcttgtcatttaggccaggttattttcaagagcaaacttttcagttttcagtatgggaaataatcacctttcttcttcccttcactcagtgttagtgccatgaatagggcattgttggtcgggtgtctgacccaggatggcatctgttagatgaacgggtgatgtcactttacattcctaaggagtattcacctgtccttgttgcagcatgtcatagcagctttacccgtgaagggccgtcagagcacatcagtagatgatagtttggtgccatctgtctttatttccattatactttaatttcttgaggataggacttccacatttgcacttggttcagtagttgtcagctgttggtgactgagctgaaccaaatccagttcttcattgcacagatgagatcaccacaacccacagaagtggcatcacctgctttcagccccttggccaggtggtgagagagctggggcttccagttcagggctccctctgctgtaactcagggatggtccctaagctggtggttaaagtgttcatatgaagtaggtccaatctgtggttgttgctgtaatcagtgtgtcagcacagagttccgcaatttcagtatctttctaaataaccgactgtggaatgtttg

SEQ ID NO: 39779 - DNA, 1046 bp, Homo sapiens
agaacttcataactgttaaagaaattgaatccgtagtttgcaaactcccctcaaaagaggtctctagcccagaggtgtcactcggtaatttaccatatgtttaaagaagaattaatgctagttctacattctcttccagaaaatacaagaagatagaccattccccagtgaggccagtattaccctgacacccaaaccagacaaaaaaaaaatagtgcaaaatagaaaactacaggccattatcccttttgaatgtaggtacaaaaatcttgaacaaaatatgagtgaatcaaatccagcaattaattatacactatgaccaagtggctggtttagtacttaaaaatcagtcagtgaaaccctccatattaatagattaaggaagaaaagtcacatgatcatatgaatcattcagaaaaaggatttgacaaaattcagtgcccattcatggttaaaaaaaaaaaaaactttcagaaaaatgataatggaggagatctttctcaacttgataaagaacatctacaaaagcccctacagccaatgtaacacataatagtaaaagactaattgcttttctccaatatcagggatattagggacagagatgtctgtcctcaccactcttattcaacatagtgctggaagttctgtctagtgcagtgaggaaagaaaaggaaataaaaagcatgcagacaaaaagaaggaaacaaaactgtctctatttgcaaatgacatgattctctaaataaaaaatcccaaggaatctacaaaaaaaactagagctaggtggggtgtggtggctcatgcctgtaatcccagcactttgggaggctgaattaagaggattacctaaaccaagaagttcaagaccagcctgcgcaacatagtaagacccccatctctacaaaaaattgaaaaattagctggatgtattagctactcagggagctgagctgggagggattgtttgagccagagaggtcagggctctggtgatccatgatcacatcaccatactccagcctgggcaaccgagtgagaccctg

SEQ ID NO: 39780 - DNA, 1055 bp, Homo sapiens
gaaattaaaagttttaggacagaaaaagctgttccgtgcagctgctaacccaaagaaaccagtgcgcctgcatcagaagtggacttcaggtagaaatggccatgagaggaagaagggacatttgagaagaaaggtcagcgccccaggattatttccggattctctagatctgtaagttagtatgcacagtttccagatgcatcagatgaaaactgacacaactgaaaaacgaagcagacatatctgtaatcacagtgggacgtgtgagcacaggggtccacaaactgtagccagtaggccaagtctggcctttggcctgcttttgtgtgggtctgtgagctaagaatgctttttggagtttttaaagggttggtttaaaaaagaatatctaacagaaactgtagggggccagtgaagcctaaactcttcactgtctggcccctgcagaggaagtctatggagctttaacaaagcctctctcaagagctgataggacaaacagacagaaggttagtatggattcgaattgttgaacacattttgaacacagtgaacacactcatcctaacggacatatagaatcctgcacccaaaagctatagagtaaacacttctccagtgcatatgggaaatctaccagaattgactagatgacagctcataaagcaagcttcagcaaatttcaaacaattgaaagcatccctcttttttctgtccacagtaagctagaaatcagtaataacaataagtaaaaattctgttatttgaaattaaaatagtacacttctaaataattcacagggaaaaagcagaaaccacagtgggcattataaaatattttgaatgacagtgaaaatattgtccataaaaaatgtgtgggatgaagctgaaagctgttctgagaaggaaatttgtagaattaaatgaatatactttaaaaaaaaggctgaaaatcaatgatctaagtatacatctctataaattaataaaaaatcaaactcagggagtgtggtaggtaggaaggaaatagtaaaagcaggaactagtgaaatagg

SEQ ID NO: 39781 - DNA, 1042 bp, Homo sapiens
tccagacaccgaaggaggaaccagcagctgtgctacgccctttcttccagagagcagaagaagaaggaaggctttccaactgtttctctaagtccagcaaaatcctgatgcaaaaatctaacaaagacatcacaagaaatagaaatttaggccattctgtttcatgaaaataaagcttccaaacaaaatactaacaaatcaaatccagcaatatgtaaaaccaataatacatgatgaccaagttgggtttatttttggaatgcaatattgatttaacatttgaaaaccattgtaaataacaatgaataagaaaaaggatataatggatgctaaaaaaatacttgattaaattcagtacctgttcatggcagtcaccttcaggcttctgtaggaaatacacttctcactaacacgtcctgttagcatctgctcagccctgtgtacgtgtgtaatggttgctctttttaaaaacgagtgttgttttggataattttgtagaataaaaagtgtcgcacagcactattttagggtatagtagtgctgtgcaacaaaaatcattttgattaaacctagattaactctcggataatctcagttcatgatacgtttcttacagtggtgagcaaggttcttctattttagtaagtgaagccttaacttctaaaggagctaaaatatctgttacttttttcctaatttattttagttttatttaaaataactcttggttaatttgagctacatagataagccagacaatgacggattcagtttcacttacctcatttacggactcatgtggacactcgctagatatcggtatcactttccatggggccagtgtcagccaggaggtagagagtatctcatgcagcatcctcgctaaatgcaggaaccctctgcagcatcttaggatagcttccccgtttgagaacagaatgttggacatcaaggtaaatttgacagtgaaaagaaatatttcatattggtatggtcttaatttgcaaagattatcagcctatcaacctagtgagatacataa

SEQ ID NO: 39782 - DNA, 1860 bp, Homo sapiens
ttatacagtattattaatgacgtgcatggaacagtgttttcactgcatccatcacatgagaccaggtgtggaattttccacttatagcagttttagattttggattttcagattaggagtgctcaacctgtagcttcttccagaattcttaaataggattcaggactcccaaacttatggttaggtagggcgagcagtatcacacccagtctgacacatttttaatttttgaagtgcttttcactcctctccccatttctcacacacacacacgcacacatatatgtaatacacatactttttttttttgaaacagggtcttgctctgttgcccagcctggaatgcagtggtgcaatctccactaactgcaaacttccacctcctgggctcaagtgatcctccctcctcagccttctgagtagccaggactgcaggcgcgcatcaccatgcccagctaatttttgtattttctgtagaggtgaggtttttccacgttgcccaggctggtcttgaactcctgggctcaaagtgatccgtctgcctcagcctcccaaagtgctgggattacaggtgtgagccaccgcgaccagcccctctccctattttttaatgaggaactaatactccctgcaaaagtgccccacagatatcagactaatctgataggtgtagttatgatttattacttgaaaatactccccaaaggctgccaatttagttggggacgctggctgctgtccagcttaataaatacaatcgctacatgactcctggaagatttccaagtaaggcctcaagccaagctcatttggaatgtgttttaatacccgcagggatgagaaaagcggtgtgatccgtgagagagcataccggtctgtcacgataaagcactccaagctttcatagcggagagaacacatttggtaatgtgttgccatcactgttcctcacatacacacacacagattccagagtggcataggactgcaagtatttagaacttagaagcagcctgaattttatagagagcaaaagcagaacaagaggagaaatgtgcttctaataagccaataagtattggaaagtagactgtagaaatgaaaggtaaagtagccttagtgtagcctgtaagtcattccatcaaggatcttttcctttctttatccaatctcttgaccaagttccaagtgattatacgttctagtttgggaaaaaaaaaaagtataggatagaatattcaacaataaaacaggaagcttgaaggaaaggttgaatgttccatgttccatttcttgatctgctgatgttgttttgttttttgttttttgttttttttctgacgttggcatttctgctgaatgttcttataattaagaatcgaaagattaagatatattaaatccaaacactttttaaggtaagattgtgtggtaatcacctaaattgtcgtaataggacttgaagattcttttttagaaatgattgtttaacctacagaagctgcttggtgttctttttctgggggatttaggagaatatgttctcgaagaacctcttgggatgtggtcatgctgaaggagaactgtgctgcggttcatgtctgggaggagggtgcagccaccattgctgcctcgccttgggaacagtgtggaagggtgtcccctaagcttccttccagccacatctggccctactttgccacatctggcccctcacatctcatttgcatctggtctgtttgcagagatctcggctcaccaaattccacaacctgaaggcagtcgtctgcaaggcctgcatgaaggagaacagacgcatcactggccgagcccactggggctcacaccacgcaggtggga

SEQ ID NO: 39783 - DNA, 1805 bp, Homo sapiens
tcacgatacctttaaaaaatcacatgagtttgtatgtaatcaggccttctagtagagacaaacaggacaaggtgtcatggactgggaagttatggaaattttaaagcacgaaaagtgtgtgtgagtgaagtttgtggagaatggggagaagctcacaagtcccagaagtgctgctccatgcctcaaccagggccctagagggatgggcttggtcatgggcgccatggcctgcatgggtccagggggccccagggaagaggagtggttgggctgctcaagtctttgtttgcagagtccgacctctcaccaccaataccagattctcctggggtagggtttaacacgcagatctgtgactccactcctgagccgggttctctggggatgcaacccttaaatttgcgttttttcatgaccctccctctgatttaagtacggggatactgctgacctggtgctgccttgccaccctttacatgctgtgtcatttgggttaagacatttgacaacttactaatcttctgactatgtgttcccacagggaggtggggaagacagggctccagctaccacaggacgggctctgggtatagccgttccagtcagggacagccgtggagagaccagggaccaggtaagaaggccagtggtcactctgctgggccacctgcatggcactgcctctcaccttgtgcttttgctgataactgccttcctctgtttcagaaaggttgtatagttccagtaaataaacagataaatataccaatgcatctaatttttatcatttagtgaaataaagacaaataatttccatggttgatgctagccctgtctgcatctggccactttattcattttctatcagttcattctgctcaagatccagtttttgtaatttacttgctagaaggtacttgtaaagtttacatgtggaagatccattgttctcatgaaaaaaggacaggttatagtgtttcaccaatagctgcattcaggtaataggattctgatattttccgtgacttggattacagtgtgaggtaggaaatagccccaaccctttgttttttacatatgttgtacagatgctgttttaatgcatgtatcgtgctgaatttaaatacatcgagaacttcacatcagtatttgagctcaaattccgtatagttttgagagccaaactttataaactttgaaattacctaatatttatcatttaatcccttaaaatccaaatcagcctttgatttatgatatctgtgactttcacaacgtctaaaatgtgtagagacttcgcaagctgctcaaattattccctaaaacacagcaagtcttcagtgtgaatccagttgacctttggggtctgtctcgggtggagtctgcatggaggctgcggggccgcacatctgttgagtaccgtgtcctttcctcttgggtctgtacagtcagcaaacattgcgagtccactgtattgctgactgtagatgagaattgatggtgaatgtttttgaaatgcccatccttgagagagagctccatgaatttaatgcccatctttgagagagctccaggaatttagatttacatttgcttgagatgtttccttgaatgagcttaacctgcagaaactcaaccccaccgagtcgtgcagtcactgtcatgtggagcttccagatggccccactgaacacgtgcagtccatcctttcatggtctctactacagtgtaaacataagggtcacttccacttcgtcactaactaaatcatccgagtatttataccagtgcagggcaactgagat

SEQ ID NO: 39784 - DNA, 3456 bp, Homo sapiens
ctgcagacaggtgtgcctgcctgtcacagaggaaactgtaaagagtgtgccatcaggcctcccactgatgggactcatcgccacaggcaacgcactgaaacctttccatcaggcatctggcctggataaccttgagtgtcctttctagctctggaattctgtgactttctattctatttattgaatggtgggtgagacattagtaaagtgtaactcttaggagtcaataaggaaggtagaactatgtcataactcttaggagtgagtgggaaaggtagaactatgtcataactcttaggagtgagtggggaaggtagaactatgtcataactcttaggagtgagtgagaaaggtagaactatgtcataagccttaggagtgagtggggaaggtagaactatgtcataactcttaggagtgagtggggaaggtagaactatgtcataactcttaggagtgagtgagaaaggtagaactatgtcataagccttaggagtgagtggggaaggtagaactatgtcttaactcttcggagtgagtgggaaaggtagaactatgtcataactcttaggagtgagtggggaaggtagaactatgtcataactcttaggagtgagtggggaaggtagaactatgtcataactcttaggagtgagtgagaaaggtagaactacgtcataagccttaggagtgagtggggaaggtagaactatgtcataactcttaggagtgagtggggaaggtagaactatgtcataactcttagaagtgagtgggaaaggtagaactatgtcataacttaggagtgagtgggaaaggtagaactatgtcataacccttaggagtgagtgagaaaggtagaactatgtcataactcttaggagtgagtgggaaaggtagaactatgtcataactcttaggagtgagtgggaaaggtagaactatgtcataactcttaggagtgagtggggaaggtagaactatgtcataactcttaggagtgagtggggaaggtagaactatgtcataactcttaggagtgagtgagaaaggtagaactatgtcataacttaggagtgagtggggaaggtagaactatgtcataactcttagaagtgagtgggaaaggtagaactatgtcataactcttaggagtgagtgagaaaggtagaactatgtcataactcttagtagtgagtggggaaggtagaactatgtcataactcttaggagtgagtgagaaaggtagaactatgtcataacccttaggagtgagtggggaaggtagaactatgtcataactcttaggagtgagtgagaaaggtagaactatgtcataactcttaggagtgagtggggaaggtagaactatgtcataactcttaggagtgagtgagaaaggtagaactatgtcataactcttaggagtgagtggggaaggtagaactatgtcataacccttaggagtgagtgagaaaggtagaactatgtcataacccttaggagtgagtgaggaaggtagaactatgtcataagccttaggagtgagtggggaaggtagaactatgtcataacttaggagtgagtggggaaggtagaactatgtcataactcttagaagtgagtgggaaaggtagaactatgtcataactcttaggagtgagtgaggaaggtagaactatgtcataacccttaggagtgagtgaggaaggtagaactatgtcataagccttaggagtgagtggggaaggtagaactatgtcataacttaggagtgagtggggaaggtagaactatgtcataactcttagaagtgagtgggaaaggtagaactatgtcataactcttaggagtgagtggggaaggtagaactatgtcataactcttaggagtgagtgaggaaggtagaactatgtcataactcttaggagtgagtggggaaggtagaactatgtcataactcttaggagtgagtggggaaggtagaactatgtcataagccttaggagtgagtgagaaaggtagaactatgtcataacccttaggagtgagtggggaaggtagaactatgtcataacccttaggagtgagtgaggaaggtagaactatgtcataacccttaggagtgagtggggaaggtagaactatgtcataactcttaggagtgagtggggaaggtagaactatgtcataagccttaggagtgagtggggaaggtagaactatgtcatttacagatgtatcatcaagaacatgccccatcctgccctgatctcagaaggcaggtggagtgggacctgtttggtactgactcctctgggaatgataagagtcacaggcttttctttatttctttcattttcttccagaggcggcctgctgtggtagcttcagacaggctgactttgtctcaagcgctggttctgccccttcccagtggcctgcccttaggggatccctggaccactgggctgctccctggcttctgatcagtgtggcctgaccggctgcagggacggcacctccacagcaccagcatccaggcagaggggatcgtggccacttcttccaaaaccaagtttttcctttcctggcattaattctaacatttctcttaatatttatgtcaaactattttgttaaagagttttttctgttaaaaataaagcaatgtccgtcctacctcagtatcgctgttcttgcagaatgaagtgaagcaggaacatcaccaaagcctgcaggtgtggcctggcgggagcagagccatctgcttctcccagggctcccccagagcatggcccccaggtcaagtgccaggaaggatgccatgcacattggcttctttctttcatgtgacgacagagactacaggagcatctttaaactagaccaaaagaacccccttccttggattgacaggaagcagctttcttccgattctgttagcagagaacagtgtccagaaatttctcatcctcatgcaaattaaaacagcataatgactttccataggcggaattgtagctagtcatcctcagccctgggtccctgccaggggaaagtctcactcttggaaccctgtgtgcctctgcagcagatccctcggccatccagtaacaggaaccccccagtcgccccggtcttgccagaagtccagaggccaccatggtttcctcgtcctgcctgatggcagctccttggggcaggctgagctaagcctgaggggtctccaagtggcattcagcagctggtgtgtgggtgaggagagagccctcagatggacacaggtttgggggtgacaggacatggggggctggcaggagacagacagaggcagtgtcccatcaggactgagctggagaaggaggccgtccagaagctggcagagaagagaggctctgaggatagaagctgacagaaagggccagggagcagggagggagggagcaaaggccg

SEQ ID NO: 39785 - DNA, 2100 bp, Homo sapiens
cgcttcagtccctcatcatctttgctgtgttcccactgctgagggtgctgtgcacgtcccaggatggacctaaggaggcaggctcagcagacgaaggcccctgtttgtgcgccctcttaaatattaaatattaaatctagtcttgctttaatatttgcttcctgtagattcccgaatccctgagctggtccgcaaggctgtgggggtggcagaggtcctccctagactctgcattttgccaagctttccatagcatgcccagtaatttgcttttaaatctagtacgcacacctgtaagtaccactttagcacaagcttcatttctgacatacatttctttaggatgtcattgacaaatataaataaaaagccaagtaaccaaagtgagttagtagctcttcctgacccagaaaggagcacggaggagatgtgagcagtgggcacaggagcagtgcgggcacgctggccctgctgagtgaagcacgcgtgaccaggagagcagctccacacctgtctctgtcgcctcgttcctaagtcactattaagtgaagtgggctctcccgggctctgcggagcccacagccctccagaaaaaggaggagacagttgggctacatggcgtgaactccaggtgtagggttcccttctcaccacctacaggaccactttgaatttcaggaatgatttggaactcgaaggaatgtttgtcagtctgggtgcaaggcctaagggagcatgttttaccacttctgttctggtcacttagaaacaataaaactgtaatgacctcagcagctggagcctaacaccacttcaaggctgtgccctagtttcataaataggtctttgaagaagatccctgctttattggagtagatcataacagtaacacagaaatcaaagagtggtgatgcgtgtgggtttggggccagaaagtagctctgggagactcttaggttaaaggcaaaattgagatgttaaatgctgagtttgtgtcagatttaagagtttaggaatgagagtgggagaaattaagccgttcttgcaagacagaagcaaggatgctatatttcatttgcattctgccttccatgcggaagtagttacaaaagtgatattagtggtgcctgtgtgtattctaatttcagagattccagtataaagtgtatgttatacacacatgcacacacactgctctcatcaggactggaatctgcttttcagaccaagtaatccaccttttcagttgtaattactgtgagggagtttggggcagcacatttctcctgggttttgcctaccttcaactcctcttttggtatttcttgaagatattaaagtagttcaagtagaaagttgtcactatttccagggcaattgataggtaaaatttcttgtgttagtaaaaaaactaaaaatgcctcttcatgaaagtattcagtcactgccaaaagttgtcaagtttctggagcctgagtgtgtggacaggtagggggtcctggggagcctggcctgaactctctggtccacttcaaaggcctcagagctcagtgcaggcagctgccccgagaacaaaggctgctcaagtgagaaggctttaacctcttccttgctgttgctcagccccgctggaaagagatgacgtgttaaattccacagtccatagctacaatttgcctgtgattttccagattgtcacttctctgtggtgattctgtaggaggcctgccataaaactgctgtgatcatctgtggtaacaagggtgggggcagagtaacaagggtctggaaacctcactttggctgtagccctctcctttcacaccttctgccggagcccacacttttgggggaggggagagacccaggctgcccacggcaggagtgggtcagaggagaggcatggagaccatccccagtcacggcaagtgaaggctcttgccgtcatacaccagaagataactcagagcagggaactctggaagaaaagtgttatttttaaaatgtgaaaaactgtcaccgtttttgctactagtagggaggttctgccccgagtctcttcccaacgttccctgtctatcagaaaggcagacagtagcc

SEQ ID NO: 39786 - DNA, 1048 bp, Homo sapiens
gattactaggcttagaagaatatgtaccaggcctggcctggtggctcacacctgtaatcccagcattttgggaggccgaggcaggcagatcagttgagttcaggagttcaagaccagcctggccaacatggtgaaacctcgtctttactaaaaatacaaaaattagctggacatggtggtgcatgcctgtaatcccagttacatgggaggctgaggcaggacaatcattcgaacccaggagatggaggttgcagtgagccaagatcgtgccactgtactccagcctgggcgacacagcaagactccgtctcaaaaaaaaaaagaatatataccaatagtccattcagtcagacagcttaatcaggtataggttaattctcaggctagtatataagtttgattaaatttcctgaccacaattgtcagctagagaatatttcaatttaaggaggtaagatatgattaaaagttaaactgtcagtattggatcttagaagtaaatgattattaggactgtaatagtaattattaggactgtaaaagtaaaggattattatctgcattagatatcattatatctaatgatatagagactgcagacataactacagggctctttttcttaaatcagaaaatccagattcaatagaaatagggtaaagtgataggaggacaaatagccttccatccagtggttatcaactgacgactacaagtcggcctcacttgctttaattattctattctatcctttgatgctgcttgaagaactgtgttttacctcttgactagtttgtttattcagtatttttccttgtacaggtcctcattttatctaaaagcacacaaagctcttgatttctaaactttttgcaattttccttctagttatgagccagagttatttcctggtttaatctacagaatgatcaaacccagaattgttctccttatttttgtttctggaaaagttgtattaacaggtaagttgtaacaggaagtagtatctgaaagtttgtaagtgttttgagtatggcattttctcagt

SEQ ID NO: 39787 - DNA, 1088 bp, Homo sapiens
ctgagggacttggctgaggttacacagctagtaagtggtaaaaatgagtgagtccttcaggtgtagaagctggtgccctatccacaggctgccaactctctgcagtaacttttttttgcttgttttgcagtttttttctcatggactatcaggtggacatttgtgggttcttaggttttattgttagagtggtttgttgtttttaattgtaaaagtacatcttcagctgactcaggaataaaatcagaaaggggaggtccttccttcctttctcttctgcctctttccccaagataacgaccagattagtgggtatcttctaagccctgttctgtctatcttctgggcatggcatttgatcccatttttggaaaaaagaaataatacattcaattttatagctttcccttttttcagtcaatatatcataaacctatttccatgattgggaatctaggatactcttcttaggtaccttcacttactgagctattcctgtaattatggtcatttacatgacctctagtttttcaatatcatcaacagcgctgcagggaacatccttgtatgtgtatttttcggatgagtgcaggtattcatgtagtaaactttcctagaagaggaactaaagactatacattctgagttttaatcagttgataccagattgcagtccaaagagaacggtgcatgaaatgcccttttcttgcattttccaatcattagtgatgccaataatgtatggattaattggaaagacatcattccaatattatctcctatctaagaaagaagtatctcttcatgtatgtaggtcttatgttcctcagtaaagttttgtactttttttcacacagggcttttatatttcataagtattacttccttaattcctaagtatagtatcatttctgttttattactggaagtttttcctaacactttaaaagttattgttgataatatttttcttattccgagtttactgaactcctattactgctgatttagttgattgcattgaaagttctaggcatgtaatcatctgtaaatagtaattttatgttttcctttccaacatttatttt

SEQ ID NO: 39788 - DNA, 1031 bp, Homo sapiens
gcacactctgctgcacccaacagccgtcatggggtctgctgttggcccgtggccatcacggtctaggactacctcttgaagctgtcaggactcctggatctaagtctcctcctgcccacgaattaggaagtttgaataggaggacaggatgtggtgagcgtaatatctggaggaaaaagcagattggaaccgagacatctctggtttgctgatatttcactcttctagaacaagcagtgttaacttacatttttggcaaaaaataccagagaaaggatgctcataacttgaatttaatcccaaaaaacattaaacacaattgaggcacattctacaaaatacccaaccaatactcttcagaattatcaaggtcacagaagacagagacttgaggaactaccccagattggagacgtgacaattaaatgcaatgtgtggtcctggattggatcttgaaccagaaaaaggacgtcagtgagccaaccggtgaaattttcgtaagatctgtaaattagctcacaatagtatatcaatgttaatttcctgcttttgatcattgtgttgtggctatttgagatattaatacttggagaagctgggagaggacaaggaatatgggaattcttcattctatttttaaaacatttttatgtctgaaattcttttaaaatgaaaaattgtgttttaatttttaaaaaagaatagatgtagaatagaaaactttcatagcagtgtatgttggtgaggaattaaaaaatcagtaggagtaactaacatggaaggggattggtgaagcacacaaaaaggaaagtgaatagaaaatccaaactaaggggtaaaaatattttctaatggattagcacagtaacatcaatgaactaatgttttcagatgaaatagatcctcagattagatcccagccccccccaaaaaaattcatctatgtggtatttctaaatatgtgctatttctgggtcctaaataaaaggactcaaaggttgaaagcaaaagaatgccagccctaccccact

SEQ ID NO: 39789 - DNA, 1087 bp, Homo sapiens
ttaaaaattgaactctgcacagaatatagaaacccagctgtgagaagcactggagagccgtcaaaagccgacagactggagggggcgcttgaacccttgcaggaggggagcttgcaccagccagatctgagggccatccacgactgcagcaggtgcccagcactcctgcagaaggcacagagggatgcagccaaagaaacactcgatggaaacttgaatctaaaggaaggaataaaaagaatcagaaatggttgatatgtgggaaaatagaaaagacaaactttttgggttttgacttttgattttttaaaagatgattaaatatagaaaaatttctatatttattaagttgaattcacaatcaaagacctttctttgtggaaaattccaagtccaaatggttttactgataagttctatgtaacatttaaggaataaataataccaattttatacaaactttatcagaaaatataataggaagcatattcaatcttattttatgaaacctgcataaccccaaatcaaaaatgtgacaagaacattacaaggagagaaaattacagactagcgtccctcatgaacgttggaacaaaaaattgtaacaattatttttagcagatcaaagcactattgtccatgcagtggaacactaattcattatgactaagtagggcttcttttttttaatgtttgaaatttttgttttatttatttttattttatttcattttcctttaagttctgggacacatgtgcagagcgtgcaggtttcttacatagatacagatgtgccgtggtgtttggtagtcatgggacgaccagaggcaggagccatgctgacctcttcacaagatgacacctctacgtaattacagtcattgccgagtctggtggttcttccccatacgtaaatgtcctaatgaatgaccgaataaggattataagacatttttctttccactcagcatatattgctcttacttttctatcaataaaaaaataaatccataagcagagctaccccctctgtttaacataatcaaacttcaagttctcctccctttgcggctttttcagttttggt

SEQ ID NO: 39790 - DNA, 1044 bp, Homo sapiens
tttcaaatgaattagttaatatgaagaaacagaacatgattttaaatggttcctttttaattgtagtttactggctattacaatttagtatttataatgcctcttgctctgtgtacagaaatgagtggttagtattttcaaaaatgaatgatatggttaggctttctgtccctacccaaatctcctcttgatttgtaatccccataatccccacgtgtcaagggagagaccaggtggaggtcattgaatcgtagtggccgtttcccccatgctcttctcatgatagtaagttctaatgggatctaatggttttataaggggctctcttccccttccactgggtacttctccttctggccaccttctccttcttcttgtgaagaagatgccttgcttcccctttgccttccaccaagactgtaagtttcctgagggctccccagccatgcataacataattgagtcaattaaacttctttcttttataaattacctaatcttgggcagttctttatagcagtatgagaacggactaatacaatgacctgtagtccatatatggagattattttttctcctgcaaaatagctatgctaaaagagatctttgttactgaaaatatataaaagtcacgagtttttgtaggaaaattgagaagtgcttttattatagtctgaagtatttattgttaacattattttactttttccatcaccctcaaataggcaactcatactcttcattatgtgtttataggttagcatggcctcattgaaagaactagatcaaagactctttgaaaattacatcgagttgaaagcagatcccatcgttggctccttagaacctggaatttatgcaggatattttgattggaaggactgcctgcctccaacaggtaagtaataaagtttcttgagtaatagatgtggatatacttttatcaattgatacttgcttgaattcttttcattttattctcatttttctcatatctactgagagtgagagattaatttgattttaactttttgtttgcttaaa

SEQ ID NO: 39791 - DNA, 1035 bp, Homo sapiens
tttataaatggtggttccagttcgtgaactacattgggatttttttttcaaagagtgaaaatgtcaaagtgggcggccctgtcttgttttcctgcctttttgtaaagattaatcatcctgatgagaaatgtcgtgacttaagcctttggggccaaatgtctagtttatttccagaaatttttgtgttaagaattgcaaggtgctatcttgcagtaaaaaagtggctatttgtagaaggtggttgctttgtttttatataacaacaatgacatgaatatatttattggagaaatgttatttatcattttaaaatatgtgaaatgattaggaattgcatgtaaaagaagcaagtttggttttctctaggttttttgcagtactaagtaggaactgttgcttcactttatatcactaagaagtagaattaaattaattcttaaaaagattttttcatatccttccttgtctttgtccagatcattttgagaccaagataatacaaaggatctggagatttagcagtataaatggtaggctctttcccactcagaatttggatttttttttcatcgaccgtcttgaatattttgaaattcagttgtgtttagaatgaatagatagtaaactagatttagatgataacatttgcactgattttattcatttgtgaatctgttaatttcatgattccaaccaagtaaagtctatttctggcatcaaagggaaaggtctgctgactctgccactgtttttcatagttttccctccaaaagacaaataattctaggggcatcgatcccagaagagtcacagggcacaggtcacagtggatggcttattcattccctctctgtttccgcacttgaagatgagggtctctcatagggggacctcatgtcactgggtgtgagaccttctctcagactcctctggtgtgagccagggcaggccaagtgtttcctccggggatatttcctcctgctttcttactggtacttacgccaggaaaggcattaaacggccagtttttcattc

SEQ ID NO: 39792 - DNA, 1096 bp, Homo sapiens
attctggttatgcacagaaagagcatgcagagtatgtgatggaaagtgttttttgccaaaggtttagtcaaaggatctaactcaaggctctagattagtcaaagttgttccagagaaggcccgcctgcctgcgggagcacaggttgggtgcctcggtgaaccgcaccagcagcaaaagggcaattcctggaattttatttaccaggtagtcttgaactgtgaaaggacactgtgtttatcagcatttgtgtctggtagttttcgtaagaaattactttaggtggacagaaccctggagaatgtagaagtaactggcttgtaccccttcctcttggcaacactgaccgtgtcctaaggtggagtcctccaccctcagtgaccctcactccccattagagggagattattccttgttttcttctgcaaacacaagcaattcttaatgccctaaggtatttaaaggagcccatcatacagatatatggcagtgtaattctgttccaggttataaaaatttataaactactttataatagtttctacattttaaatgtaattagttattaaaaatattcctgtagccttttcttgtatacaaagtattaagtaaacaatatagtagaacacttttcataagcaacactgatcccagttcccagctgatcctagttaatggaattttctcaatctgtttttccatccaagctgttaagtcttaaaggaaatatttgattctttagtatattgcatgtaattataagcaaatagtagagttgcaggattttactgtgtttctctttatgttataatattgggaaagaagcagccaagaaaagcaaagcattggatattgacgttaaagagcagagattataattaaacttgacaagtgttaatcagctattctctctggcaccataaaggtgattttctaaacatttgttttgcttttaggaacagcgccttttgatagtcctaagtaattgctgctatctagaacgtcacaccttcctaaatatcgcagaacattttgaaaagcacaacttccagggaatagaaaaaatcacacaggtaagcgagttcatgtaaaacgcac

SEQ ID NO: 39793 - DNA, 1032 bp, Homo sapiens
gtattccattagtagcttttgttcatccttaagtttttatgccattgtcggttttgtttcttcctgtgtgtccccacaggtattttaattagaacttgacaagaagtgtgtctggcataacacctgccaatagcaaccttggtatgtttagtacagttttttttctttattctgcaaaaatgtttctagcaccagacttcattttgccatggccttccctctgtcattcccttctgttcccttgaagtgggagtgacctgtgggttgttagcagatactgctcacgctggtcctcctgggtggtggtgaggttcctggagctgtttgtagtgtgaaaggccttcctgagctccttggtgcctctgggcacctcctttgttttggtggcgatttccctgaatgccccttgagcttgtgcatttagtgacctgtataatctcttgtttttagcggcaagtccagcattatcacttgcccctttcaagaacaactgtgggtcaaaactgtgtgagtgaatattcgttatggtacactggggtaaaaagccgaaacagactaaattacgcatgttcctccctgcgctctgtcttatttgtcttccttcccctgttccttttattgctgctgcttaactctgtgtggcttgagccgtaattgattttttgacacattctgttgttagtgtctattgatgtatgaagataattcaggtaggtatcattttctgggactcagttatctaagtgagaatcattcctgttactcttctgtgtaatagttgcaattattttactgtttgtttattttctttagtataatttgggaagaaaaggaaccacagattacgtaaccagtttaaatataatttatatatgatttgtctactctgataaaagtttggtaaaataagaaatagaaactaaatgtttgaagggctctctatcaatttaaaatattaatgcatcttacactaacccttcctcttctcctactttagtaaatataatcctactcagaggtcagcatgtgagc

SEQ ID NO: 39794 - DNA, 1047 bp, Homo sapiens
attcgtgtctggggtctcctgaacagacactgcagtggatcagtagcttcaaggggggactgggaacgaacaggtgagacagatagataaatatgtatgtatacacatacatacacacacacacacacacacacacacacccacacccacatatacttttcaaacctctactgtctctgctttattttggtttgttttccctgaaattctctattaagattttcatgttttattagcattgcattctaatttttaaatcatttaaaattcatgttataggccctttcgttatctgtttagtatttgtatgttctgtgtgatttttttaacattgattcttcagagatatcttttttgtgtttttaaaatgtgtattgtaattttcctccttagtagtttttagtaaatttttgttttcatagtctctgttctcatagtattgtgaacagagaatatgtttcttaatatatatttaagtttttgtaagtatgccaaaaattaaaaaggacggacggatgtggtttcttcagggtccactatttgatatagtatcaatgcctgattgattatattatttaaatatagcttatttatattaaacatgacagacaaatctctttctttaatttggattctgtcggcttttcttcatatgtaaagcatgtatttactttgtcacttttgatggtttagattctcttgatgataatatatttataagtagtccccaagattaccctcagtttggtgttttgctagaaggactcacagaactcagtgaaagctgttgtactcagacttatggttcattacagggaaattacaggttatagtcagccagggatagagattcatggagcaggtctaggaaattttcatccatggagcttccagtagtctcccagtggaattgcaggcagcactgactttcctggtaacagtccgtgacacacacatggagtacttgcagccaaggaagctccccaaaccttgttgtccagatccggagtctgtagtacggccccgtcacatggacatggtcaaggc

SEQ ID NO: 39795 - DNA, 1044 bp, Homo sapiens
acaggcctgtgtcttctcctggcttggggctagctgttttttagaaggtttaaatctgaccttacactgccatctaatggaaaacatatctgttcagggtggcaggaattgtccgtgactgaaactgtgtgtttcgattcctcgatgaaaacatttcgtgagtttacacagtagggtctctgtcactttcagtcctaactctgtgctagtggatttaaaatgcaggcttggtttgaagtactcagagcgtatgttgctttttctgatgtgtctgagccgggacttcacttggaaatgtagaatccgaaatccagttattctgaacaaacgtaagagtttttactccgtgcttcattagctgtgttgatatactacctcttcctttcctgttactgttattaagggcattagcaattctcttcatttgaaagcagctcccctttcgcactctcctgcattgtcatctttacggatttgtagttgtgatcgtatttcccacctaaaaccctctggttctctgtttgacagtagaagtaccaggttcaaatctcgactgtttacatataacctctcagaggccatttcctcatctggaacatggaaatatttaactcagttattgtcatgggaatcaaataatacttaggaaattagtctgtaagatataaataagtataaataataaaaataatagcaaataacatttttgagcatttatcatgtgtcagaaactgctaggcttccacaagcattatctactctgatcttcaaaacattcctaagaggaaggtatggtgatccattcataatggaataacttctcgagattatacaggtggattgagcaaacatcgagattgaacccagagcctgtgctcttagccactgcttattactgctgcttcccgttgggaatactgagatgagccacctgtacttttgcagctgtgttacccatggagcttcatggactctggcattggtattcattttttgttttttctaactcatttatttcacatttttgaggtgtttgcataaaag

SEQ ID NO: 39796 - DNA, 1035 bp, Homo sapiens
ttatgcaacagaacattttcttatgtgatgcgagttgtggcatcatttttgagaccaatcattcagagattaaagagaaaggaattgaatattttcagtgtagacactatgagtttttaaaagtcaaaaattattacagattttcagactggaaatgaaaggtcactgaagcattctgtggatttaatttgccatattgaaaagtattgatcactttaacctatgtgaacagaaagctgtttgaagtcctccttcccttttttttttttaaattaaaaaaagtaaagagttcttcagaccaaaaatgagaaaaccacagtggattatcctcagctgtgattggtccatttcttgctgtgacctcagtaggagtcattattgtaaaatgccaaacacttattttcgtccctggctctgcctaaatttttggcccaaggcagaatccaacagatagtactgccaccagaaggggatcctgcacagggacatacagccaaagaacctgcttgtgtggatgctgaactgaacctcacgtttgcagactttggctttagcaacgagctcacctttggcagcagggtagataacttctgtgtcagtgcttcttacactgtcctggaactcttctaggcaacgtacgcaaaagtacgatggctctgagatggatgttggcagcctgggagtcattctctgtgcagtggtcggtgatcatcaggtttctgtcttacaatggacagaactatagcagagcttccaaagtaggtatatatcacattccctttacatgtctatggagtatgaacacctaaataaattcctgctcccaaaccccagtaagagaggcactgcagaggaaatcatgagggacccatggataaatgtgggctatgaagaggaactaaaactacatccagccactccctgactccagggatccctggcacactgagttaatgctgtccttgggctacatgtaagggaaattctggactcattgatgggctacaggacacctcagctggagggccacaccat

SEQ ID NO: 39797 - DNA, 1085 bp, Homo sapiens
tgggaaaccagtattgagttgctttaaccaatacagcatatccagctttgaacaaaaaattacacggcagaaatgaaagacaaaaaccacattttgaagaaacagagcaagcattagaaccagattcaggtatggtggaggatgttagaatgatcaaaccagcaatttaaaacaactatgattatatgctaagggtcctaatgggaaaagtggggaacatgcagcagataagtaatgtgcacagagagatggaaactttaagaaggaatgaaaaagaaatggtagaaataacactaacagaagagaagagtgccattgatgagcacatcagtaggccagacatagctgaggaaagaatcagtgaactggaagaaacatcaatagagtcttcagaaactataatagagaaaaaaggtggaagaaaatggaatggaacagccaagaattgtgggacagttacacaaagtataatgtatgtatagtgggaaccaagaaggggaaggaaaaaaataacagaagaaatatttgccgtaataatggctgagagttttttgtaattaatgatagtcccagatctggaaagctcagagaacagtaggcaagcaagtaccaaaaaataaataaataaataaaaaataaaaaatctacacttagcatattgtattcaaactgtagaaaaatataaaaaatactgaaggatactgaaggaagctggggttggggatgagatggacaccttacataagggagacaagaatggaaattacatcagactttttttcagcaaccatgcaaacaagtaaggaaaaaagacccacctacatagaattccgtatccagtgaaattatccttcaaacgtgaaggagaaataaactttttccagacgaaattgaggggatttattgccattagatttgccttaactattaaaagaagttaaaatgttaaaagttgttctttagggagaagcaaaatgatataggtcaaatacttggatctgaaaaattcaaggatgaattttagagaaggaataaatgcagtggcttctgggttccctcccctcaggtcctggcatctggcacca

SEQ ID NO: 39798 - DNA, 1021 bp, Homo sapiens
ggttatcacagcaccacttgggagcctgatgtcacaggaatggttattgatttagcccctcctataggctatggaatatgtgtctcctgcggacagactttgtctctttttaaatttatttttggttcatgggtgtattcccagcaccaagaacagcgaacagcacatagtacacttagtaggctcttaattaatccttactgagtgagaacaaacgaacggagaagctgggagtacagaggccagttaggtggataaaggaaacgttccaggagagagataataaattaaggcctcaactagcttggttcttaggagaaggaattacaaagatcctcttttaggccgggagcggtggctcatgcctgtaatctcagcactttgggaggccaaggaaggtggatcacccaaggtcaggggttcaagaccagcttgccaacatggtgaagccccgtctctactaaaaatacaaaaattatccgggtatggtggcgggagcctgtaatcccagttactcgggaggctgagacagaagaatcgcttgaacctggaggcagaggttgcagtgagccgagatcacaccattgcactctagcctgggcaacacgagtgaaattccgtctcaaaaaaataaaaaagaataaattaaaaaacaaaaaataaaaaaagatcctcttttctctgcccggatagtccacatttttgtatttccttttacttgtgtatttcaaacacttcctcctttaggtaatcctccccaactacacccccaaacttggtttctcttactcctatccatatatataatgagtatgtgtgtaagtatatatatagacacacatacatacatatgtacatatttgtatataattgtttaaaaacattttgtaatgaaaatatcaaacatgaaatgcaacagaaagactagcacaatgaattccatgtacccttcacccattttccacaaaatgatcaatgtatgatccatcttctttcatccatagcccacttacttctcccc

SEQ ID NO: 39799 - DNA, 1045 bp, Homo sapiens
taagtgtaagttaccttggttaacataatttaattatctaaccacccttataaggtaggttctataattattcccattttgtaggttaggaaataaaagcacaggaaagttaagtaacttgacaaagaccacacacctgggtaagtggcggagctgtgatttggacccaggcaatcagaagccttgcttttaaccaccaaccgttgctctcctgaatagctgggcatcctatttgactattttcaaacaccagcaggactccacagaggtgcgacgtagaagtgctgaagatcatagatactgtttttttccttttatatgtattaaattccatatacttccctataatcccttaagccctatccaacaacagcttggttattatctggaatagttcagtcttagtgatctttctctctgagtgtaaacatcaaatcttgtgcttcatctggtgttctcaagggaagcagtgcttcaggagagaacttgctgagaaagagaatgcgagattcaggagctattgttacccttgtgggaatcccactgtcattgttagaggcctcggtattgcaattccttattcagctctcccaggtatgaaaacacaaggcagccattaatagatgcctggccactgcctggaggccccacgtgaacatccaggacccgtttcttgacccatctccttgccccccacatcctgagctctgtacccctcagaaaggagtctaagcacactaaagctacatcttcagctctggtggcttctccctaaatctgtaggaagcctttgaggttgaatgtttgttttgctcttttgaatcctaagaatagtaagtggaagaagtcagcaagatatctaaagaatgctcatttatttaagttagcttaattacctccattaaacttaattgtcataattgttgcttcactgtcattattgtttttcctttataggaaaggcattgtgagctttgtgcagctgtttacatggtgtttgatcctatttattttctcattgcttacttcctgctcttcagggatt

SEQ ID NO: 39800 - DNA, 1029 bp, Homo sapiens
gctgaatatctaaatccactcgataatggtgtctgcaggctttgatcctcagtgccagaattgtgagttcaaatgaaatctgaggatggaattaactccaggcattaagaagggcagaagtgcagtttctttgttgaaggaggccacccactcgtaagtttaccttgctagcctgtagcgctccaggcaatctgtcctttttgagcaggtgctgtggaatactatctcctagataaacccttgattgtgggctttgagttctggcgacccatgtttaaagggatcacgccagcccatcaatggttaaccgtggagaaatgaaccttcccagaggaggttatttgttctagatgttgccgttctggtgacttcaaggaaatggtgtgtgatcgtgtttgtatgtgtgtggcttctcctttcttaaacacatagattacagtgtgattacattgtgatttggaaatcggtgattctagattgtgctgttgtgctgacagagggaggactggattacacaatgatgatattgtaggtggtgcaaccctcaggcgctcggccagcctgcggcccaggtgcatgctgtttggaaagatctgcgtgcttgtcctattgtcatttattcacaccagtgcacagctgtgataatgaggcacatcgccccatgcaaatctatagagtaagtttcatgataaggctagctctttttaggaaatcggtggcaggttttgatagaaccccttagaggcctgtatgtttctagggcttaaattttgcatcctggaagttttagctataaatactgcatagactggtgaggtctacagtaagccaattctaccagtgtttaggccacgggacagtgatttccttatgcaactttctttaggttgttgctgaaacagggataatactggcccccaccttgatgtttgtttcaaggaaaaccttgtctttcatgggagtgtgttattgcttctcccaagggacactttccgtggtaaagaggaacagcaccgtggttgttagggc

SEQ ID NO: 39801 - DNA, 1030 bp, Homo sapiens
ctcctaataccaccacattaggggtgaggatttcaacagaagaattgtagggaaacacacacgttcagtcctgtgcaccctccttgggaaacttcttctaggttgggttcagtgtctctcctctgcacttccataggactcgtgctggcgtatgtgcttattacactgtaatagcagatatttgcctgctttccttactggacagtgacctctttaaggataaactgagcactttgtgtctgtgagagagtatgtgtgaatacacagttctgtatgtgtgtgtgtgagccacacagggtctgactccatgaaagatttttgaatgaataaatgaatgaaaagtgttacgagattgatctactcgaagtagcctaactacttcgtgattcactctgcatcattataacttgaaatacgaagtcatttgggaacatgcttaaagccaaaacatattatttagtcacaagggattctgagaaaagaggagtcctacagctatggaggaactatattcagcaagtctgttgatctgttgttgaaggatcaggtttctttttggtaatgaacgtgttcagtgcaatatctgtcttatgttaagagcaaccatgtaatgattaaaatgaataaccttcatgcttctggagctgtgctcaaccagttctgtcaaaatacaaccagtgagtctgctggttaaatttagagtggaacatgaggaataagtcaagagagagggaaatgtctccaaattaattgttgtggtaagttcccggcagacagaaactggaggcttattttgcttagcaagcctcacagtgaaagggattaattctgtgaagcaccgggtcactgtgagagtttagtcctcacagcaagaagaggcctgggtatgtggatggtgtttgtctatgtggacatgccgtcatcctaactaacgggctgtctaggcaggctggtgttgggtcaggacagtgggtccttctgtgggtgctgatcaaatttgattacttaaatagtttcattaaatatggaa

SEQ ID NO: 39802 - DNA, 1059 bp, Homo sapiens
acttttccatgattccatctcccatttggcaagggcccctgtacttccagatttctcctgtgtgagcacctagaggtcctggcagacatcagagagggctggggtcaaggtgctgaggagctgtacctacaaagaactggtcacagcagaggctggaatgagagttgggctgaggttacaaccagatgaggaagattagggtgagaagtaggctcaggctagaatgaggtgggctgaggctagaatgaattgtggtagttcccacagagaggttagatatttccttgggggaggggaaacaaatgtcagcatacatctgtttaattgaaagcatctcacagttttaccgacttcaatttatattgatagctgagtaaagaagagagtgttggcattaatagtgctgcttagcagctccctccctggcattccatttccatgtgttaagggtttagtgtggatctggctgtggcactggaagcagtgtgggatcccatggggaatgcacaattcagcagtaaccggtttgagggctgcagggtttaccctgatgctgatgtcaattatagcaaattgtaggtccttttcgatgttctctttatcttttactatttttaaaagccatttaaggattgtatgtaagcaatggaatattattcagccataaaaaagaataaaaccagttgaatacaggttaacttgtacaagttcctgtgatacagtatcacattttcttcatccattcatccactgaggaatacctaggttgattccaaatcttggctatcgtgagtaatgctgcaatgaacacgggagtgcagatagctctttgacatgctgatttcctttcctttgcatagatacccagtagtggcattgctggatcacattttaaatttttattgaaatttaaaaattgttctatttttaattttttgaggaacctccatgctattttccataagggctgcactaatttacattcccactgatggtgtatgagagagttccttttttctctgcatccttcccagcatttgttactttttgtctttccga

SEQ ID NO: 39803 - DNA, 1033 bp, Homo sapiens
aaagtttcccagaagtgcttggatatttctgccccttaattcccattccttggggagtacattgatgggttaataaaaaatgcctgcaggtggagcttgaccaaacacttgtaggtaagaaacacctattagcttattttcccccttgccctttaatttccatggagataagtgaataaactatggcaaaagataagttcatatttccatgatcgtatgacctccctgaagtggtgattttaggaagatagtgcatgtatctctgggcacaaagtaacttaattaactgtggaaactatctgcaaatttaacgctttccataatttgatagtgcttcactgacccagttcctaaacactaatcttgggaagaaaataatttaattcctaaaatacctaaggtgactccctgtggaaatattgatgacttgccctatgcattagaagatcacgcaggctcccagcccaaagggactacagaacaatcttgatcacatccacccagcaacctggaaacagctttgaatttcttgtcgtgttaacctctggatctgaagagagggtaaacttaaaattaccttcccatggggacctgggactctggatgaatctacagtacaatgctgtgaagaactgaagagcctcaggcttagagaccaggctaatgttgagagtcccagggcaaaatgcatggctctgaatccttgcagagtctccctaggggcatggagagggccctgacttggggctcgaggtcaggtggcagtgaagggcctctacagcgataaagcccagctgcctctttacctttcctcatagtgaaaatacatgggaagaaaaggagtgctttgtccaactctgttctagcccatttcatggtctggttgattcttttggtagatgctgaacactggaaaaatcctgcaaggattgaaggtgagtgtggaagtagacggagaaaacttaggcatttttacgtgtctgtatttttgcttctttccaaaaatgttttaatagggtcaggctcatttgtt

SEQ ID NO: 39804 - DNA, 1065 bp, Homo sapiens
ggagtcacccttggcttacgtgcagtgaggactttatcccagggtggtttgcatatagcctaagaaaaagtgtggacgaaaccaaccctagagacttccttgttttcatttataaaagaagcaacaagttagtgtttgtgaagttgggtaaaattacttaagttttaaaatgtgctgctaactgtctccattgaaacaggtaacggccttctactcaaaagaatgaggaggtttcttctctcttcctttcctttcctttctccttccctcctccctcctttaaacctttatgctttccttccctcctttgttttctcctcctttttctcttttgtattcttccccaaatagtaaactatgtttgtcttaatagtaaagtaatgcacattaatgataaaaatgacttctgccaagtagaatacaagagtgtaaggtaaaagataaaatgtttttccaaagataaaagacctctccagctttaccagatacacagaggtaactgcaatttaagtctttcttaaaatctttctgaaaatttcctctgcacgtgcaaactttcacacagacggatatatatctatttaaccttcactgcaaatggggtcacactcgatgtattgtccgcagcacacttctcctcactcaacagtgtatctcagaacctttccacaagagcataagaatccacccatgcttaatagtccattgtgtggtttgtatcataatgaatttaaccagtttcttaaattgatattagcaagttttctccccccatttggggagattacaaacaatacagcaagacgtgtcctggtacccttgcactctttgcacagatgagagaacaaacccttaggctgaattcttagcaatgaaattgctgggtcaaagggtatgtaaattttacattttaatagatattgccaaattgccctgtgaaaaagttatatcaatttacaaccctatcaacattatatgaactgcctatttcctcaaaacctcaccaactccatgtgctatgaaactcttaaatctttgccaataggcaataaatggcaaatgatt

SEQ ID NO: 39805 - DNA, 1048 bp, Homo sapiens
gtgacagttttcccaatgtatttattgcttatatgaaggggagaatttttggaggtcattactgccattcacagtgctatctgcattgtttttaacagtgaaaacctgataacaagaagaacatttgtaccatggaatgttgtgaaactactcagaagaaagagttttagttgtctcttgacatggaggagtgtggcaatgttttaaatgagaaaaattatatatatatagagagagtgagcacataaatgtgggtatctatgtctctatctatccatctatcttcaattttcctaaaattataacaactgaaagctcctatgtgtctatattttcctttgagtatggggacaggtgtataaggcaaatcctggggtgtcaagttggttgtagtgagattttgggaataaatggggagaggatgtgtggaaaagcatattagctttttctttattatctttgcatagtttcagagattgtggtgaacatgtgttgcatttgttatttttgaaggtgacatcttaagaaatatttatgggggacaaaaccatccattattctacaatcctcaagaattttacatttaaagttttctctttcttctttgctttctacagccgtataaatatactttcatagtcacagcagagatacattagtattctttttcatgtgaaccaaactatttcatagtttaaaaaattaaatgttgcactggctctccatgtttcctaggactattttttagactcaagagagaagagttgttcagtggatgccaaaacatgcagctgtgcttatgataaagcggtgatggctgaaacaattggcagggcctcctacagccattgcttcctgccaagcacaagccttcaggatgtgatgaaagggcagggagagctttgcaggcaggctcactgctgtgttgtggaagtccttttggattcttaagagacattctattgtcctgtgtattcagcctcaagtggccactctaaaatgtttagtcacccaagactttgaagagctctttactcttgagtggagg

SEQ ID NO: 39806 - DNA, 1014 bp, Homo sapiens
atatctactaagttcccatcatggtaactgatgatacaaagccagaagtttgaatttaaattttaaggagctatgaaaaagggagagtggcccttggatctcaagagagaacagctgaccactttaagaatttcaggtgcagcacacgtgggcacacattcaggcaggtccacgtactggtagtggtgacaggaggacttcctttttggaaggcttctattttacagtgagagtgaagagctgggtatggaggtttaagaaaagaataggtatgaagtggtcttatttcttgttttttcaaattactcaacccatattgtgttgatctaaatggacatttcaagatacagatactgtaaacaaaaagggcacaaaatctgtaatgcattagctagataaagggttaatacatccagtgtatgaagagctctcacacatcattaagaaaaagacaaaaacctaatagaaaaataggcaaagaatacgatttgggaattcatagttggagaaatccagattatacataaatacgaaaagaagtgcaatgaaagagggaaatgcagtttaagtaataatgatattgttttcacccatatgcttggcaaaaattaaacactgtgggacagacagaattcagagaaataaaattttcaatagacttttgttgtgagtgtgaattggaatatcacttttggaaaataaccttgcaatatctaaaattcagggaaaaaaacgccttagaactttgacacagccatctcacatttgggaatatatccttgagaaagaaaatctccaatttataacaatacatgtacaaaagtgtttatttctgcatttttccttttattgagatacagttcacattccatagaattcacccatttagaatatacatttatatattatataaatgtatttagaatatacatttatatattatataaatgtatttagaatatacatttatatgttatataaatgtatttagaatatacatttatatgttatata

SEQ ID NO: 39807 - DNA, 2049 bp, Homo sapiens
ttctctagggctccactgcaaagagggagctctgggagagggagaaggagaggggatgtttcccttggttggacctcgaggttggttcctccaggtatatcagattcctttgcagcactgggggtccagccacagacagccggtctgcattcgaggagtcttctgcccccgaaatcccatccggcagaacgtgaaagtgcagtggaaagaaaactcgactgcgcagctcgcaagggcgcctcgcgggttcctagcggacgtggccgaccgcaaagccgccaccgcgtttgcttatttcaggcgggactttctttctctccatcctatgttccctttgcaaaagatgcaggctctgggccgccctgtgggaggcggcgggacagcggaggaccctcaccttccacgcgcgccacagcgtggcaggagcccggcggccggcgactgtcttccccccgagtacgccaggacaccagggggcccggcacccctactctaccctgtaggctcgcagcctggctctgaaagtggaacctgcagtatgaaatactaagcacgtcaacgcttttcccagttcatttttttttttctgtgctttccaccctccctcctgctccagaataccctgcacttaccacctacgtgatctggaacaagttactttgtttctgcacctcggttttttgacttctacgattgggatcattataatgcctaacagtgttgctgggaggattaaacgaattaatacaagccaagctcttagaaccgcgtgcggcacgtgggaagcgctctataaacgtcggccctgaaactgacggtgcagagtcctctgaactcggtcccgcgtgggccggcgcgcccctacggctttccccggggtggtttcggccgtggcccgcagagcttggggagaattgggtccctgcgcctgtcccagccccaaccaaactcctgtgctttcaggatttggttaagaattgagttaggcacggagcagggagaaagtacgaaaagtcggggcaggaccccggagccgccggcttaagccgggagcgcggcggagcgaagcaggtgcacgcgggctggagcgcgtggctgccgcggcgccggccgcagccggggtcctgagtgctgtcgcctgtctagttctccaagaggggcctggtgggcggtgtcggactcagcgctgcttctccaggccccggccgcgccacccccgccggctccatgccccgaattgctgggggtgcggagtgctttctgcagctgggcgcagtggcgaccccggtgtgggagaacgccttccgcgaggggtggcaccgagggcggcgtctagaagctgcaggtggaaagcagggaggcaatttctgttttagcgtcttctcttccatgtccgacccttagccaggttcttccccgggtgggacttgtctccaaattttgcttggaaaaagcaggcggtaaacggtcgcgtttcggcggtcgtcttttgcttcgaggccggcgcgggcctctccaggactcgcgaggcggcacagggcagggaagggcaggctgacctcaccgtgggcgagaccggccccggcagcggcggccgccgggcgcgaggcgcgaaacctcaggcagcgcagccgccgccgggcaccgcgggcttggacggccttcagaaaggggtccggacgcggccgctccgccgagcgaggagggcggagagggaggggaagtgacctcttgaacctcatcaaacgcaaatgttataagaagcttgttaaggaaagaaaagcggaagggcagggaaatggagaaacgtggagtccacctgaggcttgaatggcctttttagagttccaggcccctgggatttgcagacttctctgcggtagaccgactattggtgatggactttgcattttcccgcaggagggtgaagctgccggccgacttcctccaatatgcatattttacatatataaacacctttgcagttttatagccatttaaataaaccattcacataaactcttaactcttaaaacgatccgcacaaaa

SEQ ID NO: 39808 - DNA, 1023 bp, Homo sapiens
ttggatgctgtcaacctaaagacactaaaagcccccactcttcaagatttgtgtgaaaaattaactctggatgtttttaaattcctacagctgaaatcctagactttgccttaaaaaaatgatgctggtgccaataggaccccttgcttgaaatgtaattggcacatggtttggtggctttgcctggcccatcccatgatgattacccccagatatggtcagcaggggctttccaggaatgctttagcaaggaaggatgcgggtgtacataacacagcaagcatatcatcttcttcaaggtgccacttaggcacctcctgtaagaacacaagcaggtccgcggctggggagccacgtgacgcatgcagggtgtctctcactggacgttggagtctaggccaccgagacttccttttggggtgcaccacagggagcccaggtttaaaaaggacttcctttttctggttaacatatattaacatgtcagggaaactaattgggtttaaaatggctgttactctttcttttttttttaatggatattatgtaacaattatgatcatctttttactagaagtttctgagcttcagttactcagtttcctgaataacaaagtctttctcaagtaattcagtgttgctgagagaaccattgaagtttattatgatacatggtcagggtgaaaagtgtcctctgcccgaaacagattcactatatgggagtatggggcaggggggcagtgagagaagcagctaccctatcctgttgccccctcagtggcatctgcccttggtccactgggtgctatcacccagctgccaaccttttcctgtccacccagccccttccttgcctgaacctatctgggtagacagtatggatattgcttattggtacaacaccctatcacacccaaagcaaggtacccaggctgtaactgggaggactgggatggaatgcatgtgagacaggcccctcccgagacagccatagtcccaagagacctgctttagttgaaactc

SEQ ID NO: 39809 - DNA, 1035 bp, Homo sapiens
ttaaaaatgagctaatagacacctcaccaaagaagatatacagatggcaagtaagcatatgaaaatatgctcagcgtcatacgtcactagggaatttaaactaaaacaaccatgagataccactacaatcctattagaatggcaaaacattagaatactaacatcaaatgctgactaggaggaggagcagcaggaactcttgttcattgctagtgggaatgcaaaaggtttagacactttgcacgaatgtttgcaatttcataaatagcacgatggtttcactacgcaatcagcaacctcgcggctatgtatttacccaattaagttgaaaacatgtcctcagaaaaacctgcgcatagatgtttatagcagcattattaataatcaacctaaactggaagcaagcaagacatccttctaatggatcaacttctggtacgttcatccaatggaatgctcttcagtgataaaaggaaatgagctatcaagccatgaaaggccatggaggaaccttaaatgtatgtcgctaaatgaaagaagccagtctgaaaaagctgagtactgtatgattccagctatatgacattctgggaaaggcgaaactatggagagagttaaaagatcagtgtttgcccagggtccaggggagggatagaggaagagcacagggggcttttgtggcagcagaactattctatatgatatagtaatggtggatacatgacattatacgtttgtcaaaatctgtagactcatgccatggagtgaaccctaatgtaaaaatctatggattttaggtaataataatatcagttcatcagttataacaaatataacactctgagatatattgttaataggggaaattgtgcaagagtggggtggaggaaaggtcctgtgagaactctctgtactttctgtgtagtttttctataaagctaaaactgctctaaaaatactaagtctatttaaaaaaaaaaaaagccctttggtaacctaactgaggagaagtcacgaagttgaaaaaaactgagt

SEQ ID NO: 39810 - DNA, 1035 bp, Homo sapiens
gggatggcctttgagtgtcaggcattcctgttcttggtggaggtggactgctcagcctcaggtcccagtgctgggcccgaggagggacagcgcgaggtgtgctggcacctgcagtcttctttcttgccaccgcataggacatcactagacaaaagacatcaaaatcagatgctgttgtcccacgttgccatctctctcctcaaatcagtgtcccaatattcaggccgacttcggttcatcctgttttagctgtgcccactagaatttaaaatgtggccgtgcagctcctgactctgctgagggtgcctcggaaccagaagactgtagagctgcttttctcccaggggagaaactaatgatttgcagaagctagtaatttagagtctatggaacttgccccaggctctcccttccctcctgctttcagtggtactgaggagctgtatttaatctgaacagaaaattccattttcttctgatgattttgtgactatatgaaaatggaattaagggattgtagatttcttccccacaagcatattttaaaatccagagtaaaaataaaaactttcgcagagtaattgagaataaaggtgagaagttttctaataatactttaaaaaattctcatatacagataaattagaagaagcatgaagacttttccttaaagaaatgttcctttccctgcactttgaatagatggacaaaattagtatgcagggacagatccaacttttgtgggagctcatacactttggtgtcggtgcggagggggtggttcttctatagaaaaagaatgcaaaaatatctcccttttgcagaatgttcacattctgcacgtgtgagctgctgttctcctcacctgggcctggagaacatgggtgagatgctgagccccagggcttaggccagctgcctctgcgtatggaggctgtgtgtgcccctcagctgtgccagggaggagtcacagcagacggcgtgctgccatcctaatctctgtggcacacaggagaatgtccccacccccaagga

SEQ ID NO: 39811 - DNA, 1124 bp, Homo sapiens
aaaatgtcttgtttcagacagaaggaaaaaactgtatttcatgcactctaccacacaggaggaaataaaaaggaaaggaagtaaccagtgcttgggagaggtagggctgtggagtcgtgcattgtccgggcacagggcgtggccggggctctgacacagtgaaccattgttcccggtgctaatggagagtgggtgtgcctaggagaggatgtgtactggccctcagggaggaagatgccagccacgctgtgctgacatagcagggactgccgactggagccctgagctgtgctgccatttgactctctggcctgatgaggtgcgacagagatgtcaattttctggaacattgcacagatcacatatttatgcaaatgcttttctgtatctacaatcaaaaatggtcatctcagagaaggaaatttactaagccaacagaaacctcaatttttacaacttaaatgtggctctttccctctctgacaccaaaatagtttcaaaagctaggaagtcattaagaatggcttgtctgtcattcctacttagacaaggtgtgggattgataaggacacagaacaaaagaattcactgaacaggaaaaggaccctcagactaacaagactgttcttgaatccgcatcgaccccctttcctgccgtgaccgacgccgcatccctcccgtttcttttgttcattcaagtgctatcatcatacctgttctgcagctctgttgacactagcattctttgagtataagagtggtgtctgatttcatatgcttgctttatttttccaccgatttggctctctcctgagcttccctttactgtccaattttgaatcttgaactacgttttatctttctaagcctctaggctgcattaatttcattcactccacttcaacctaatattccactgggtaagcttttcctgtatggtgagactaaacttttaacctcattcctcagaacaacaagttttcctaaaacttggatcaacttgacagcctcctgttgaattgcctcaggggtgagaatattcttccagttgaaaggtaaccagaactggagactatattgtaaataagcttttagttaggtgtgaggtcccaagagccaatggt

SEQ ID NO: 39812 - DNA, 1030 bp, Homo sapiens
gttgcataattgtcataccatccatcatgttcattctcacactgaccatggtttttaatgtctgtccacctgcagtctgtggcctcgccagacagtaagggcagcgccctggaagtgggggatttatcacttgccagtaggtttactcttggggagacgctggggttttatctccatgcccctggagaattgacttactgaatgcttcccttgaagacctaagtcactggttcttcagcccctttgcatagtcctctcactgaaatcagaactgaatttgttctttttcatttttggttaagaagatgcacattagaagacagctcagagcaatggggctgacctagtgggaaaagacactggtttcttttcacgtttctggatggcccgtggcccacatctgccagcatcttcgcacgtgtccacagcaccagtcagcctcacccaccttgtctttccctttgcgatcttagaaagaatttggtagaaatgggaaccgaagattgagcagaaagtataattaccacatgtatttaccagctcattttcaagagcagtaaaagtacactaaacattctgcttgtacatacactagcactttaaaactaccagctttctaaaacatggttttgatttttggagcaaacattcaattgctattctttgatattattgatttataaacaaaatgatcagcattccctaatgtctcgaagcaaagaaattagggtaacacatttaaaatttatcagtttgaaactttctaaatactcttccttaataataaccacaatacactgaaaatgtcaagttctgtaaaaaatgaacagggacgcgaatgtgtcgggcttcattttgaagacccagcgtgtttctcatcctccccaggaagggaaggttgaaatcatgaagttaacatctgccttttcgtaaacaccacctcaaagtgctctttctcttaggttggaggctgaaagaaagaagcacaaatcttccctgggccaagagtttcatcataagccctgtgtga

SEQ ID NO: 39813 - DNA, 1059 bp, Homo sapiens
ttacgtctgtggccttcaatgagttaaagaagaaattgaatttggtcagtgtttttttcattttaccactatcagttagagggacaggttcgcatccatgattgagtcatgcttgtgcagctgcttatacgctgttcttgggaggggatgggaaacacaagagcgcttttggggtcatttcctatcagaggacattcgttttcacacagacgcacactcatggaggacatgaggattgtctctgcaggggtcacacgcattgtttctcgctggaaaatcgcagactctatcaaaaactttccttccagagtcattgtctctagaagcttctcaattcacacacagttacctttatctgtggtggcagttggaggcagagggcccaggtagagtcccaggctgttaattcacctgatctgtgaccctgggcattggcaaatgcatcaggatgccacaggagcacttccagctccagaagcaggatacttcccccggccaggaggctgtgttagtgggactgggctagaatggtcagaactgggcctgggctcagaggggagcatcaggggatgaaagaccctcctctgaagtttccagtaagtggagccttggacagaaagtcctccagcatgaccctgagagggctgctggaggaaggctgtcctcgtacccagaggcatgtggacggtggtgatcacatctggtctgatttctaaacagagtacagctcatttctcttgagacccccacttgagcgctccctcctcactcccaccccagccaggactggtccagggatcagcatgggaggccacgccagcactgcgagatgatggggtaggcctttgaagggccagacacggcaataagaaacctgaaccaggagggcagcaggggtgttggggttggaaaaacattttcaggcgtatttctgctataagagaaaaaaaaaacaagaaaatgcaaggggccaagttctgactgcagagctggtacagtcctggcccacactggtcaggctgctgctgtcgacgagctttgaggtctgagctgcaaacg

SEQ ID NO: 39814 - DNA, 1026 bp, Homo sapiens
catccaaccataaacaaattagaacaggcaacacaaatgcctttttcagtttagtgaaatagcgtagcagttgcttagttgatggtgacgtggtaacatacatatgccgatctgtgagcatttcatttggcctctactagctttcatacctcaaattttgagttcaggtctcagagtttttctttcatttacacagcaaaaccaccaggaaagagactttaaaagagactatcaggcatgacaagatactagtgaatcaaaaacgtacttaaaaaataaagcaaacgaggccaggcacggtggctcaggcctgtaatcccagcactttgggaggctgaggcgggtggatcacgagatcaggagatcgagaccatcctggctaacatggtgaaaccctgtctctactaaaaatccaaaaaattagccaggcgtggtggtgggcacctgtagtcacagctccggtggtgtgaacccgggaggcggagcttacagtgagcgctacagatagcgctactgcactcctgcctgggcgacatagcgagactccgtctcaaaaaaataataataaaataaaataaataaaaaataaaataaaataaaaagcaaatgaaaaaaatgtctaatgactcccatgaacattaaattgatggcctcttctttccttgatttaacagttattttttgccctattaccaaattgatatcttaaagaattgttttactccaaatgcacttattatgtgcagttttattcatggttcctcacaatcaacaaattaaatgatatttatgcccatctgcctgcacttgttttttgaattagaaatacaaaagagatctaagaacttataaaatagttggtttatcaagcctaaaaagacataaatctaatttagtaatttaaatgtgaaaattactagatttttaaagattattttatagtgacatatctccttctatgtaaactctgtttcacattattttctgtaaaagcagaataagaattcaccaaatttgttataacaa

SEQ ID NO: 39815 - DNA, 1043 bp, Homo sapiens
agaaagcagtcaagtggtggatatgaacaagtcacgtgtcctccagccactggaaccacctgtgtcagcgtccttcctcatggttcttcctcccttcctatctgtgtctctacatcacaaacatacacatgaacaccacctacctgtacctgtacagagagacaatttctatagcagtgacactacagcaaaaatagggatatatgtgcaaaatattgttaatttgttgtgttacccattctgatattaatagcgtcccctttcctaatctttggaaatcttttaaataaacaattatgcttatttgaggaaaaaaatgagttggtaatttctaattagcagtgacatggatctttagtaggaagcaatcatttcaaaaacgttagcatttggttatcagcttgtgagtttgttaggttcgatagaagtttcactttgcagtgagagtttgggaggaaacactattttccaggatcatgtttcttacaaaggactaaaatatgcttaagccaacctcctccctgcataaagttcacctctgaactaagaccaaactgaaaacaaggaacgccttgaaatattttgggatgttctgagagcaagggattctaggagagagagttcatttgatttttagcacttccagcactttagcactccttaaaggtaaatgcccatgacttaccacccttattcttttactacataggatctttttatatcactataaaacattagtcaacaaagcttaaaaaaatcccgagaattaaaaatgtctagctagttcagtctctgatacctacattctgtttatgcagtgtgtccacctggcagaaacatgaaaaaaatttgactcataagtttccgtctgtcctgtttgtttgtaacttgcattacgtgtacagtgtagctggatggtgcaacagtcgccctcacaatgtcattagtggctgccagatccggtgagctccaaactgccactgaggcattttaaccaacccgaacgctgtttgttgagattaccctcaagaccacacattacg

SEQ ID NO: 39816 - DNA, 1033 bp, Homo sapiens
caatgggatgaaaagctgacttaacagacctaatgtagttttgatcaatgtgagcaagaacatctcgttaccaagcccaagtagtaacacgttgttaaaattcagaaaaggctgactttaagagcttgccatagtcaacatcagaattatgttccacggtcgtggagagaaacgtatcgtaattagcacaggccatctctgtagcccggaatattgggcaccatgtggcgactccaggcatgcttgcccccaggagctgagagccgggagccacggaaccagggagccacatctaaaaggctcactggaaagcaggtgcaggcacccaagggctgcttacgctctgctaccagcgcttcgccgttctctgacgtggatggttgctgaagacatgcctttcttgctagtaaatgtattaggaagtggcctgggaaggaaaaagttgcagcataactactttctcccttgcgtggtagtgagttagcgcgacatgttggcataactgagtcgtctgaaacactgtgagtgatatcatcgagagtgcttttttgcagttaagggaacatacattttcaaagtataacattttagactagaaggtacacttagaaattgtctactctgattagatgtggaaatgaagactgaaataagtcactgatttatccagtgtcggagagccagaatgaagtaaaatgacccagcagcttctctggctactggtttttccttttcactatgccaaactgtctcttcttgtcacattatttgaaagattagtagaagttggccataaaacttcatgactagtttctgaaaatacatcaagccatgtgcttgtgatatgtgtactttttaatttgtatattatacttcagtagaagttatcttaaaaacttcatgatttatgaaatttgacatcagacttaacagcaggggctctttatcaacacatttttaatcgtaataaaggcttaggtcttaaagttgaagtggttataaaaagatggatttcattggtgcttgtgtgtta

SEQ ID NO: 39817 - DNA, 1138 bp, Homo sapiens
tgcattgaacatttgatacaaatagcaaagtagtttgaacatttctctttatacacatattttaaatagttgccaaaaggtggtagctatctcagacaaatgcacattgtgaattgtcctcttttaagcctgagattcctttaaacgtgcctattggattttgagtacctgcagttaaatagtgttgctcttggcaggacttagtgagcaaatgaggtatgatctctctgatctcagtcatctgctcagtcagccatgaccttctcagtgtctcttctttccacaccctgtctccactgagccatggcccaggcagttcacagtggggtggccagagattaccacaggggaaaaatgcagggccccaaggcggaggttcatgtggggttcaggataaattggaatgatttctgttttccaatgaatattgtccaaactgtcattgtactttatctaactccaaaaaaatctttaaatcaaaagcttttggatgaagtattgagcaatggaatagaatttttattagacaaattttggttacttcaagtaccatttggatatggatggataatgtttagatatgtatgtatgcatgcatgcatgcacatatacaatcgtgtatctgtagacacacaaacaataaaaattgccacagggccataggaaatatacatttgaaaaagaagtaattttgtatagtgtgataagtagaattgtccctagtaggacttagtgaacctcctgtagggtttcttccttacgtctacggcatcatcagagggtgtcaaaaagaagtaattttgtgtagtgtggtaagtagaactgtccctagtaggacttagtgaacctcccatagggtttcttccttacgtctacggcatcatcagagggcgcccaaggttgcattttgtttttaaaaataaatctctattgaagtaatacattgtggaaaagattgtgacctaatatgcaatcaaattctttaataaattggctattattcatgtcttaaaggcaattccattgttttcagtttaatgctggcaatttaaagtgtgttttccaaattttgtcagtttttttcctttaatgtttgttatagaagatagagatgttatgttggtatgctttataatat

SEQ ID NO: 39818 - DNA, 1051 bp, Homo sapiens
aatttgaggggagtcagagacagggcaggttgacaaaccggacagtcacctgctgagtaattaaataaaggttatgatttattttaatgtagttgcaaaatatctggttagggtgtgtgtgtaaatatatgtgtgtgagagacagacacacacagacacaggcagagatggaagaagccaaaaggtgatgtccacaattaaatttagattaatatttgctgggattttgattggatttactttctgtcttgaaagagattaaactttaacaaaatgctttccagttcttaaacatatataattatctattttttaaaaaaggtatggtaaaggtcttaatttctgccatctcattccctctggttaaaaaaaaaagaaagaaagaaaaaaaatcacccagcagagccatctatcttgtataatcatcctcataaacccctaaagtatgctttgctcccaaaacattattggcatggatcctggcatacaatcatcacaccagtaattacagctgttaactggaatatagtcgttagtatttactagcctctattatgaacacataaatcatttcataaaacggtgagtggacacattacttgtcgttttgtttatgttagacattctctgcaggtattctacatgaaagttaaagcattctgaggctctttttgtagactgtgcttatcattaatagaaagcagcatgtgtgcatcctgcaagcccatttccttatttaaagtgggcatccttcctctgctgagatgtgcttcctctttcgttacaagactgaagatcaagcctttgtaaacccttaaaggtacatcccttccaaatgaccttttgtcctgagcgacgaagatgtattgtttagtccactcagaattacatggggtgtcctaagaatttttgttttggttaattaaatttggaaatgtgtcattttttcctattataaagcataaatgaaagtccagtcaaattgattttagagttctggtagatgagataattgcagaagctaaatgatttagggtttaaaaatgtgttt

SEQ ID NO: 39819 - DNA, 1049 bp, Homo sapiens
agtgctaatcaagaataaaggagagaagaaagacacgcctaaaaatgtaagaaatgagagatgaaatatcttttagagaggagatttttccttaaatttaagactttttaacatgataaaagatatgggaaaaataatgaaatgaattttataggaaaatataaattattaaaattaattcaagaaaatctaaataggctagtgaccacagaaataacagttacaaaacattagtaacaattgtgaaaacaaagttctgaaaggctctttttcttcatcattttataagcctttagtgaatggatgatttttgtgccatttaattttcggagtgctttgaaaaaggtgagatagttcctaatcgaattgtaaagttatcaaaggcctgaaaaaaacacacacacacacacacagaaaagaaaaaattatagattgaacaagtgccaggcattaataaaattctacctggaaccattaacagacatatttagctgtgaaacacttgaagtgttccaattaataatggcatttcctgtattcactttgaaactatgctgtacttaaaaacattttttttaacttttaaaagttcaggggtacacgtgcaggtttgttatatgggtgaactcacgccacggggtttgttgttcggattatttcatcatccaggtattaagcctagtacccatgagttatttttcctgatcttctccctcctctcaccctccaccctctgggaagccccagtgtctgttgttttcctctgtatgtccatgtgttctcatcatttagcttgcactttcaagtgagaacatgcagtatttggttttcctgttcctccagtagtttgctaaggataatggccttcagctccatccatgtccccaccaagaatatgatcttgttcttttttacggctgcatagtattccacggtgtatacatagcacatttttaaaaacccagtctactattgatggacatttaggttgatttcatgtcttctattgcgaatagtgctgcagtgaacatatgcgtgcatgtgtcttt

SEQ ID NO: 39820 - DNA, 1273 bp, Homo sapiens
ttacctctggaatcaggagacatatgtttcttatttggtgacatacaagcagtagaatgttttggttcagttggcaacattctttctttctgtgtggtgcataaaataaaatcttatcttacattgatgatgtcttacattcatttatgacatgctaataattagatgtattaattattaaaaataaagtggaatgctttggtcttttctttaaactgaaaaattacaatgatgagtattaatttcaagcgagtattgggcatttctctgtgccagggacagtgctaagcatttaatcttcataacaggaatcatagtaggtattttggggcatgattttgaggcagctaagaaaatcacaaaactaagatttaaacacacttgactctaaaccccagcctaataaccactgtgctatactgactatcctgatatttaatctacagttctgtgcctaatccgcagagttagttagtcctttttaggtaatgtggcaaggaatataaaccaaggggagtccaatttagtgttttctccgttaaccactcagccctaaatgctaacctatgaggttaagggaaaaattggttaagaaagagaatacagtaatttgacatccttagggcaagattctggactgtacaaataccagaagcatcatggccagacatgatagtaagtaggaagactgtgaatgtcatatagtaaatagtggaccagccaacgattaggtgattttcttcattgttgatggtcatttgactgacatgcctatgtgtggctttctttgtatttatcctgtttgggatttgctgacctttatgaatctgtagatttatgacttatatccttttagggaaatatatgtcttctgcctcattctctctctctctctctttttttttcttctctgggagcccaattacaagaatgttataatattgtcccacaggttcttaagatctcttcattttgtttgatacattttctctctattcctcagattcagtagtttttatcgctctatctttacaggaaagtctttactgactctgtcatcaccaatctgctaaacccatttgctgcttaacaatgtcgattttatatccgtatgatgttgtttagttttagaatttttattagattcttttttacaacagatttttttctgatgatattcctttcattcatcatgggcatatttttctgtataaccttgatgaaacttatagcagctggttgaagatccttctctgctaatttcaacatctgg

SEQ ID NO: 39821 - DNA, 1039 bp, Homo sapiens
atgacaccagaattaatcttcgcatttttatactttccaagaattggcctgcttggacctgtaacaccagtgccagtgtacactgccttggggcccaaggaaatgcatgctcaacccactgctgctatcatggggcctgaagactgacttacctgccaccccaggccctagcaaaacgttaccacagcctccactaataactgcaccataagctactgaggaaatcacagataactggtgctgtgtacagctgaagaaatcttacagagactacactactgcatacatctagaatcatagctaaagtgccctacccaaccaacaccatagatacatgttcaaaacaatgccctcccctgttaaagtaaattcaaaaaattgaaggcagtgactgacaccagatgcccaagtagcaacataaggatgcaggaaacatcaaaaagcaaggaaatatgacatctccaggggaacacaataattcttcagcaatgattccgatcaaaaagaaattcacgaaatcctgaacaaataattcacattcttgattgtgaagaagctcagtgagataccagggaattatgaaaaataatacatagaaatcagaaaaacagtgcaggatatgaatgaaaaatttgccaaagagatagttatcataaaaaagaaccatacagaaatcctgaaactgaagaattcattgaatgaaataaaaaatgttagattcaacaatagtctagattaagcagaagaaggaatctgacaactcaaagacagaagacaggtctttcaaaataacctaatcagacagaaataatgttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaag

SEQ ID NO: 39822 - DNA, 1045 bp, Homo sapiens
tagttttatgttcaatgaatttagcaatatgtacagagaaaactgtggcatttggctttcttaaaatcctgagacctttttcctttcttctcattttaacagaacattgaagaaagtatgggtttatatatggcatatgtaaagaaaatagatgtatattcagaaaggaagtttaaaagttctcatgcacagagataaacataatatctaccccgagacatattcatcttttaaaaatagtgatgttttgaatcataatctcagttcttaccttactttaggaaaaaaagaaagtaatttgctttgttggtcatattttgaaatttaagttttttttatttcttaaaacaaagtatcactacacttaatattttaatagttatcaaagaaatgttctaagactatatttgtaaaaaaacagtgacttaaatttgttgtgaaagtcattatttgcttgtttgcctgattctcttttgttttcttattaatctcaccatttgtcgagcatgtgctgtgggctgatactgtgcaaggcaggcaggcttgcctttgattttcttaaaaaatcaatatcctttttcagtaaaaacatctaaaaaaattcaccgtgatagtgacgtagagataattgcattaccataggaaggtgtttttttgagtgacaattagtctgttgctagttttcctttcacacctttaccttgaaattatgacatgcaacatacaaacaaatatgggagaaccagcttttcaagacgctctataatatatttataattttctaagccccgaatcagaaagtggtatcaattgaaaatatttaaagcaagaaaacactatattatccatctatttagatttttcttgacatttaggaaagctaacaattattcttccttcctggaatcattaaaaaaagtaaccctaatagtcaagtctaataaatgtaaaaaacaatgagcgatttaaattttcttttgttgtgggtttatttctttatacctgagtttgattttataagtaggttagtttaaaatatcttttc

SEQ ID NO: 39823 - DNA, 1110 bp, Homo sapiens
ttttcttgaacttgttgagaagtctgatgtggtatagaagtttcagcagttctaatattttccagtttcgcacaggcaaacataattttctgattttgtaaaatacctcgtagcagtaaaatgaaatttttcttattcatttcttctctgcagcattacttttctttattgcttaattctcttgtttttttttttttgtttatttgtttcttatccagtgatctctggaacatgattaaaaactcatataaacttggaccttttggtcattgaagagtcttagcatactttgacattttagaaaagaaaaacagaattgaaggggacacaaggtacattggtttatgggatgttcctcaaaccctttctcaaatattttggatgtatttcatttcctaacaaatatttttttcctattttgaggcaggaagtgaggatatgcctgttgacaggcagccccttcttcaggaattacatgtatctgtataatgtgtacaggcatatgcatctgtgtatacatagccagatttgtcatcatggccaggaaattaccctttagctcctgctgcaagttctgcattcttcgttacttttctcattggctggtcctggtctcaggctcccttccagtggctgcttattttagtaaatttcacacactttcccatcattcgttcacagtaagcctgtggcacgatgtgcatcatttccattttatagatggggataggaatgatcagagaagttactttgtacagtgtctccccgatggtaaatgatagagatgggatttggggagacctggctttctgactctaatgcacgcatcctccactggtacctgtgttgtttctcaataacagcttgaggaaatgaatgacagaaagtaaaatctgccttttagccctgcagaatgggctcctctgtgagaacgtggcttccatgagaggggtgtcttcctttgccatccctacttgtgccattgtttctctcacaaggcggctgtgtcctgttagcacccagaattaggaagtgtggaaaattaaagccatattatcctgttaaagtgtttcagggaaatgggatactttgatttgcatggaggaaaat

SEQ ID NO: 39824 - DNA, 1038 bp, Homo sapiens
ttatttatcttctgggtaggtaatatattcagctaatttaaaatataaagatgcaaatgggtattcaggtgagtcgtcctatgcctgtccgccacctccccatttcctcttctcagaggaccgacctgttgcctgtttactttctttttttgtttttcacacagggtcttgctctgtcgcccaggctggagtacagtggtatgatcgtagctcacttcagccttgacctcctgggctcaagcggtcctccctcctcaacctcccaagtagccagaactcaggcctgaatcactgtgcccagcctatttatttattaagagatttttaaagaaattcctaatgcttagaatctgtgaaaaagcacaggtgttaggttagctcttggaaccttgtgaccctgaataaactttagcctctacaaacctcagtttcataatgtatagaatgaagataattaactctaatttcagggttgttggcacgtaacatagctctcaataaatgatctggtgattgtaatctgaaatactttagaatgcacattaagatatatagaagattcataattacaattgtgcatattaaatatatttaataattatttgggaaagataaaaattaagataatgttctgtactctctgaggtgaatttttaaaaattgcttattttccattgcaagatgtaaaagtgtggtatcatagtatatttgcaaaagtgaatcactactttctggcaaagacagagtgtcttagtccaagaaacaatataaggtgaaaaattttgtaatttacggatgatctgatctaactggtttgtcctaatttttcacttccggtggtcaaagatatcttcatcccttgtttaaaacttagaagggaggcaatttctgtggacttgaggtggagaaagatggggttcctttttgctgtttactgccttgcttttctttcacctgtgcatttccagaggtgagtctgggtgttgtcttggtattcagatgagttcatcgtaatcctcaactttcttctctttcttt

SEQ ID NO: 39825 - DNA, 1034 bp, Homo sapiens
ttacgaggtcgtaccttctttaccactctagttccagaacactttttgatcactccggaaggagagcccatacccattcatcagtcactccccatcccctcctttcccagcccctggcagcacaaatttacattctgtcttgtatgtttttccctttgccttagatctgggaaaggttttttttcgtcatggtggggaaatgggcttctgtgcagtcaggggagaagccgatggaggaaaggagtagtgtggttatggaagaggctgaaggggagaaggtcgcgggcatctggaggcctgagatgtgcatgagcatccagtcctgcaccggcgctggtgctgcagtggtgccgtctctgtcactgcagtgctgttctctgagagctgttccgcagcgtgattttgggtgctgttcctcattatgaagcctctcagtcatcttcttcagtctgcactgtacctttcatagatttctgattcaattagctgcagattggtttttgtggcttcctacctgaacgaagatagaaaatgatgatatatatgatggtggacggtaagatgacaaaccagttttgaagtcctctaagaaacatgaaagtggatgtgagtggtagatcacaccagtgaggttgtgattttgattagagtgttgtgagtaaatttcatgggccataagtgctgacaaacaaagattgttatggtttgatgtttcaaaaggggcatcaggaattgaggataaagtgtttgttgtacccccttttggggtctaggagaatgaatgagtaaaaatcctgaatgtcagtagctcatggagtgttagattttacatagactggtaaaaacctgagattgatatatggtggctaggttattttgaaagtaagaatcttaggagtaacaaattgctgtctgctatcacagtatttaaaaaaaaaaacccgttttacacaccaaaatgtaagaagaacatgctcccagaataaagaacactcaccaaattatatacttttgactatgtgaactactttttc

SEQ ID NO: 39826 - DNA, 1033 bp, Homo sapiens
gtaatcacggcactttgggaggctgaggtgggtggatcatttgaggtcaggagttcaagaccagcctggccaacatggtgaaaccccgtctctactaaaaatacaaaaattatcccagtggtagtggcacgcacctgtaatcccagttacttgggaggctgaggcaggagaatcacttgagcctgggaggcggaggttgccgtgagccgagatcacgccactgccctccagtctgggtgacagagtgagaccctgtctcaaaaataaaaaataaaataaaataaaataaaataatcaatcaccaaagccgttgtgaagggcattagaaactgacaaaataactgtgtagaagacaaccaagttgtcttagatcccagaaatagtggggctccaaagtgctgccaacctaatgaagggtgtctctttagccagagatgactggaggcagagctacccacagcccgaccacttctacctgagctcttattgaggatgcaaaaagccaaaaccgtaagtttacaaggtgctctgatggggccatgagtgaaaaggaaatatggaaaattgattctaagtgaaagagcaaacgcagaccctggggtgccagcgagggcgagagaacctcaagctaactcagtgtgagggacgtcagcagtttttttgagagatctttgcatctgttttattccccaatatttgaatgctcaattgcttcagcaaatttgtttcaaattagagctttaaaataaactcttccccatgtttcacaaatatggagaacagaaagttttcagttagaaccttactgaattatcttaataattatcagcactcacataactttttcttttctttatttttgagacagggtctgactccgtcacccaggctggagtgcggtgacgtgatctcagctcactgcagccttgacttcccaggctcaagtgatcactgcacctcagcctcctgattagctgggactacaggcatgcgctaccatgcccagctaatttttttgagtttttgtagagat

SEQ ID NO: 39827 - DNA, 1024 bp, Homo sapiens
caaggctggttctggtgaatgctgtctatttcagaggaaactgggatgaacagtttgacaaggagaacaccgaggagagactgtttaaagtcagcaaggcgagtaaggggccgtgacaggagcagcgcctgtgttcacacgagcgtctccggctcggggcctcccgcgtctgcagccgtggggcctttctgtccctgcccctcctgcttgacatccattgggtggcctcgtgtccctgggcgcctggcatccgccctgccacctacagggcaagtctgaagctgcagccctcaggctcgatcaaggtcttaaagctcagactccagatatggcgtgccatcttctagcggacatttcctccttttctctagcttcattcccatcaggacctacccactcctttctttctggcggcgtcccgggaagccccgctaccgcgcctcctgctggcctccgtgccacactgcaggagcggaacaactcagcctgctgaattgaggctgagcagggaggactctctgacaagtgccagacacgtagctggtgcttagtaaatgctgaaccgatgagtgatattcagtcctctcttgatagtaaggataagtacagatttttgttttaaaacaaccaaaccaaacatgtagatagacactgagattaaccacctccagcgtggaagatgtcatttgctgatggccctttatcttcctctcactgaatcttctttattgtctcttgttttgtttttctttaactatagaaatttttgaacatagacaaagtaaacagaatagattaattacagtgtattcttgatcattgaccatagttagatcttccaggctaacttgaacttgagccttcagtttttcaagaaatttattttcattgtctgttctcctcgcaattcagaaagaattattttctttgaagctttattctgaaatgaactgtgctattttcccctggcaaaataatttctctctttaaaatttaatgattaacaagatgtacaagggctttg

SEQ ID NO: 39828 - DNA, 1015 bp, Homo sapiens
ctgctattgttattattgcatcctcttaatatatatataggagtctgggtgtaatggggcaggttaaaaagtgggtggtgagaaatgtaaaccacctttgcctaccagccttggaagcctccactagaattattggctttaaaagccaataattgcctacccttttttattgtcttcctcccatctgctgcagtgggctctgttgtttgacaggatttgaagtggcccgctgtggagagggggtgagctgtagcaccagccagcatgaccagctgttggtagcaacatattgaaagttgcttgctttcctttaatgagcaagtatttattgcatgcaccagggtgcccagcagcgtacttggtgctttggagtgctgtatctctgaggagcagacaggggagcatgtaccttaacaaggactggaaaccaagctgcacgaggcacggtccccaaggggcggcttcttggggtaggggcagtaaagacaaacgtgtgaggactggccagaagggatcttctggtcgagatggtagactgaacagacagggacccctccatacacacatataaatgctggttaaaatacagcattttttagaagtacgacactgagctccagggaaagaaggggaagttcccaggtgtcaaaccaaggagggaatcccagcaggagcagacacagaggcagctcccagggcatctgaaccagagagaagcgtgaggactctgggtttcaacacctgcccgggggctagagctgagctcccaggcctctgatgccgtgagaactgagctccttcagtcaagccaggagtcaaaactgtcaatggccacaggactgggagatctttgcctgccacagggactcagcccagagctggcggactgccttggaccgtgggcagaagaagattcacccaaagaaattggagccttgaagtctgcaccacgcaggactgtgtgttccaaattccacctgctccctgaggctgagatatcaatgtgagaaccagg

SEQ ID NO: 39829 - DNA, 1072 bp, Homo sapiens
aatgaaatatacatatacttacttgttcaccatattttaaaaacattttaaagtagaggagtggcaaaagcagtacagttaaaataattttagacttacagaggaatggcaaaggcagtacagagattttctgtaagcccttcactcacccgccttccgctaacgtgaactcacataaccacgctacggtccccagagctgagaaacggacgttgtcgtgggactaactaaacgacggactttccttgaatctcaccagtgttttctctactgtcctttttctgttccagaacactctattaaatgtagctgtgtctccacagtcgcctctgatctgtgacagttccttgggtttgtcttttgtgaccttaacactgtgatgaggacagtggtgtaacgggttggtattttgcagaatgcccctcgatgtgggtctgtctgatactttctcttgatcagactagggggaagagcaccaccctgctcatggcgtcgtatcgaggcaggagctctgacgtcagcgtgagctgtcactggtcacgctaaccttcctcagttgagatggggtctgccaggcttctcctctgcagttactagttttccctttctccacttagtttgttaggagtgagtcactttatttcttcagcaaagggactcacagctatgaagggcagataatccatgtggctaggtacactgctgtttacctcctcactcctcaaaaagctgtctcttctaaacgtgtgtattttttaaaggttagtagggtttttctgagaaacaaaggtgaaaatctgggtgaggttggaagagaagagttgtgtgtggttgttgttgatttcaaaggctggagtggtggtctgagtgacgaaccagagaaaggcctgctgcaccctggggtgcctgccccgccctggggtgccggccctgtggaagcaagtccttgttccccatgttgctgccaggtccgtgtgtcagcatcagagtatgcagactttccagatgtccttccagtggtgccctgggtgggagacccagtcccactgccgcctccacccctcccacgctg

SEQ ID NO: 39830 - DNA, 1045 bp, Homo sapiens
agaacctgcagcatcaaggcaaatgttctctacctgcactgcccaatagtccagcactaggcacgtgtgctattgagtgcttgagatgtgcaggagtaactaagggactgaatttgtcatttaaaaccattttaattcacataagtaaccacgtatggctcgtggctattatattggatgggcccagttcaggcagcaagtagaattagagacagtagcatcatttctccctttcacagcaaaacttctccaaacatgagccccaagcattgtctctggggccttgctttccgtccttgcctcagtccactgaggctttcgtcacccccgctgctcaggtggaattcccttgataagataacccacagcctccaggctgccacaggcttggtcattttctcttttgcttatctgaacttctcagcagtgtctgacccagcttgaccacaccctcttctttgctttcatgatacctcacccacttggcttttcccttcctttgccctccctccaaaggttggatctggggctcctgacatttctccatctacactctctgtgtgtctgctctgctagaaacatggcactaattcacctctccataggccagagactcccaggtgtatatcaccaactctgacctccctgctgagttccaaaatcgtataccctactgccttgtggatgttccacttggatgtccagtaggcatttcagattgtgtggccaaaacagaaccctccttcctcccacatcctcagagccatccctccctagaaccattatccatgcagttgctcaagccaaaaatgggtaagagtcaccctttcttctctctctctcccttgatcagcaaatcctctcagttcttcctccaaattacattctgagtccctcaatttctctgtctccactgccaccccctgaggcaaagccttttcatttcatgcctggaaaactaagcacaatggctttctaactgatcttcttgcttcctgttcagacctctacagctcattcttcacttacaactagggtgatattc

SEQ ID NO: 39831 - DNA, 1050 bp, Homo sapiens
cctggcctgctccatgagcaagcctcagtcattcgctataatggggtgcctgatggctgcgctactctatctgtctcctgaagataaagttagatttgtggcattactttaaagtaataattaaatatgcagttagtccatttatggctgtcattgagattggaagcattcgttattgcctgttttcctattactcttcttgctaatgaagctgatctttacaagatggatgggcacagtccttgtggtcccctgcctgacgctcaggctcagtagggtttgccgtacgcatgtgagatcttgattctcctactactttattcatacctgttagacctgcatttgtgcagccagtcatggtgacatgtggcctttggtgcgtataaatccagatgaaaatgtgggctccaaaatcttattataggttcacactgggctacaggcatcccatccagatgattgagaatacccttgtattaatataagactaagtttttcactgacatgagagcatacgattttaaaacttctgtagactgccaagaacacacccagagatggctacaatattcctgcccacttccggagccagcatcctggagcccagccccaccttggtgacccgtcctccctgcctcatacctgcccgccttggtgcctgcttttcatcactgggttgatggtgtggtttagacctgccccctgcctgtgactccatggttgggctgcctctgtgactctctggctgctttctccagcatctgaggatgaagtcccttccccgagtcttagcccctgtcaccagggagcctggccagacaggatgtgactctccacagaggacatgggactatcatgtgggggctgtgcaaaggtagaccagagcggggcaggcctcagagcgacgtggagacttaaggggtctggtctttaccctgtgggccctggagagccactgccagctttttgagggacaaagtgatgtgctttgctttgtgtttgggggggatcactctgggggtcacacccttctgattccaggggctgcca

SEQ ID NO: 39832 - DNA, 1110 bp, Homo sapiens
tctgagatggagaagaatgcaagggaaaatatgatttctcctctttggtaaatagtactggctgctttgtgttagggtggggtcatgtgactaccctcactacatgggaagtgtttgctgggaggccccagggccccccattcttggtcatttgctccccgttgggctgacctcagtgcttggagcgtgattgtgtctcatatctcattatgtcattcccttacctctttttagaaagaaccatatacagccccggagtgtaagagttagacatctagtagctacagtgaatcttggcttgagacctcccttttggcacacctcagcatgtgtgcatgtatatagcatggtgctgtatagctgagcactgttttgatattaaagagtaaaaagggattgaggctatcatgatagtgccttgacaacaatggatgataataagctatttattcagcattttctaagttcagaaactatgctgagttatacatatgtacatatacacaaatatatagaaagatatgtaaatttcatagtaaccatgtaaagtagctcccacaaatagccccattttacagttaaggaaactgagacctctaattcctggaccttgtctaatttgctagagatgcctttaagccagagataacacttactgagcttgtacactgcgtcttccctgagcccctctcgccagggagcctggccagccaggatgtgactctccataggtgacacggaattgtcatgtggggactgtgcaaaggtgaactttttcactgctgagtgctatggaactatttaatccacccagtaattctgtgatatgagcactcatttcataaacagaaatctgaggcctagggaaggtaacttgcctaaggttacatactaatgaaatgggaaaagttcccttgtcccccttgcagggtgtgggatgggagagtgggtcactcttccagtgccctgctgctcaaacctctagaggagcataaagcggacaggctgtggggctgcgaccccacagcagcgtctatgggtgaatgtttacagctcctgaagccccggtgggcgtgcgtgacggggtgctcttttagtttagccatcgga

SEQ ID NO: 39833 - DNA, 1022 bp, Homo sapiens
ctgacttagttaacaacctggggagaggaaacaaagccgctttgcttggtgaccatgttgacttttgatccaatcccaaaggtcaacgatttctcaagactttttatgctgggtgtatcaaggttcctgtttggagaattattaattttgttccccttgccttgaattatatcactatacactcagaaatagactcagcaacaggaattgggctcaagtctgaattctcttactctgtaattggttgatctctgctcccttatctcgagaattagggggttgggctaaatctccctttttacccatagtagcctaggatctagtgaagtgggtatagatggcacaggactttttacccagtactcattcaacatatattgagtgcctgctggacaccgggtttcagcatctagcgtcattgtcttgtttcacaatgattcctaactttttccctctccatatgcagggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgtaagtaggagccttcacgactagtcttgaaagaatttagcaaaagtattgttgcctgggaggttctgggaaagatactgtgcatgctgctcgtgtgggctggcagttttgtggaaacacaaacattaaaggcctcaagtgttgtgaaagaggcttttcaggtgatgccgtgaaacatttcactcaatcctgatctccagctcgggctcagtgcacatcaaaggacacgggaggttgcgtaactgcttggaggagtggcgatcggttctttcctgatatggagaggctttcggttttcttcagaattgtctgcattgacatcctgtgtgcttctatctggtgcataattgggtatccacacagaatccaaactttccacattctcatgtccacagttgtgt

SEQ ID NO: 39834 - DNA, 1034 bp, Homo sapiens
agggtcacattacacatgtggaaaatttcttccaaaacccagcgtgtatttgggagttccttgagctgacatgtaatgtgatttcctgtgtgcttgacatctgcctcatcatgatttgcaagtgcttctcatggacacgttctctgtggacagcaacagagaagcagtcagtgacctctggagacctacgcaggggacctcttgggggctttctttggtagaggcaacacagggtttatttttttaaaccaaatacttgagttcataggtttctagtgtgggctatattggtctaaaatataccgtttcccagaaatctacattgaaataggttagaaaaatatactaatataatccatgtcactgtctttctaaaaaaatgcaaactcaactggggttgtagtgtccttattcaataaataatttaatagaaaagtaaaaatcgacttttatgaatgaaccagtctgtaacagtttaaattgtttaaagattgttttcttaactttcttcttgtacacacatgtgatgtggcctccctgatcacacaccaggcctgaggacaaaagagtttgggtcttgctcttagagtaaccagaagtctgacatcgcaaaccatttctctgcagttgcttttctgaggttcctcctcagatgggcaagattgagggggtgccccgggaatcaggggcaggctgcctgagtggtagtttttgaacattttgagtggccttccctttcagtttgaaagcttggtattttccaactccattttctggcatttgactccctgcttgagccttgcttaaaaggaaataaacccatttaaagggaactccagacctctcggctatgggccctgtttcatggctgcaggggaagtggatcaagtcatacaatatgcttcctaaggctgcagtcagcatttagtaacatttaagtagtacacttctttcttcaaaaagttacatttttgacaccaagttttgtctggggatgttcactgggtattggtatagaatctgctagctcaggt

SEQ ID NO: 39835 - DNA, 1050 bp, Homo sapiens
gccctcccgcctctctgtaggcatctcttgcatgtgagcgtttgatgaagacctatttatcctccctttttgtaagaatgacctgggcaagccttttgagtgaaactcaaatgaaacaggtggggcctctgctgttacccagcccacagccagctgcaaagagccacaaagccccagcttgtagggtttcaagccaaggaagggaattatcttctgatggaacctgctctgcagaattgtacgttcccttcacaaggttccggaggccactggggaagtatctcccaacagggatgagttagtgagagaaggagggccaggcctcctgatttgcctgctccttgctaaaaaccttaaaaagagcaacgaactgtaggtgggcatttccaccatatttaaacatatgaaaagttcagtgcttttcctaagattttcccagggcttcaagtttgccagccactctgcacttcatcaggaagcatgtttgtgcttgcgtgcgtgtgtcatcctgagacgaactgcattcctctgaaagcaggttaaacaactgatggtgtgcttttattaggataacagtttagaaatttgaagcccccaaatgttctgcataaatgatgcatttgtcatgatggctactgaaattactgagccaaagcggagagctagaaggagacgcgttcctggaagtcctccctctgcctggttttacagtgagctgaagagcagttgtacacaacagcaaggaagattggttcctttaggttctgcaaaagcaatttcagaattcggggaaaaaacattaaacatttattttaaacttaggcttcttcaaagtctcacagccagcctaccctcaaagcctgagtgattgtggaaggagccagcgttcactcagcagaggaacagagctttcctgccgcaggctctcagtgaagatccagggagcagaggcgtgggcaaggagcactgggctcagatgcaggagaaccggtttgaaccctagcactaccgcctctacactgaggaaccttggggattactcagccccct

SEQ ID NO: 39836 - DNA, 1055 bp, Homo sapiens
gatttagagattgacagggacctatttgtctgggaaagggcaggggctgttgagtgcatgaagtggattcctctaaaataaaccattgctgtgagaggataccgccagcacgcgcccacccatggcatctgcatggtattgtatcctgtcagacctctcttcggtctcttttggctacaagtaactaaaacaaatttaaattacattaacaaaatataaaaggaatttcttggaaagatgcagggcagcaggtggaaggtgggatctgagatcacaaagtggggtggggagtgtcttttaggacactcagaagctatatcttctcatcccattctccagaagtgagctcggttcccacttcaaactggcttcgcctgatgcttttgctcatgtgatccctggtcaagcaacggccaacacagaggtcagcatctctctgtccaactccagcttcctgggtgcaaatctgattcccagcatggattggggtgagggaaaggaggttttggagcagggagtgaggttacgcagggctggggactccttcaaacggtgtgacaggatatggttccggctgttcttcaagctggggtggaaggggttataggcagatgtttctggcaattaattgagggtaattgagtattgatgatttaaccactaaatgctttaaacaaagtattcttttccctcccagagactcaggatgtaactcacctgctggctacttgagctgagtgtggaattagcaggaacatacctcctgaggcttctcttctaggaataattaaacatggccttagatattagctccagatcacccagggatcttggaaggagccgttggacagtcaccaacacagtgttgccaattgtcactcccacccctgccttcacacagggccagtctcctgctttccaaacatttcttctagtcagggccagctacataattcgcaggtccccgtggaaaataaaaatgcagagtcccttgttgacaaagtgtgttgtcaccactgcagagctaggcaagggtttccccaagcctttcccag

SEQ ID NO: 39837 - DNA, 1031 bp, Homo sapiens
ccgcagaacacctctctgggcagatttctctactctctgtcttcttagtcccggctagccaggcccccatcttgtcttgctgcttttaacaccacaggcccgagagacagaaaataagatggaaacctgcccacatcacttccctgcttgaagccttccatggctccccatcactgcagcacccatcaagggtgccctcagccctgagccccacatgtctttcctctcctcccctgccacccctccttgttgtagggggcatcttgtatatattaatagttcccagcccggtctctctcactgccttgtgccttgctcatgctattccacttgctcgagccccttccctccttccttcagccccttggttcctgctcatccctcaggtcagctcagtctccatctgaaggacggcaaccagctgtccccttatccaagccctcactggaccctggttggaaggatgcccgtctctctcccctcctgaagctctttgactttatgaggttaacaccataaatgtctgaactcatctgaacttgatgtcatgaaaagggcaagagtggccgggcacagtggctcatgcctgtaatcccagcacttcgggaggccgaggcaggtggatcccctgaggtcaggagttttgagaccagctggccaacatggtgaaaccctggtctctactaaaaatacaaaaattagctgggtatggtggtgcgtgcctgtaatcccagctactcaggaggctgaggcaggacaattgcttgaacctgggaggcggaagttgcagtgagccaagatggcgccattgcactccagcctgggggacacagtgagactctgtctcaaaaaaaaaaaataaaggggggcaagagtggcaggcctggcttgcagccccaactctgccacttgtcatgggtctctctcccagagcattactgcacctgtttcctcaatggtagaatgcggtcagtgctgcctgaccttgagggccattgtgaggacagacgcagaacactgggaagcgtgcc

SEQ ID NO: 39838 - DNA, 1044 bp, Homo sapiens
tatatcacgaaatcttggcatgcacagacatttgcacacgtgtaagaaatttttagaagtgggagggtgaaagtaggctgcatttttatgttaatactgtcagagtgttttctgtagaaatcttagctatgcacaattatactaataatatgtgtggttctgttccctacaccctccctgacccaggggattatcaaatctttacatattttctagtttgatgtgcaaaaaattgtatttggtggtggttgtgacttgcatttctcttgttatgaaggaagttaaacatctttttgaaagtttttgagccatccatatttcctgttctttgaacagtctcttcatttcctttgcctttatgtgtgtgtatatgctgtgagaagcattattttcttatgtatttataggtacactttatgtatgatgtaaattaacccttctggatgacttgtaaccattttcctcgagtttgctgtttggttttttaaattttgtacatgatatttttgttatgtagaaacgtatggtttggttagagttgtatgaattaatcttcttttttatgatttcttatgttagctttaaggcttggaagattcctggaagactggggggaaatcctatgttttcttctaacatttttatgatcttataacttctttattttggggttggagatacctgttttgcttttctgagctattaggataaattgctagaaaggtcagaggatataaccagcatttcatgcagacgttgacttgcttgtaacaacgtcctaaacatttagtttggcagtggcccttattaatgtaaggattagaggctagccagctgttaagcagcctttccacctccgtttgggagatagctgtcttcccaggtcacaggtctccctttccttcttcatcttcctgttctgaaccatctgcagatctctccctctccctctccgtctccctctgcctctctgtagcaacattttctgcaggtgcctttactttggcctttagtccaagataggattgagtcgaaagttggtgt

SEQ ID NO: 39839 - DNA, 1028 bp, Homo sapiens
atcaagacatttgtagttttgctccttgtgtctaaactaattaattcacattttaaagtaaatacagactctcctccaccccacccgctacccattctgggctgttctggcagagttttaaatgctttgtcgaaatgtatgaaattggacagttttaaatagtcaatgtgcatgtaacctcctccccccgtgtgcattggttaacagttgtagctcatggatgtgtaagataaactcttacatcatcataatcattgttttaatcttgtaccaacctggccagaaatgctctgtcctgtgggaactgtctgactgagctgcccctgctgccctgcaaggtaatggggaaggtccttctagctgggttcaccttgatcccacccacctcctaccccctgctttctaaaggtgtttctgtgactgttttcccttcacggagggcaatatttctttgttggtttagcagcaaagaaaaattaagaacaatgactatttaaatcactgtgtatgtctgacagactgaggatttggcaacattgttaagtatttcaagtgtctttctagagcagagggagaataatggatcaaagtgagtatgtgtgaagagcgctgtgtcctggggtcaaagtagaggtgaacttgaaagtgatgagatgggatagagtgccattaccttggcagtgaggacccaggaaacagctattcacactcagccatgcacggtgggaggagagaacaaaaatagttcttaaaagcagactatggaggcatattggagagctgggcagtttttctaaattagcattcgagagggtcacagacagccctcatgtgtgtggcatgttttgggtgatgcttgatgacacgttgcagttactgggccagactgagaggggaaacctgggaacaataattagacacacattttcttatacagtaaagcctagaaaggacatattgattttcacagacaaaaaagatctaaataaaggactgccttcccagtgttctgtgtgtttcaagcacat

SEQ ID NO: 39840 - DNA, 1767 bp, Homo sapiens
atgttataatgaagttttaaattgttaatcattccatatggtgtctaggttttccgccatgattataaagcccttccctagccccatgtgatacaattttctttcttataatacttttatatttcatttctttttaagtctttggtatatctgacagcaatttatgtatgattcagatgtatatttttttccccaaaggtcccaacacctttactgaataatctttttcccataatttgagatgacacctttatcatacacttatatgccctgtatatttgagtctatatctggactcccttctggtataaagaagtgcagttgacttttgtataacgaccttatacctgtccaccttgttaaaccctcttactatttctaatatcatgtctacagattctgattttctgttaaaatggttaataattctgtctctctctctttttttttttttttgacatggaattttgctcttattgcccaggctggagtgcagtggtacagtcttggctcactgcaacctctgcctcctgggctcaagtggttctcctgcctcagcctcccaagtagctgggattacaggcgcctgccactacacctggctaatttttgtatttttagtagagatgaggtttcaccatgttggccagtctggtcttgaactcctgacctcaggtgacccgcctgtctcagcctcccaaagtgctaggatcacaggcgtgagccaccgcgcctggcccttaacatggttaataattctctgataaagattgttctagtctttttcaatcctttctcatccttttgattcaacttatttttcttatgtgctattgaagtccttcaagtctatgttgtttttttttatttctaaaaataaaaccaagaataccagaaaaccctaaggctgaagtaactgaaaaccaaactcaaaaattgatctgtagggttattcagttactctgttggttagtcaccaggtcgtgtaagtgcaagtcctaatcaggaaaaaccaagactttgtgaattaggatggggacactccagaggattcggagacctccttgactccatggagtactctgaactcaatgccttgagcctcctctgcttgtcaaagcctttccttcctcttaatcctcccgagggtgttttcctcctgacaccaaatgtgtgatgtccgttctaacaccagccatttctccagttctctagacatcaaccggatgtccaataattcaattaaattctgatactgtctgcctgcgttagcatccacccctacaagttaaaggctcagtcccacaatacttccctacttcagatgtcagctgtaaatggggtgcccaggtgatccacatttctgcccaggtgactacaaatttgggggttcccatggccccttcccctcagtttctataatttgctagaatgcctcacagaactcagcaaagccctgaagcactgattattctcattttattataaaagataacagctcaggcctggcacggtggctcacacctatagtctcagtaacttgggaggttgaggtgggagtattagagcaggtagttagacgtgagcagggcagaagagggtccttccaccaccaggaatgttaggcaaccatcaggtgatggtcaggtggttgttaactgtctctttaaaataataattggttgcagccagtgctagggaaaggcagtctcccaacagatagaaaacacctgaaactggtgactagcagcttcccaatatgatctc

SEQ ID NO: 39841 - DNA, 1052 bp, Homo sapiens
caggcacacctccttttcttttattgaaattctcaaagccaggtacagtggctcacctgagtttattcaaggctaatccgtaattagggaaataaaggttacagctgcctgttagtgactcaggtcgtataatcacattcctttaaggctcaaaataacgttccaatagctttgattttgaattacttattttcacaagttctataaaattacagagttctcatctatttttgttggcagctgtttgcctagcagttgaaagtgcttagcacatgatagtatatgataaacatttgtttaatttatttcaatattgtcagtccatattccagcttctttggcaaaggagactgttgtttttatatgaatttatccaaattttagttgtttccagctaagtttagaccaagagcccccacagaattacttccatgtcaactagtagaggaagagctttaatttaggatttaaatgccacaccacaattatctaaagtgactgaattgagctactgaataatagtccttctaaagaagattttagacacacatttcatttctgttattgctgacaagtgttttattttacagaataaaaggcatcttgcctgggataaaatttcgaaaggctgtgtttttgtagcactttcttttttggaaggatctctttttagctactctgtgtcatggtgatgttgagttctctgttggaagctagagttcctgggttttttgatgtttctaggcttttgggttttgtttaagatttgtgttttgggaaggaacatttccatggttacgcccattccttctaccatccttgaaaaaacgagccagtagagtaatctgattcctggattactactacacagatgtcttttgtatctgcctacacatgaaactgctaggcaagttccatttccatgcatttacttccttcagtgctttttaaaaatgaagcacttttaagattaggaatgaaagacttggattggcaagttaaacagggattggcctacgttatgttaatagtctaaactcaatgtaggatta

SEQ ID NO: 39842 - DNA, 1045 bp, Homo sapiens
tcacagtaagtctttatgtctgatagggcagcttcctctagtgtcttcagaaatttcctgactttaaaaaaaatccttattgttcatgcttttttaaagaattagctttacatgatgcaagaaaaagatctgttggaattttgattgtaattttgttaaatctataggtcaactaattacaatattgaatcttcttatgcacaaacatggtatatttctccatttattcaggtctttatttaatgtctcctaatgtctttttgtagtttttacttagagatcttacatatttgttattatatttactcctaggtacttggtattctctaagattattgaaaatgctgtcttctttttaattacattttcaggtatttgtcattggtataaagaaatgtatttgacaataatcttatattcaccttaaattctcttatttctaataaattgtactttttttggttttctacaaaaatgatcatatctaaaaataaagttagatttgtttattcttctgcatcattttgaattcagtttattatttcatgtgctattagaacctttaatttagtattatttattttttgatttgtaaatcggaatgcttttattatcttttcatttaggatgatgtttactgtaggttacttagatacgctctatggaaatctcttttattttttctaagaccttttattatgaatttaatgttgaattttatcaaatgctttctctgcatttattagaataattatgatttttctctatctgttattataatgggtcagatttatagatttttctcatactaagcctatccttgtattccttggataaatctaacttggtaatgtttacttttttcataacttttagctattaagtagataccaaattttctttcaaggtcaagtttgatagttataaaaaactagtgatactaagtcatagaaaatatactttaaaaaactagtgatactaagtcatagaaaatatactttattttataaaaagactttaactgtaaaaagtaaaaaaaaaaaaa

SEQ ID NO: 39843 - DNA, 1064 bp, Homo sapiens
cctggaagcagcgtgacgatcactttcattcttgtaatcatctgagtttgcctttgtcctagaaaattgagttcggaatctccagactccatacatatctcttgatttccaggggagaagggttttaaatgttcttacaaaatgtctcttgttgcctgaattccaaacgttttgaaatgttagggccgggcgcggtggctcacgcctgcaatcctctagcactttgggaggccgaggcgggcggattgcctgaactcaagagttcgagtccagcctggccaacatagcgaaactccgtctctgctaaaaatacaaaaaattagccggcgtggtggcgcctgtagtctcagctactcgggaggctgaggcaagagaatcgcttgaacccgggaggccgagatcgcgccattgcactccagcctgggcaacaaaagcaaaaacgccgtctcaaataaataaatgaaataaacttagtaaactatttttaaataatgttaaaattaacggtgtacgtagtagaactgtgagagatctcatcttggaaatagagtgatatacttgaaggcaagagattgggtcaggtactattaacacgttttacacatgaacaaaccgacactaagaggtaaggtaatttgcttatgattgagttcccaagtacaaagctgatttttgaactaaaatctgactcgaaaatctgctcttttcttatcaggctgcttcctacaaaaatataacctcgcttagcatctgcttgttaagcatccaccctcacagctctttggcattcaaatgtttgttgagtaggggtaatagagcactacgttcgaatcagaaaatgccttatttttccttgcttgcaagagcctattataaataaatgccttgttttcgctgtgtctctttcttgttgtcgagagctcaggctggtcttaatttctgcaaccatagtattatctcccaggtctccttctgccctgtgtattttgcagttatgctttatgtggagatgaagcatcctaagtgtggagaacgatatatggggcccgaacaataggtgctga

SEQ ID NO: 39844 - DNA, 1050 bp, Homo sapiens
gcaagaattgacctgatatagcttatggcttatcagtgagtgcagaggctgtttcaggactttgggacacttcactaaattctgtgcactttagccttttggtttcctgctgtccactgtcttgcatgcacttcacttcttgcctttggcaaaatttacatggtcattcctgttctggctgcttttatctttagttgcttacagatacctccctggatggttacttttccttttatttaaagttactactgttagcttctgtattgacttattatcttggaatccttacagccaattatttgcagccagtttgctgaggcaagtataaagaaaatatctatagacaaacatggcattttgttatgtataggctgggaacaattagaaatcaggctgcagaaatgtgagggttgggaacaaatagaaatcagtctgcctaattgtagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggtaaatgcctacggtcgaacgttatttaaagaattttgggcaaatgacttcttaaataaatacactgtgtgtttactaaaatgtggccttaacattttggtttgtcttgctccctcttctctgaagagtgtgtgtgtgtatatatatatatgccagttttttatattagaccttgaaatactattaaggcacaaagtgcctcagtgtcacacgagtaaaagagacttacgagatataatattcacatttgtagaccttacttagctcttgattagaataaatcaactgaaaaaggtatttttaagacaattggggaagttttgagtaaggacagagtgttagaagatacctagaaatcatcgttaatggtgtcaaggttatataagaaaatgttgatatttttaagaaaagtgtactaaggatataggggtgaaatagcat

SEQ ID NO: 39845 - DNA, 1027 bp, Homo sapiens
tgatggcctggaagcatagctggggtgcaggcagggttgtggccgctcgcagcctctaagccctcagggacagtgcacacgtggagagaagtcctttgggggattgagcagttttttgagcaagcgcatatgtaaggagcacatcagaagctctggagaggcaaagtcaagcctttgaagggcataggcccaagcactggctgcccaagagaagccccaggcccttctctgctggtagcatctgctccctccaggtgctggcggcatcacctagtcatgcaggtgacatggggcctcacacaaaaaaatgtaaataaaagcaagattgatgagcttggtcataccccatgtagtagttcatatccagagtcctgtgggaacatcgaagtgtggacaaagaggaaaccaaaagaacagtaagagggttcaagagacatgttcacaaaatagttatgaggagggaaaagaggagggaagcatcttctccaaatgcacgtatttgtgactgtcacttcctctcaaggggcactgaaatctccagatatgatttccttccctgaagaggaagaagttaaaggtggctcctttttatctgccatctgtcagccaggcagccttgtcactttgactttcttcaaagagatgtactccaccactatgaagcccagtagttccatttactcctgagtgaggggtgagctagggacgcaatttgtatctacgaggccacagggcattcttattttgcaactccatatcacccctgtgtacagctgggagcagggtgtgtgagcggtgatgggtgccctgcttccaggatataaatgtcatcactgcagtcctcttcactatggcagcttctataaaatatttctctgcagacagtaagaaacctaaattgggattttcacttaatttttattaatccaagcagaaccaagtttgctttatagagaaatcaacaactgtaagacaccctctcccattgcctgcccagactcttcctcgtccaggtgctgatttgtct

SEQ ID NO: 39846 - DNA, 1095 bp, Homo sapiens
ttttctctacggcatagcctcaggagttgtacagcgtcacctccactgtcaaggttatagaacctgtccaggttcacatagagagaacacaaaccccttcactcagtagaggagggtccattcattgtaatacaatcattggaaaacaccatctgccacaccggtttccttatcacctgtacccgcatcccccccgacacatgcacagaaacagggcagcctgtcacagaccctcagcgatcatggcatgggtttgtgctgggtaaataggtgcgtttgtgggtcagctctgcttctggtttgtagtttgacctggtcttaacctctctggatctcagtttcttcttctgggaaacaaaaaggctgagctccaaacccagtcattggaaactttaacgttttctcttaaccttttttataccctcatgcctattcctcagtggtagtgagggtcacggttcagtttggtgggggggtaaaagtttggaaaagcctccctcaaaagctctagaatcccttccagctctgacctccgtgagtgttgagatgctggtcatgctctttggctttttgggattttactttcctgctctgtaaaatgaagggtctactaaattatcagttaaactttttccagctgtcatgtttgatgttagtatgcgttttgatataatgaggttccttcatccacaccagtactgttccgctacggtggacatgtgcgttggcagaagaaatcctgtatttacaagttcctgcccaggctattgaagaggctcttcctttctgtggaatgatagaagcttgagtggcttttgcagcagggacctgagaaatcagcctactctccactttacagagagaaaactgatgcgcagagaagccgagtgattgccaaggacagagggcgagttattgataaatcaggctacagtcctgtgacctaaggcagtgtactttactgttgtgacctcatcctcttaatagaaaatatgtgagcatgaggaccctgagacataccacccccatctctcccatctgcattattcctatgaagggccagtaccctcaacagtgccatcttctttttatttc

SEQ ID NO: 39847 - DNA, 1014 bp, Homo sapiens
aataataagattaccaatggttcaacagaaacaaaaccaacagcctagtgtattgtgacagtcctgggacacagaggcagaattaggtacgtactgccttcatttaaggaacctgcaagcccagcggccttaagtatgctactaaggatatagtactagttgtcacataaataaaattctaaatcctgtcattaaataagccacccttatgcctttctcatctggcagcaagtttgtcagcacagggcagtgggtaaagagttgccgtctgctgcgtgtttccatttgccccgtgacctagcctggaattcctaccagccaacaacagaggaggcccaagaggaaggctttccccagaaacacgcagtcccatcccctggaaacagttccatgagcacattagcttagctgattatgagagtagctaggcatcagctcaggcactgagtaaagcagacctttgtaatggggctgagggaggaagcgtgtacaacagaggggaacagccaggccggagacagacacgcagctggggctgcctcacttctccgtttgcctccaccagccatgccttctgactggacattttcaccaaagaagatacgatggggtatagtttttaaaaaaatattagaaggatggcagattattaaaagccagctctcgccccctatttaatctagtacgtcatgccggcactggaggtagtacatgtgtgtcattcattgtttgtgggtgtttccccgagtgacatagttgtcgcttagttgccgctttcctaggaaatgcttttggcatcacatacttgcctgcagctgatcagggaagcagcttggcagggcaggagaaacacagagctgagtctgccgctctcactggcgtgctaaccatgggcaagctgcttagcttctcagcgtcatgttgctcctcatctatagaatgaagttgggtcagtgatttttctctaaggtcctttccagttcccatacttagtggttccagtgatacatattg

SEQ ID NO: 39848 - DNA, 1031 bp, Homo sapiens
ttttcccggtagtataagatgcaatagttattttctatccatagttatatcagaagctgagtatttcaaattagcaaacaaaaaaaggtgtataccccattcatagcttaaaaaaaaatgcaatgtatttctctagaaatggatctctggatcagagcccagctactaataacccaaataaacagggacttcctgtccatgaagagtacaccattaagaaacatcgagctcagcattgtttgtgtgtgaaatgcctccttcttgacaggagaagaaggaaggtgaattctacttgtgattcagaatgtaagaacattcatcggacaggggttttatcgtttatgttgcgtgcccagcaccacatgaagtgctattatggatataaaaggagttgctgttaaaaaggcaaaataagatgaaacgaattgaaaaatagaggcttttatgaaaagtaaatacattatggtgtacttattagtgttacaggaattaataggcgaagagggaaggcagtgaagagtgtggaggaattagtctgtttctgtgtatttgtgtaggcatagaacaagacattttctggtataagactattaatggtgattatctttggggagggtgaccagagggataagagagaaggaaaattaagcttttaactttatgcccttctgtgcttttaaaaattttatcccttgcgtatattactctgacaacaaaaagactaatgtaaggtttttgttttaattaaagtatttgaacttacgggaaaaaggtatctacaccaactgaacaaaatgcctcaagcctcatgatgggttgggtcaggtgatgagagtacagctgatcattcaggcaacaggaacttctggaagccagtgatcaaagcaggcattgggctgggccggcagctctcacctataaaaccagcatcttgggaggctgaggcaggaggatggtttgaactcaggagttcaagactgatttggtttgaatggctttttggttttgacaagtttcaggtgtatatacgt

SEQ ID NO: 39849 - DNA, 1066 bp, Homo sapiens
taactttctcctgtcctagtatcatttatggaataaggagacatttttgtcttagtccaacacaccagaacgcaaggccagaacaccctcaattccctgcattttgcttccaaaggaaacatccatccttttgctgaagtgactggtctgctttgctccgagttaccacgttttcctctgtgatgctagtaagcctgctccttcagctgtctgctctcctaaacctccccttcttcctctccacatagcatctccccagtccagaaagaagcctttggcttccgggctttcaagtcatgcttctgcccagctctttccccttctcctctatctgcagggtcatttgcactcataagcttcactgcctccccttaacacctcaaccccctggcatccaagcagtaaccccccatgctgcgctgaaccagctcctgcacagatacccagggttccaggcatgccaaaaacatgtgcgtgcctttgtccagtttgacctgtccaaagcgtctgaccattctggctggccactccaggaggctctcccagccctcctcactcctgcctccccttctgctggccctggcccagtctcgtctgctggccctcccactctgtccctctaaaactcaggcactgcccaagctttcattattggtccctctctttccctgtgatcacatccaccgccatgacacacctgtctcctgcaaggatgactctgaagtctgtctcctgtcctgacatctcacttaagtgtggtggttcagagcacaggtgttgaaaccggacaagcctgggttcagatctctgccactaaccagctgaccctgagcaagccacttagtattcctcagcctccttatgggcttgtctctcctcctggactgtggggttgctcaggcagagactagatattagattagattttaccatattgaatgcccacttggtgtcaggtgttacactgtgcacttgatgcagcccatctcggatgaagtaggtgtgtgtttgtattccctttatatctcaactcagagctatttgaatccaaaacccatttcttccc

SEQ ID NO: 39850 - DNA, 1035 bp, Homo sapiens
tctggcttggcatatgctctagacttatataatcaggcacagccaactcaggcacttggccccccccttcaaccaactcagtgtgtcatagtcttgaatcctcttgaagaccttccttgcctaccttatcatgaatcaccagtaagcacctatgttttttccaaaggacttggtttgaggttctgttagatattcctgttgactagatgctcatctgtttcagtaatctcacttgaatgtggaagcaccctttgtttcctggcagcctaatttctctgcacagttacagtggttagatgtgtattgatgagcattactctctaactgctcgtgtcaaagcacttggggaggctcatcaatcttgtgcgtttttaattgacatcaataatgtgtttgcatttatcaatatttcctaattgccgagttgtcacagtggaacttctataataaatcatgcccacagatagcttcagaggttacagcttaacattcctgtcaatattttgatgtattataaattgtttttatcagaattttttcctgtgagaaaggaggagctgtacagcaagagacaaaagaattgagtcactgtcaccatatacagttatgttaaagaaccaaatcattccaatggaaatagaaaaaagctatttcccaagctgatacaattcattcccataaagtttggcatcatcatctagattaatgcaaatatgtttcccctgatagtggtgtgctgtgcccagctcctctgaggagaggcatctggatggtcggacagtgagcactcttaggaggaaggcactgtaccaacctgcttttcagaagaggaaactgtgaggaagcttcgtgagctgcagttacttgcccagagtcaaactgcttttgcagagctggaactcaactcagggccgtctgagtccatgtttggactcttgacctcttagggacaagcttaaacccaaaggaggatgaggcctggatattagaaggcatgagtctccatcatctgttaaagcaggtagaggcagtagg

SEQ ID NO: 39851 - DNA, 1050 bp, Homo sapiens
agctggaactgggcatttgtccaagactccttcctcgccccaacttccccgcattctgtctggacacctcccaggcccactccctccacttcaccctcactaccttcacccatcccatgctgacttctaacctgggtggctgtgtccgtataccactctcagtcccccctgcaccctgccctccttactgtgaggtttctcaagtacagcagcaactaactgagctgtgtgctgggcactaggataaatgtggtagttggggaattcttaggaggaggaagttcagtggtttctccaattaaagaccttgtaaggagaacagagaactgaacccaatctttgactccagaacctgcacggtctcacccagccactccacccccttgcttcaaatttgccagtggcgccatgtggtttctggaatggaattcattcttagcttcacatggcactcttgttcttgcctctcgcttcctgtctactcttcatgtcagcaaatccaacttcttgcattttcttaatagtgccacacggctgtagaccttcatgtgattccatattgtttcctatgtttggaacacactttccttccttattagcaaatttttattcatccttcaaaattcaacttataggtcaactctgggtaagcactctgaaactgcccaacaccaccctgctccctttttttaattttttaaaggaaagaagaagaataaggaaaaaactatagttgtttcttattgtttttgggataaagtccagaatccttaccatggtctgtgtttcctgcctttctcgccttatgtcctgtcaccttcccatttggggatggtattgtcactctggcattttctcagcttcttaaatgctctgctccctggtgctcatgctgtccctctgtcttaagatcttctgcactcactcgcctggaccccagcaaggcactctgcagtcctgtaagttcacagccccatacacgtttccacagtgacacttgcaccacttgtaattgtacatttattttgttctgatctgaatcatggttct

SEQ ID NO: 39852 - DNA, 1031 bp, Homo sapiens
gaaatttctcatagctaaccgtcactttgccaattcagttaaatttgttgaaccatatacttaaccagatatttattagtcatccaaagaactctgtcactgtaatatgtagctttgatatgatgcttgtttgatgtttcattcagcaaacatttattgggtacctgccttgcgccagactcattgttccttgctgaggatgcagagataaacaaaacataacctttgcccaagaggcacctgtagttcggggcatagactgatagattccctgaaatttctacaacagcatggtgacaatataccaatagtgaaatggaacagaatattgtggaagcagataggagagacagcagcctaacccgaaaggggatcggagctgaagaaagcagtggtggctgacctgagctgtgaagggctagtagggactagctggggaagggaggcaggagcagatgagaaacaaacagtgtagttggtgttggctgtaaggaactactagcactctgtgttgctgatggcatgtagtgggagatgagggtggagacaggtgggactactaatcacagagagctttgtatgctgtgctaagataagatgctagaacgtggtcctcggcattgaaaagccattcaggtgttttctgcagattgcagactctcctttagctagctcaccccatatagaaaagacgcggaagacatagaggccagtcaggaggccattgccctagttgagtttactcagatgtttccagaggcctggctacagcaatgtgacagcacagggagaaggggactggctttgaggtatgttgataaacagaattagctggccttagtgtttggttgaatatgttggattagagagaacaaatcaaactaaggttatgagaatatcattggaagaagaaaagttattccaaatgaagcatcaaacgtagaggacactgccttcttggtatgaggaagacatttttcttgagtacctttgtgtacagtatcacttcctgagagcatctggacattgca

SEQ ID NO: 39853 - DNA, 1024 bp, Homo sapiens
agcccccagaaggccacctaagcaggctggatgctgcccagggctgggccacagcgtgtcctttgcaagtcagccagcccagcccccgaaccccatacacacacaaagacatcttgcaccccaggagcagccccacagtgcaaaggagtccatgcagctgctaatggctgctcgggtttgtctgatctgtctggggtcaggcacagcctccaggggcctctggcccaggttgcatctttcctgcagagcagaaaaacgaagcacagttaagaaaaccccaagaaggcagtcagtttcctcccttgagtttccggggtggacttccggcagagtttttggagaactgactgttgcagttaaacaatgtgtctggcaagaagcgagacttcctcccttcctgctgcctggctcatggggctgcagcctcacttctggaggtggcaagaaagaactgtggagtctgtgatctaagggatccctggcagcccacggcagccagagaaccacacccactggagaactctaggttctctacggcctcttgttactgccagtgcttgtgtggtttgaggtgggtaatgcagcagcctcctgcagccagcccaggactgggcagcatggggccaggtagttagtgtaggagagcgagcctaggcttgtaaagcaagacttggctctgtcactgggcaacttttttatttttttatttttttttgagacagagtcttgctctattgcccaggctgaagtgcagtggcatgctcaaccccttcctccctggttcaagcaattctcctgcctcagcctcctgagtagctgggactataggcacgtgccaccacgcctggctaatttttatatttttggtagagagggggttttgtcatgttggccaggctgttctcaaactcctcccctcaagtaatctgcctgccttggcctcccaaagtgctgggattacaggcatgaggcaccgcgcccagcctgggcaactttgaagaagttacttagcttctctgagcct

SEQ ID NO: 39854 - DNA, 1049 bp, Homo sapiens
gtgacagggcttgctggggaagtgttgggagacgaaggagggagcgaggagaaagagaaataaaagggatgagggaggtgagaagagggggcgatggaaacagaaaaagatacggagcgagatgcgggagggagctggaggaaaggaatggactcacctacctcccacccacccacacctgctcacacaccgacaatttgcactagacgcagcgttagctgcaggtcgggcattcctgggtcacgtctttcattcacctttaacactggcgagccccgaggctgggcgctgggagaggccgcccgatgcgatgaggccgcgcggagccagggtctcgcaggaaagggcagtgggcggcagggcggggtcgtggcgctgctgaccggtgttccctcctccccgcagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacgtaagtgtcctctctggccggctggacttcggttttgggggcgctactgaggtcggagagtgccgagcctccccgcctgcgctcagcgttcagcgccagcgcgaatccgcatcggctcactcttgccttctggctccaacccccaggcctaggaccaggcccccgggttagaacctgcgcttcccaaggggatcccacagcccggggtgggatatggaggaggatccttcaatatagacccagtcccagctctacgcggcctctcaggcttgcacagaggtgcgcatgctcgacatgctgggagccagggcaaggggcatgaaggattgctacaaaatcttggtgctgcaagatctctctgccttgtagcaatcttgatcattctttgctcttgcgtgaacgagtgacctgccaggtgttctctgaagaacagttagtttggatttgaggagtgtttggggtaatactacatttgcctaaagggaaagtcactcctctc

SEQ ID NO: 39855 - DNA, 1051 bp, Homo sapiens
ggctgaggtggatggatcacaaggtcaggagttcaagactaccttgaccaatatggtgaaacctcgtctctactaaaaatacaaaaattagctgggcgtggtggcacgcgcctgtaatcccagctactcatgaggctgaggcaggagaatcacttgaacccgggaggcagaggttgcagtaagctgagatcacgccactgcacttcagcctgggtgcttccgtctcaaaaaaaaaaaagttcacacatttttagacatttcagtgatgttttagaataaaggtgatttaagattggttttacaggcactcttgggctgtcagctagttggcttttcagatgatgatcataaagacactccccctcacgcaggtatatgagtaagtaaggtctaccccatccacactcccatactgactttccattcccaataattgcacagactgcatactctgatcgcttattaaacatttctaaggaagccgagatggatctttgatgtaattttctcatctgtatacccagccagtaagtcagtagcacctaagatttctttcccttcaagattgtattctaagcagtagaattaaagtgttcttcatagaaaaagtaacttttaattagaggctgtgcaaactctggagaatcagtctttgttaccagataataatgtttttagctttttctgctgagaggaaaaaatgctttgaagaataaaaaatactagagcataacaagcttggggagttaggaaaaaatatattagggcagtaagaaccagcattacgtcttctctgcaatgcttgaaacattcagtattaaactttggattaatccaaagtctgaagagaaatacaccaaaatgctaaagccgtttttggttaggatagtggactttttttttcttcttcagaatgtttgtaatgagcctatattttataatggaagcaataaatgcaaatgtgaaatttatctgagcctcctacaatgagtataataaatccagtggttgtggatagcttatttgtggccccaaaagaaacggagccact

SEQ ID NO: 39856 - DNA, 1094 bp, Homo sapiens
tcctatgttcttggcttccttttcgtcgccaggttttcagctttcctttagctcttcttctaatatggcttctgcccacaaaagcctgctctgtcaggatctcatggttctccacttgccagaaccttcttcagcctcagttcctcggcctcaacttgtacgtttaacccattgaccaccaccccccaaattcaccttcatttctttgaccctgctcctcactccttttctgttgaggaatctgttgactaactccaggctcactcaggctcaccgtcctgctctctgcaccagcctttccagagcgtgccagttctcatggcttcatctgttaactgttgatcacttcagtcctgatttttagacctaaatggtttccttaacgccattctaactgcctgtgactcattttcacttacagtgtttattgtaacgccaaaccaacaaatcacaggtgcttgcttctctccataaatctccccagtctaactttttgtcattcaacatgactcgtttatccaacctgaaatcgcatatagccccaagtatggtgttttgtacacaggtatttaataagtgacttccagttttggctctgctatgaataaaaagagatttcagttctcttcactttgaaatctaacaactcagagaacattgaagaaattggaatttagttgggatgaaatacttgtggtttaaaatatttctgttcatattttctaatttgttgccggaggtcttgggttttctatttgagtgcttgcaaactcaatgtgatttctgtcagcatatcttaggtttgtttgttatgaaacttatgcagtgtgaggttctatctgaaaatgttatttagctatcttctgggactatttaatgaaagtggggtcatgaatccttaaaattcttgtgcagctttgagaaacatttctgttatttgggtatcagtttgtaagtgtggtaaagccaagatggaaacgagcactttgctttcttggttgttgttactggtctaacctcctgcttgaactagtctgctgtcctgtcaaatgcatctttttatttacatgtcccttaaattaaagctgatcatg

SEQ ID NO: 39857 - DNA, 1046 bp, Homo sapiens
ttaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtaagagtgaagtatctgctcttgggttacagaaccagatagtactagaactaagattacagggtaaagctgcttttatcttttttctttttctttttctttttttttttgacatggggtctcactgtattgcccaggctggaatgcagtggcatgatctcagctcacggcagcctctgcctcttgggctcaagcgattctcctgcttcagctttccaagtatttgggaccacaggcgcacaccacaggcctggctaatgtttttgttttgtttttggtagagacggggtttcaccatgttgccaggctggtctcgaactcctgagctcaagtgattcacccaccttggcctcacaaagtgtcaggcttacaggcgtgagccactgcgcccggctcacagggtaaggcttctgtctggtgtgttgtattacggattttgcttaataggcacagtgaggcattaaaaagaaaattcagtatgcctgtagaaaggataatccttgtttaaagtctccaaattgcagtcaaagatgttttgactgtgcctttttttgttcccctgctgtcccttatgtagacttctgtcagtacccatggcagcctgtcatcttgttgacatctccttctggactgtgagctctgtatctggcttgtttttcatccccagc

SEQ ID NO: 39858 - DNA, 1044 bp, Homo sapiens
atcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcaga

SEQ ID NO: 39859 - DNA, 1062 bp, Homo sapiens
gattcctaaagggaaataaagtcattgtataaatagatactcttatgtggtccaccagtggtacataacatgaacctttatagcaaggggaaaggtctttaaagcctgaaaataaatgtgatgaagatttattctttatcatcagtactagacatgattttctccttccctttaataaagtatttgagtagaagtatgttctaggaagactagaagagaatataacttgtttaccaagatatttaaattaagtaatttgataggtgttttaaaaattagagtaaacagctggtcatgatagtatgtgcctatagtcccagctacttgggaggctcaggcaggaggattgcttgagcccaggagttccaggcagcctgggcaacatagcaagacctcaactcttttttaaaaaatattaagtaaatggtgtaacggaactcctttaaaatatgtctttatgttcttttagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgctagagaattgggggctctcaaatagcacgtaaatattttacgtcaagtttaatgagtaatggaacaatttttcttactacattttattagaaaaactacccagtataacttgaaagaataaacctaaaatattacccgacaatttattttacagatacatttc

SEQ ID NO: 39860 - DNA, 1080 bp, Homo sapiens
cgcctctgcctcctgaagtactgggattacaggtgtgagccaccacacccggccagtgcctaggttttattaaaagaaaataattatggctgataatttattgagggctatattctcaatacttggcatgtattatttagttctgacaaacccactgagcgtagtcattgtcgaactgaagtttggagaagaaactggtcagggctcccagttcataaatagattggagaacacaggatccagacctagatctgttggccccatagcctgtgctgtactcagtgaaactcagctttgtagactactgtataattattgaagacttaatattgaaagttatgaattttcttggtcttcttacattttctgttttattctcatgtgcttttgaactttatgcctgtaggaagtataattttattatgctttttttcttccatttttgtagctacatccttgggtcttaaccttcaaatttgcattttgattaattgcttaacgtggattgggattgcctgattaatttttacgttctaacagatgctagttttcagatgaaactcttggactttatcttttcttcattcttctatttacctgcacagataacactaagctggaggtgaaggtgacttcaccaacacacgtaaccctgctgcttgattatttcactgccaaaaatacgcaactcttttttaccacatgatttggatgtgatctggtctgaaattgagacgcttattgaatgcttatgtgggagtgctagcgtacagacaaaagggtttcagcctatacagcaacttgaaccaatttctcgttagtaggtgactggagtgctctattggaagggattctgacaccaaagtccacaggaaagggtgccagaatccattagtaatgcctttttaaatattttgtgctctttccatgtgttctaatttttttgtctctattttgtttctcagattttccagcaaataacattgtgaagttcctggtaggctttaccaacaagggtacagaagattttattgttgaatccttagatgcctcattccgttatcctcaggactaccagtt

SEQ ID NO: 39861 - DNA, 1034 bp, Homo sapiens
ctgcaacatccccaaagaattggtaggcacattactgttcaagaggcactgctccaaaagttctgttttaattaatgaggtatgatgaaattcttattgctaatcccagcaaagctgtagagaagcaatatttcttcctaacataaagtgaagtctttatttcttttttttgagtcggagtcttgcattggggcattctcagctcatacaacctctacctcccggattcaagcgattctcctgccttagccttccgagtagctgggattacaggcatgtgccaccacacctggctaatttttgtatttttagtagagaacggggtttcgccatgttggccaggctggtctcgagctcctgacttcaggtgatctgcctgcctcggccaagtgctgagattataagtgtgagccaccgtgcccggccaaatctttatttttaaataatgatttttttttctcccatagtaatctcctcttaattgttctttttcttaggtagaagataaagaggaagaagatgtgtctggtgaacctgaagcttcaccgagtgcagatacaactatactgtttgtaaaaggagaaggtaatacagaagtattagttttaattcagatgtaggcattttaaaacgatgagcttgttcatatatatctgaatacccatatctgtaaagtaatattgttggcatttaaagggaatacgtaggtgatatagacacaataaaaaataaaccaaggggaaaaaataaaataaatactacctagtttaactagaaattgactgtccttttcaaagattttgtttttgagacagggtctggctctgtcacccaggctggagagcagtggccccctctcgactcactgcaaccttcacctcccaggtttaatcgattttcctgcctcagcctcctgagaaagatgatgttttaaaacttctttaaactgccacagcaaagtaactttgtcttttttttttttttttttttttttttaagatgtagtctcgctctgtcacccaggctggagtgca

SEQ ID NO: 39862 - DNA, 1069 bp, Homo sapiens
aagcgtctgctttagggtaaagtcgttcctttgaggctgatctttaatgatgtcattttgaattcagaagtgaacacacagccccacggctgtgctttctaaacagtagtctgctcctgttttaatggaatatacacctttaaaaattagccacagaatttttccagccacaacggtaggagtgtatctggttttatttaggaagcaatttgcatgtgatctggaccgctggtttgcaaacttttttcttttttgttttaaggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactg

SEQ ID NO: 39863 - DNA, 1042 bp, Homo sapiens
ctgtgcctgggattctttccagcatttcctactttatacagagaagccaagagtggtgtctgacaacttctgtgtaactggattttctggaaatatccagtgtagctccagggacatcacttttattcttctacactttccagcacccaccagacaccatgcatagatttcctttcttaaaaatctcatttttctaccttgccatggggctgatttgtatccaaaagtaatgctgcgtgtctaggactgaatgatggttaacaggatgatctacttgggatggtgagatggtcaaaagcataaacttgggggttgggtagacctggctggctgaccttgggaaaaacctctccacgcctcggtctccccctttgcaaaactgagctaagatctactgtgtggtgtctgggcagatgaaagtacactgcttagtgtgatgcttagcatggggcagatgcttggtaaattgtaatcacttttgttgtcagttaaatggatatttcactgttgcctcttaaacgcttacgataatatatactaattatacatgttattatcagtttatatttattgaacatttcggggaagtaattataaaataatcttgtctactgtcttaccccattccttgtatccttacttaattattgtatgaaattttatgggagattcttttaggtttatatccatagaggatcctagcagacctaggcgtgagcagacacaagcccaggtgaccacgctgaagcccttcatccctggcacatgtggctgggttacactggacccttaaaaatgcttgtcctctcccgaccttgggctgaggcctcttgtacttcagttccgcaccttagctgctctctgacgggtcttaggtgttgaaatagtatttttacccccgtttgctgacatagtgaataacaacttagtcctgcctattttagtgctggtagaaaataaaaaagaaagcaatgacttagaacaagatgtttcatgaaaatgttgggcaagcagcagctttatgagatttaaatgaaagaaa

SEQ ID NO: 39864 - DNA, 1042 bp, Homo sapiens; identical to SEQ ID NO: 39863

SEQ ID NO: 39865 - DNA, 1042 bp, Homo sapiens; identical to SEQ ID NO: 39863

SEQ ID NO: 39866 - DNA, 1025 bp, Homo sapiens
tcctcttgcctcagcctcccaaaatgctagggttacaggcacgagccactgcgctgggcactctggtgtctgcaagtgctgaccccttcagaatacgtccattgggcgttgtattttgtattctttgtgaagtatccaagtacgtttcaaagaagaggacagggtatagggtaagactgtcctttgcattgtctgctttgtttggttgggttttggggtagggacagctatcacttggctgccctggagactcagacctagagctttcactgagggtgaggctgacgagggggctttttgctgaagcttccagagggcttgacgagatcagttcctgacctggcctcactcagcacagcagcatcgtacaagggttccaggttgttgggtgagggaggcatctgcaggcggttccccacagacacagtcacctcctggatggtttccctgtgtctccactgacacacccatgactgttttatttcctcctgttagacaccagagccggaagtggaaccgcccagtgcccccgagctcaagcaagggctgtatgagctctcagcaagcaactttgagctgcacgttgcacaaggtaagggggacgtcctgatgccagcttcagagaatcactattattccttggcgtgctgggcttttccttcctgctactcaagggctcttagatagcagcatcagtggcactgacaaagggtcactctagaggagctgttgggaccgttgttcagtgcacctcctctaaaacatgagttctccttttgtctgtgcccttatagaaacgccgagtctaatgctaagcacacgtgacccgcacactagctggacagtgcatccttggctaagagtgtttattgacagactcacctcgcttgattgctctttactttattgcactttggagatactgcatttttttacggattgaggattttggcagcccagcatctggcaggtctagcggtttttccagcagcttgtgcttactttgtatccctctgtcagcatct

SEQ ID NO: 39867 - DNA, 1050 bp, Homo sapiens
aacttgctagaggaagtgacacccaaactaaacctgaagggcagatagatttagctaggtggagtttagggacgaagtgtcagagagaatgtgtcccagggccaagccaagctatagtcctttgggaacactgcagatgctgcagtagggctcaggagtaggccacaagggaaggagggtggactctgggatagaagtcaagcgggaggtcagcagggccagaacaactaggatccagaacaacactttgctaagtttaatactggaacaaggccaagatttcatgctgagaacagggcagtgactctggagggatgggagcaggggagagaggtcctggagtactggtccaggagctgccatctgcaatggtgtaaagaaaggactgagagccccattgtcccctggacagagctgaagttgtgggccagctgccctgtgacctgatactcaatgtgcttgtactcttgccttgttccaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccacgtaagttggaaggaagggggcacacttcctaggtggctcctggctacaaagaaagtcctagttaaacttttggtaaaggtgtgaagagatactaaatttaagcaggcagtccctgtcattagggagaaactgcatttaatgctgtgtctgttttagatggcttttatacttggataacctttaattcatcagtgttgggttttcctgtttataagagaatgtgtttgcaagagaaaaatgacggtcccgccatgctagatgttcaccggtacattttacacagtgtgcatggactgtcatcagttttggcttgcttttgctggtgacttattcgcaaacacccttcctatagttccttcccgtgtgactcccacagggctgttcctgttggaaagaaagtatagagtctgacagacgat

SEQ ID NO: 39868 - DNA, 1034 bp, Homo sapiens
atgtaatttttctagatttcctcagagcctgtaatttcacatattaaagtttaaagattagattttttttagttttgattaagtggctgtgatacatatacttaatgtcacatacaagagtgatcatcctactctacatttcttgaataaggtgtaagcaaaattattatccattataacatttagaattccttaattactgacagttaatgactcagaatggtaagaaataaaatataaaattcaataatgttcccacttgaaggtaggcctctgaaattccctatatatcctggcaactattgtgtaatgcatatgtgcatatacaagcaatgtgtacaggctctttgcattaggccattcttgcattgctatgaagaaataactgatcctgggtaattttataaagaaaagaagtgtattggcttatggttgtgcaggccgtacaggaagcgtggcaccgggcatctgctcagcttctggggaaacttcaggaagcttacagtgatggtggaaggtgaagggggagcaggcatctcacatggtaagagtgggagctcaggagaccactatacttatgattacagtctcattataaaggatacaactcaagatcagccaaatggaagagacttatagagtaaggtctgggaaggtcccagatggagagtgtccatgccctcctccatggaatctgagcacatcaccctcccaggatatcactgagttgttcaccaaccaggaagctctactgagcctcggtgtccagagattttactggggccttatcatatagacatgattgattaaatcactggccacaagattgaactcagtctctacctgtcccctcctctccctggaggttggactggctaagaattccaacactgtaatcacacagttggtctttctggtgaccagcccccatcttgaagctacctaggggccaccatggatcacctcattagcataataattcctgtcattcaggaagttccaagggcttttgaagttctgccccaggaacaggg

SEQ ID NO: 39869 - DNA, 1034 bp, Homo sapiens; identical to SEQ ID NO: 39868

SEQ ID NO: 39870 - DNA, 1034 bp, Homo sapiens; identical to SEQ ID NO: 39868

SEQ ID NO: 39871 - DNA, 1025 bp, Homo sapiens
ttgagttctggggtattgccggcactgtatacctgattttggttttctgttgtggagagtgaagctagctcgcttctatatccgcattttggaactgcaagttgtgaaattattttcttacgtgtgtatttgaggtttacttatagacaccatgatagaatgaatttgtttcttttttatgtgaggaaaatagaacattgttaactgtggtatgcggcacaaatctacttgaataatcttttggttaagagaaaaagcacttgataaattcttgacttttttttttaagtcaatatagtctcctaaaacactgagataacaggggaaatgacttcgtactgagttacaaccagtaagtgttgcagatgtgataggaaggttcagagaaatgggccttcttggtgtcactaattgttcaaaaagggaatgtttggtgcagtctggtgattgtctttgactttagaaaagcaaatttcataaattcagaaagtaaaccttttccgttgtgtgcctaaagagttaaaaggtgaattgcttcaaagggactgtaatttctaaaagtggatattctgtctaaacataacaatcctgatgaggaacaaaagtgcacctttgtcagatgtgttctgattagaattttaaaggacataacagatgacaaagtaagtggcagaagcctgtaactctttttttaggttaggctcagaatcttctgaaagtgatgaagctcctaacaactgccaaatggattttaagttatgttctcagagccagtgggggaaaaaaacaacgcaggaaatgatagaagcactgcttgggaaagatgatgtcatgttaatatgccacagaaagaaggcagagctaatcaactcctgtttttttttttttaaatattttcttttttaaaaatcaatgattgggaacctaattttcaatacttaaatattatctttgatatagctaaaattaatggttactgataaaaacacaactttttgaaaacaaaattcttctcttttaccata

SEQ ID NO: 39872 - DNA, 1025 bp, Homo sapiens; identical to SEQ ID NO: 39871

SEQ ID NO: 39873 - DNA, 1025 bp, Homo sapiens; identical to SEQ ID NO: 39871

SEQ ID NO: 39874 - DNA, 1025 bp, Homo sapiens; identical to SEQ ID NO: 39871

SEQ ID NO: 39875 - DNA, 1064 bp, Homo sapiens
ttactgccctactggttttctctttacctgataactctcaataattctaaagtttatcttagagaaaagtctttgagtcacctattttggaatttgagcccagtgaaatgataagcacctgcagtttgtatcacgtctctctctaaccaaatctctgagcattcttgtagcttgatagcaaattgggtgaactgctccattcactaaaagattgagttcagctttattgcaaacagaattatgaaggtctgttctcatgcatttactcagcctccttcatctgagtcacacaccactggaagtagcccctccttatattaagcaatattgacttgaaatggatcatttcctttttttaggtttactaaagaataccagagaaagaactgtatcttaatctatcttcctttccaatgaagtaaaaaacaaattatttgacctccaaatcctcagttaatgtaaattttgcatttgttgaaaacttggtatttcgcaggaaggacatcaggttttgtactgaacataacattgaacacgaagaacctttataagtcagtgttcactgggctgaaacttttactcctatctgaatatgttggcttttgagagctcttgggggattgatgttgttgtttttcaacttctatctcctacttaagtgatattaacagttgtgcttatgtaacatctgtgttgtgtgtgtatgtttttaatctctacttaggttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaa

SEQ ID NO: 39876 - DNA, 1396 bp, Homo sapiens
gagctagaaagggatggtggaaaaccagtgttgtaagtgaaatagtctgggagatcccatcagaaatgtttttaaaatctgtaaatttggtgaggggagaaatctgttcatttctttgtttacagtaagtttatatagggaatgtcttccaaaaaagtagcagagttaacaagtcaaggtcattcataattatctcagactcaaagggacaagttccaaagtttaaactgtaaaaagaggtgaaagtggtaaccgtaacctcatcctttttgaaaaactctgtgagtttctggcaaaagtttcctgagggaaaaatgaataaatgtacattcttaaaatagatcatctaaaaatattgtcaaatggatcatctagttaaaaattattagaatagggggttgggtgcagtggctcatgcctgtaatccaggcactttgggagaccgaggctggtggatcacttgaggccaggagttcgagaccagcctggccaacatggcaaaaccacgtctctactaaaagtacaaaaaattagccaggtgtggtggtatgtgactgtagtcccagctactcaggaggctgaggcaggagaatcgcttgaacccaggaagtggaggttgcagtgagcccagatcgcgccactgccctccagtctgggcaacagagtaagactctgtctcaaaaaataataataataaataaatcattggaataaattaggaatttttagaagctttaggagctcttggaataaaaactattttttactgtgagtctgttgataatcctgactctagagactccaaatgtaaaatgtttaagttggagaatatttattttgctgtgttctgtatgttagtatttctttaaataataggcctgtaagcaacttatactagtcctcagtgacaccaaatgctgttctgaaatacaaatatcacacataacattgccctttttacctagtttaaaatctgggtgaacaacttgaacataaacaagcattagtactctattgtttggaaatgctttaccaaatggctgagtggagaattatctgaaatgaaagagcgatgaaaggactaaaatggtaagaaagaggtcagatttgaatcatcatatatttcagcagctgacatgaaatcaagttggagtaaaacttattgttacatctgtttgctttaactatcagcaaagagatttgtcgaagttgattttgaattttattcattcatttattcatttttggtaagaaagctcccatttcttgttagatttgcagctctttttattactggttgagcttttaataaatcgtacattttcttttgaagtccttgctgaggtttatatatggtaaagatttagaaaaagaacaaaatgctcttttacaaaat

SEQ ID NO: 39877 - DNA, 1101 bp, Homo sapiens
cattaaccaggcgtggtagctctgtgactgtagtcccagctacttgggggaatgaggtaggaggatcttctgagcccagggaggtcaaggccacagtgagtcatgattgcaccactgcattccagcctgggcaacagagtgagacctgtcttaaaaaaataaataaaagcaatatttaacaactggtacctatttatagttcctatttcagattttttatctctgtagtgaaagtgtaatataagtaatgttatttaaatgtggagaaagtttattggagctgaagtacattgattaccaccttcttttattccatgctaggttcaatatgttttagtagcttttcgaatttaaaatgatcatgaggcacaacttacctcatttcaaaacaaaaaaagcctgcaaggtaaagaggatttgctgctaaggtatctaagcatctctctcctggtggcagcctaaacacagtctttgaacttgagggagtctgtacttcattttagtgagactgtgctgctgtgagcatggctacccaacagggctccaagaacaatttctatctgaaaaccacaataacaaacttgttggctttttacgaaatatatatttaaatgtgacatatggtttgacatttaactttttaagctttatattaggaaaaatatcatcagtcgtcctttgtgatgacagccagcaggctagtgaacgtctgttcagacccacaagatcttgcttgctgtagcatcgggctgtcattaagaaggagagtatttctacatctaattaaaaataaaaaagatgatactgaagtgtaactcataaaccaagtgtttaattaaattttcttttcctctagcttatgcaggttttgcagtagggaaaagaaatactcggaaaaggagggaacttgtttggaattcctttgccagcagaatgaataaggtcataatcctatagtgcaaaatattcatagcactagctgcaaagttatttaattacgagtctaagtgcactggagggtacttggtttttaggcaggttagaagtgtttcattcagtacagcatgttaaagttagggttacattaataatatttagcat

SEQ ID NO: 39878 - DNA, 1066 bp, Homo sapiens
gcactttgggaggccaaggcaggtggatcacctgaggtcaggagttcgagaccagcctggccaacatggtgaaaccccatctctagtaaaactacaaaaatcagccaggcgtggtggcgcatgcctgaaatcccagctactccagaggctgaggcaggagaattgcttgaacccaggaggaagaggttgccctgagcagagatcgcaccaaggcactccagcttgggcgacaagagtgaaaccctgtcttaattcatctgactcctgcctcccttgctatcctccttcccgtcattctctcagccacaacatgtgccccagagcctgctgtatgctgggctgtttctacccagcatccttgcattactcttctcttttgttccctggtcccagcccttcccttcctctccacttcatttgcatttcccaagtatctctcggttcccactcattcctcggctgcatctctctcaggcgcctaaaccacattgaggtgctccttcctctgtgtgtgtttgtacctcatgtacacttcgggtctagctcatttcactcttactgtaattctttgaaaatctctctaaattataagctgtttgactcaatgattgtagcgacacatatttgtaacaccattgtctgaggtaattcctggcatgtgtaggtggtcacccctccataaacactgaataaatttttaaacgtatttctctatgcttttcaaggagtttcctctatactttctcactgtacctcatcactaagaaggaaataggaccagtgttattggccttcttttacagagaaagaaactaatgcttaggaaacttgagtggtttaaaggcacggcgctcagtttttggaagggccaaactttcagatcttctgactgaagtgtcttaatgtgtggggaagctctttgtcttataaactgtaaaataccgtaataattgaggtctgcgcaggccccaacctatccatggtttggggctgctatctgcctcataaagcaaagtggagggtttgtcttttggaaaaacaaagtcgttttctcctctgaaaaagc

SEQ ID NO: 39879 - DNA, 1035 bp, Homo sapiens
taccaatttactgttattagtccgttttcatgctgctgataaagacatacccgagactgggaagaaaaagaagtttaattgaacttacagttccacatggcttgggaggcctcagaatcatggcaggagtcaaaagtcacttcttacatggtggtggcaagagaaaatgaggaagatgcaaaagcggaaacccctgataaaaccatcagatcttgtgagacttattcactaccatgagaacaatatgggggaaaccacccccatgattcaaattacctcccactgggtccctcccacaacagatgaaaattatgggagtacaattccagatgagatttgagtggtgacacagcgccaaaccatatcaaaaatgttctataaaattaccttcaggttatgtgtataatgtatatatgaaacataaataaatctcatattaagacctgtgtcccattccccaagataccttactatgcagatgcaaatattccaaaacctgaaaaaaatcgaaatttgaaacactctggtcgccagcattttggatgagggataccaagtctgtatctattgttattctgcttttttagaatgtgaagttatattttgtgggatatgccccagctaacattgccatatgatgtccgatagctgaggttgcgttcttaagcattagagaaacaaatctcattccttttcatcaagaccaaatgtgcttgtttgacaatatcatttcaggtagcaaccatctagatttgagaaatatcttgatatatctttaatggcatctagaacaatatgcaataaaacttagtctctgattataaacagaaagtggttaggaatttgaatataaaatgttcttggttaatgtaagaagcgtgctccttctgtcgtaccctaatgtgtgtatatatcgtgtatctattgggcagtttaaatgtaataacgactgtaatactgacataccttgatacaaatgtttaatcctttagtgaagatttcaaaaattgtgcagctttttttttaatcataaaa

SEQ ID NO: 39880 - DNA, 1021 bp, Homo sapiens
cttttaggagaaacaagtataaaaacgaaaaagctataccattatcatttaggaatttgaaaaatatgtataatatgattgagtccaggacatcaactcgtttttaacttcgaggccttattcatggatgcagcatgatcagacttcacgttgagccatgtgacagatgggtcagaaagggaagaattgattataaacagtctcgtaatctaggcaagagaaaatggctgcctgatggagtagggtccgaaacagatattagatatagttatagaggtagagttaacaggaatcttggcaaaatatagaatgtgaggaaaaggaaagattcttaagatgactcccagatttttagcttgtgtttcatactaggtactgttaagtgagattgggaatataggaacaaacagtagatttgttttgaggggaaaataatcagctttggccattttaaatatgaagtgccagcagagcttatgagtagaggtatcaaagaagcatttagacgtagagctctggatctcaggagagaaggcagcgttggaaattcaggtctgtatttccagctgcacatcaaaggggtgagtcagcttgagcacaccatatcaccctagcaatatttctaaaaagttgaaggatgacagctaacacacttatggactgtcatatgccaggcaattttacatttatttcatatagtcctaaccaaaatcctgtgataggcacatttttaactcctcccacttttgaaggtgcagaacctaaagctcagaaaagttaaacgatttgcccaaggctcctcagctaataagtagtaaagccagatcttgaactcatatctgtcaaaattccaaagcatggggaaagcattatgctatactgctttcttatactattacctataattgtattgagtcattacaatatgcttggcagtttactaaattacaaacatctcagaagaaggtgactttgggaaagcgtgaccttctggagaaatgttttgatgccaataaaagca

SEQ ID NO: 39881 - DNA, 1049 bp, Homo sapiens
tgttttttgattaaacgtttttctaagtgaattgagatagtttggaacttggaagagaggcagcatttcaaaataatttagacagcgttatttttacttaattacttaatatataaagtcctagtgttaactttttctcttggaaaaaaaaaagaatagtcttcaaacattagcacagggtttctccacctttgtgtaatgatgtgtgtacaaagaaatgagatggaactttgttttttctgttttataatcgtacaccataggccatgattgattccggagcgcagttaatcaaggcataatggcatggtaagattcttttatttgtaacgttgagtgtggcaaagtatagttaaaatcacgttttttcaggttaatgacaccgtaatgacttttttttcatattctacctttttttggtgtgggacttttgtccttcaggtcggaaaactcaaaaataaactgaaataattgtgacttcaataggtcattgtaactcaacattatcactaattttaatttttaaatatacattgtatgccggaaatgctacctttttattccattttagcagttgaagttgaatatctgtgttgaatttaggaagaggcctcaggcaattatacacacctgtgatttttaaaatatatatatatatattttagtttcactgattactgtgagcttcaaaagcaaagcacaatgttgatcatttagtctgaaaactaattttaattccatgcttcatttttgctccttgcatcacaaggagtttggcccatttttttttttagatgatggttagtatcagtcattaatgtttgaagtggaagggatatggcagacattccccaatgatcacagttattaggtatcagaggtctttatcagtcacactttctcaccagtgatgttcttattaataaaacagcattctaaatgcaaggctttggtgggcaagttttatgagactgatgcctcaggcagaggaaacaaatttattttcatgttcatttcaaatgttttgtggggagtttcagtagcaatgt

SEQ ID NO: 39882 - DNA, 1030 bp, Homo sapiens
aggtcatttactctttctcgagatacagaaatgaaaatctcatgaatccttggaaatcagaaattctgttaggtaaaaagagaaaggctggcacctgatcccagactctggttttcacagttggaaagaatcttacagattcttgaatttccaatttccagttatcttttttaagatggaatcactctgtcacccaggctagagtgcagtagtgtgatctcaactcactgcaacctccacctactgagttcaagcaattctcgtgcctcagcctcatgagtagctggaatcataggcacgcgccaccacacccagctaatttttttgtattttattagagatggggtttcgccatgttggccaggctggcctcaaactcctgacctcaggtgatctgcccgccttggcctcccaaagcgctgggattacaggcatgtgccaccgcacccagccaatttccagttgtcttctaatggctctgcattcaagtactgctcccctcaaatggacaatagattcaaaccttgactctttgaattatttttaaagtatatattgagacagaaatgttttccttaggaactacaacatcactattttcattaatttaaaattaccttaaagacatttgcaaataatagtactttcattaaatacattaataaaaaccaaaggggagggagaataaagcaagcttatttcagagatttagttaagagagagacagagtgcacgagacagagacagagggaatgtgcctgtctaaagtcctagggtcaaagcaaagcgactactcatttaaacattcctgctctacctgcctctattctattacagcatgagaactgatctgcctaatgatcctagtgaaaatcctaaatgatcaatgattcaattatatttcctttactcagcttactaagctaagaaaataaaatatctaacaattagaattagtgtaaggggatactagatttaaattttaattggcaggaaaattacattaactaaatccttccttcttgaggat

SEQ ID NO: 39883 - DNA, 1051 bp, Homo sapiens
aatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaatgcatgttgcgagttttatttggttcaaagcagttaaaatgtatgcctgcatggaattccaaatgacctatcacttgggagttatttttacaataaggcattattttagccatgaattttagacatttaattcttctcttgtttcagtgagcaatggattatatcattacctttacattgtattcatataccaagttaagctgtttcaaaaatggccattcactagaaaaacgtaagattagcagaggatataaagacgataattaataaattgctatataaagccacctagggaggagcactagat

SEQ ID NO: 39884 - DNA, 1064 bp, Homo sapiens
acaaacacctcccaccaaggccccacctccgacattggggatgacatttcaacatgagatttggaggggacaaacatctaaactatatcatggatctgacagcaatcacctgtggatggtaaaactattcggtgaaaattgaatagaaacttcataatgacgactcaatacctgaactcactgttcagtttgagtatcagtggaacagccggaaattacgtacctcctgatgtgaggcagtaggaagtagacagaaccctctgaagtattcgtaccaaaaacattacacctgagtctaatcaagcctgtaaatctaattgccagtaacaaaacgcatgtgtagagaaacaaatgatactacgaaacaatcatacaaacctataatattagaaattcttcataaaggatctagtttttctaagaaataaaagacatgaaagaatgggaggagcaaagagaactgttattggttagaagagacttaaaaaccatttcaaaccaatggaagatggaccttctttggatcgtgatttaaactaattataaaaagacattctggaggctaggaaaacaacgacatttttgagaccgagaaatttgaacatggattgggccattagaagatactaaagaattgttaatgttgatagacaacagaatgacttcatggttatgttaaaaagtctccctatcagaaggatttataaataaagtgatacctgagatttgcttataatattctatacttcccactcccctgccccccaaaatggtgggaagtggaattgataaatactagattggaatcatattgaaaattctgaatttcggcattggatgctgagtgttcatttgacttattctccttgcattagtgaatgtttgaaattttctataactaaacatgacatattattaagacagatggtaaaaaccatttaactaaaatcttttaatatcaagatggaccttttttttgagacagagtttcactcttgttgcccaggctggagtgcagtggtgccatctcggctcagtgcaacctctgcctcctgggttcaagc

SEQ ID NO: 39885 - DNA, 1032 bp, Homo sapiens
aagatccccaggtgacttacgaacattaaagtttaagaacctgaaaaattctgaaccctcaactgtgttcaatgaaagctttaaaaagtccataaagatggtgtctccatacttcttgtgtatcttcttgaagcatgatgcaatagtttggtaaagaaatgagaaaagtagaagatgaggcaatcgtggtggcttatttgactcttgcattgtccttctaggcaataccagtattcttaccttttcacattttttagtataggttggaattattgataagtagtgataattcctaggatgactaaatagaaaaatgttttaagttatagaaaaaaataagatcactaagatcccgtaatgtatcatagacttataaaagggttcattctattcatgttaattgcaagagagaataaatttgattctactttaaaaatatataggcaattttttttctgtgttctttggaagaaaacttccaaaaagaaatttaaaaaataaaattggatccagttgaccctgagaattaactgggagttaagaatgttaaggctctttcaaaacacactgaaaaccagatcatgtgtatgaaaatataactaggaatgcgaagtatatgaaatggatatcgtgagtattgtaaaagttcagatgaatgagtatttgattaattcattcaataaatattaagtgcccattatgtgccaggcattgttcttggaattggggctaactggagcttagattttagtggaggacccagccaatacacaaattaacaggccagtgaaagtctgggtaatacgtgctgtaaagaaaaaatagagcaggtcaggcgatggtgaatgactgcagcacaggccaggatgccacaagcagatgcttccctcttctttggtaactaggcccttgagatgatggggagatatgtaaggagttaccatttggccagactctgaataaaacacaagagccatgtgtgggaagtggagcataaccaaactgcagcaatagttctgtttgtaaagtcct

SEQ ID NO: 39886 - DNA, 1123 bp, Homo sapiens
aaaaacaaacaacaacaacaacaacaaaaactaaactaaaacgatagagacatatacagagtaaaaagttagtccctcccttttccttctccccatgcccactatcctccttgcctctccagcagtagtcactgttaacagtttgatgtgtggtctctggcatttgccttatgtgtatactatatgtacttgtacatacatgcctaggcaagtagattggagttggtaaacaatttatttctctaaatcaaatcccagaaagcagagtttgtgctttatgttatctgattgcactctgattttctttcttacaggaaagcattctttaaggcttaggaaactataggaattctttgaggcttttctttttttacctagtttatttaacttatttttattagtaatctgaataaaggtgccaaaattttaaaatatactaaacctggagggaaaaaatgtctatatttaggaatttggactaatcttgtcagcatgtgatggtgaggctgaaatgaagaaatattcaatagggataaaaattttaaattgcatttaaaattttaaaatgtgttatagaagtttaggatgtaagacttgatttcagcagtagttaacttgaaaataacctggtgatgtttgttggcaaggactagctgatgtagtgtctgaatgcaatcttatgataactgtaatagaagtatactatcctgatcaagaaggcacaaacctctttgtacccttccctaagcaggccactttcagaatactatattcaggtacaggaaatataaggtaaaacacaagtagcccagagattttatttctgtttggagcaatatggatactatctaagtgggtttgtatagcccactaattactaaatgctttgaaattaatggttatataataagtataaacaagtttgaatttcatcagatagctagataatgaaatacttggttgatttttagaaagtaagcaaggacttggtatttttgtaatagaaacacatcaaaaaatcaatcctttaattataatctaaaccaatttcaatagcctgtgcatggtctcattgttgctactcaaaatgtgacctttagcccagcagcttcagtatcacctg

SEQ ID NO: 39887 - DNA, 1047 bp, Homo sapiens
gttaccatctttcccaggtaggtagtagaaattaaaggtaaaaaggaaagaaatataagtttgtctttgaaattaaaaccaatgaaccaaccaaagatgaatgaaagataccttattgacttaagtttctatttgtaggatattttactgttaggattcctaggattccaaagtatccagcctttttctctttcgattcttcgaacgtatagcattttcaaggagtaaaaaatcaatttttaaagtatccagttgggtaagcctaatttttggttcttcaacaagggttccatttaatctagtttccttcaaaacgttttagtcagtttgggaggttcaggtgctttcatgttccgaaagagaatgttgaaaatgtgtcaagtagatattatgtatctagttatgttcagaaaacagggccctgctattcagggttaggtggatgatcgtctgggttggacagttggatatgtatcatctaacttgacaggtttgcatttctgggagtagacattgataaggggaaagaagttgcaccagaaacttctttaatggcccaatgtggtgaaaatacgccagcatcagtagctcatagtaattctacagttacagattcacgcatttgtagcttttcttcttaattgaattgggacataactgactttgacaatgaacaattctaataaatagttaatttatgacattttaaatctaaccatttaataattggagagcataacttgttctgaaatttatgtgacagtttagaacctgagatctgaggtcattcgtgggcttgaatcctgacaccagcatttaactgtgtgaccttgggcttcagtattttatcctgtaaaagatgataatatttcataaggttttcgggaggaacaaatatgatggtgccctttatgtgtctaaaacagtgcttggagtgcttagtaaatattaactattataatgatgtgtgttcttttttctcccatatctattttagttgagacacttcagaatgatgtctctgtcccttttgtggtcttaatatac

SEQ ID NO: 39888 - DNA, 1023 bp, Homo sapiens
ctccttcgcggcggccattcccgcgcgcagcccaccctccgaccctccggacccccgaacctgctctcgccaccgcccgccgacgcctggagcggagaacggcgtttcccgcgcgcggcacacaccctgcctcgggagttctggggttcgggccctaacggtcaagctcttgcccctctcctcccttcaccgcgcctgcaccccgggggtgtgtctgtgcactcgtgggtgcctcctgggtttgcagattggcttgggaagcggctgggtttctatcagtgtctgggctcggaggggcttctggtgtgttctttccgacaactcctctctctgcccgatttcccaggccagtcctccactctggattagtaacgcttctttctcctcggcagtaagctgtgtgtgtgtgtgtgtgtgttcacccgtgtccgatgaactgcctgacagtaagctgtgtgtgtgtgtgtgtgtgtgtgtgtgttcacccgtgtccgatgaactgcctgacagttttagtagcagagcctggttctttggttacaaagggagaacatctgttgtgccatcctcaaaggactggtctttaggcaaaatgtgaaatccgcgtttgtcttcagtggtccatattcagtgtttgcctcacccccttcccgtagggttttctctccacttcaggacttgttaaaataagcgcacttcctttctcttccccactccatctgattttgctctggctacccttttaggcacgtaccatctgcctgattatgtgtgaccacttaatcttaaaattccaacctttcctaccccgcccaccacagtgtatattccccttgcctgcttcatttgtcttctcttgagcatgtattagttagcgtactgcatattttgtttctttagcttgtttcttgaacgtctcctctaccagaatataggtttcaggaagacacagatttttgtcatttcgttcattgcttgctagatttctagtacctacagcagtgcctggcgcacagtaggtac

SEQ ID NO: 39889 - DNA, 1032 bp, Homo sapiens
atttactccagataaacagactcctactcagaatcctgtctgtgttcctcaggacttgctgggtttacctcaaggggccagacaaagtgttattttcttttcttcatttttctttttttagacggagtctcactctgttgcccaggctggagttcaatggtgcaatgatctcggctcactgcaacctccgcctcttgggtgcaagtaactctcctgcctcagcctcccgagtagctgggattacaggtatgcgccaccttgtccggctaatttttgtatttttaatagagatagggtttcgccatattgcccagactgctctcgaactcctgatctcaaatgatccgccgttctcagcctcccaaagtgctgggattacagatatgagccaccgagcccggcccaaagggttattttctgagtgcacccatgatgtgagaaaagttgttaagccctgactttcaaatttctcttcctggaaactgacctggattttactaatgtcctatctatggcagagtctggagtgaaccgaagactaagcataaatgctgcaggtcaggggctgtttcttatgcctgaacatcgcggggccttggacaccgtctttccaaatcaagacagcatagagcacaagtgctcagagggaatgagcgaggatgcagctggctgctgcctctcagagtcacagttggtgcacggaccccagcactaacaaacggccaccaggacgctcctctgtgtgcatgggctcatgtccctgaccacgaaaggctcagaagacgcacctttggcctggtgctggctgtagccttcggggcatctggaacctgaagtccttccttgaatgctgcaaaaataatctttgcagccaaagtcaggcccgcctcggcctcccaaagtgctgggattacaggcgtgagccactgcgcctggccgcaggcatgtcttttttaaaaagacaaagcatgtaatttttatattagtctcagtttggtcagagaaaatgactggtctgttgctatcagcctc

SEQ ID NO: 39890 - DNA, 2107 bp, Homo sapiens
attagccagcatggtctcgatctcctgacctcttgatccacctgccttggccttgcaaagtgctggggttgcaggcgtgagccaccacacccagctgattctggttcttctaaattgctccctgggaaagtagtttttggggaaacattggaattattattattattattttctagctagcctgaagggctccgattaaggatgaagggaaagtaaacaaaatgattcaatgggtttcatttttctaagtcattcataacctaaatagggatattcctggggtttcaattgtatgtttctgtactaaaccataatactcgcgaaatcttttcccaaaacttcgggttttggagagaggtccccacaaaggcctctaagctctgtaatacatatttaatgtctaaaacaaaaaatctcatttgaagctggggtattagaaagaacatatattctttaaaagaggcatgaaaaaatattttagtgtgtgtactcaaattttatctactgaaatgcatgtagtaggtaggtgaaggaacaagagaaagaaaagaactggatagttcattttctttaaatataaactgtagcaaatgggtttgagatactcctttagtgctccatttgcccttatcccaccacatgcaaagacttgatttggggtagctatatgaagctgaaatctctagccttcaacagtgttctgcagaaggactttgtttcagcccagcaccgttcatcatgcctttaggggtctgggtacccacagctgactttgacctaggactaaaacccagcaatcttttggctcctttctgctttgtttaatgtgtttcaagggcctcgatgcaaggaggcagtgctttaagagtcttcccatttagttcctgcatgcctgtttcgttcccatcaatgtgcgaatggcctagattccaagttatgagggagggtgtgggtcagggttcttacctggtatttaaaaaatgtttgggagtgccctgggcctatttgaaaagtttgaatctgtgatcactgtcagctcctccaagacttctcctctcaacagacaattgcattgtagggcaccccagaccccccttagcctacatggcagcaaataccactgtgccagttatatctggactctagggtagtcttggccaactccaagactggccaactccaagacttgtccactgtgtgcagagtattttaagtatgttatctcatacaatccataaaaacaaccctatagtgttgggtattgctatttcttttatacacatgagaaaatggaggcagtaagaggaagaggaacttgttcaaagtcacacaactgttaggcagaaatgaggtcattcaaatccttaatcttctcctccagaccacactgcctcccaggaagagatgtgggcacctcctgttcttgccaggcaggaaaccgctccttatcaatgtctacggggtctgctctcacacccaggaaggactgtgacaagcatggactaacctgcggctccactcagcctgctgtcagcaccctcctgttcagcaggatgcaacatctgatgttctgccaggaggctgtagagctgcacatagaagtagccagtgtttcttcccattccaaaatggaaatatcactcagccttttttaaaattgacttcctatgttcattttgattgtaggtgatgcagcaagcctcagggctggggattttcaaaatcttgttggctgactattatagatggccttggaatttgctcttgggggtctgaatataacgtaggaaaatgtcctttctcagggagtggggctttaaagttcgtttgtttgtcactccaattttagctgtgcactgcacctttctttgcacccctactctcttcatcttgtctcatagccacagctattgaatttggcctgtgatcataagttgggtttctgatctgatctcttgcattctggtgggtactgggggcagaatcagctttgttaatgattttctgggcagaaggtaaattcagctgcatctgaaggggcttcacagtccaatagccgtccttttgttttacataacagagagtgatggtcaaggccacccacatc

SEQ ID NO: 39891 - DNA, 1029 bp, Homo sapiens
ggcacagactgcgtctaccattggagctggtgcaggtgaaagtgctctgggcagtagcacgttaatcatgtttaccacctgctgtgggtggagccctggagctggtttgcctcctggctgcaggaggggtttattgcctctgttaggccacaccagcagcagatggggttctcataagctgattgtttccctctgcttctggctgaagcaggaggatctcttgtttcttggggaggaagcatggagcactgggctgctttcctttcttgggcaggctttggccactctaggtgtttttatccctccaaggacatgcgttcctaggctgcaggaggtggggttaatgtgatcccgcagtggctttcctgctggcacctaggttcatggaagtggagtatgtggcatgcccatcactgcctggttcctttggctgagatgagaggtgcccacttgcggaaggctggggccctgggaggacttcctttattcagctgtgggaatcctgtaggaaccccagcactataatggctggtttccccatcctctctctttctcgataataatctttcagttgtcccagcaggttcactgccatggatatggagcaaccagctattcgtcttcaaagagaagagccactgtgttctcccatgtcaagcctccagcccttcttgctttccagttctttcatcttcaagctctagactctgccctcctttcattgatttcccaaatcttctcaatacaatgctggggtctgctgggggcggagcctgaggggttggcacttcctttattaacccatctggtagttctgaggctcagtcgtttcatcctatcccccattccactcatgtgaaaaatggaaaacacggggctttgggaccacagaactgaatttgcaccctggatctgcacatatctctgaccttgggcaatcataatctctaagccttagttccccattttctacaaatgggggtgatggtgctggagtggtgcttaagtgagccaaagggaagcccctga

SEQ ID NO: 39892 - DNA, 1029 bp, Homo sapiens
aaagaagccaggcattgccaaatgacgagatctgtttgtccttggctctggataatgtgaaacaagagcttgtttccctaaatagttttaattctatggctattctgatagggaaacggtgggattggatcttggtctcttcagattgagggcccagtacaagtacagaacattattactgtgatcgataggagattatagccatgggcagtctctggaactcatttatatgcatattatttccttagtaatcaaatatgaatctgagaagtggtgctcaacgagcatcaggaaatctggctcctgatgaagacaggagttggtgaacatctgcaagcttggaaggctgccagccgataccttcaccggaatgctaactcctccctcctccctgttcagcctcggcgcctgtggctggctgctgagccctcttcctttgccgtgtttagtccctgccagtgtatgcagaagttggtgtgttactgatcattaatgtggtgttattgccagactggtatttgtattctcaatcaatttcctttagaaggggattcatttaatacttagagggggttgatttttatggtggagctggggagatgaaaagatacatatttaatttttatgtttttaattaacatataaaaatggtatatatcgatcatatacaatgtgttgttttgcaatatgtataggcttactttggagaattgtgggtgcggttccaggccactgcaataaagcaagtcagacacatttttatatttctcagtgcatataaaagttatgtttacactacactgtaatctgttaagtgtgcagtagtattatgtctaaagaacaatgtacatactttcattaaattttttttatttttaagtttccagttacttagacataaaacgttctatattaaatattaaataattgaaattcaatcccaataaaaatattgaacataaatataaagcacgtgaacatatattttcattaggataaagaattttccagattttttttaaactctag

SEQ ID NO: 39893 - DNA, 1107 bp, Homo sapiens
atccccttccctttgtaaagttaggcatcccaaatatacagaatgaaaacagtaaatttaagctattaaatgccagactagctgagatcatacttttatgataactagctttaacatgcagtttatagaaatgtatcatatataaaatgtgggataaacctgagttatgtgtttatagttgaatttctgtaactactatatgacataatcttagaacaagaattacatgcacatatattagtagcataataccacgtggtataatacaacgtagtccctgaataaataaaacagagatcttgggtctctttgttttttcttgatgattacattgcaggaagtgatattttttcatctaacatataatgtattttagatcatttgttttagccttctaatattttgattgggattttaaaatatgaagtaaatttatagttctattcttttaaatgtaacattaaaagaattattaaatctaacataaaatggatagatgtttaatgaaatatgctatcttacagccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaagtaagagtgaagaaatttcaattgatgctattcagaatctgttttttataagacatttattctgttggtatccacagaagctttttaatccactaatttatatactgacatatctattatattattgattttaatctctcaacgaaaagtaatttactccactatttaaacaaattaaaaacaattgtttgacacacgtacagaattgtatttcagtctgaattaatttgatgaaggaaataaaatgatgttaggtcacctaggctaggttaattcatttgctattcttagtaataggatttaatgatttctgtaggttatacaatttaacttttaataatgttaatggaaaagataaagttgagagataatctagatcttataatcaggatctgtgg

SEQ ID NO: 39894 - DNA, 1034 bp, Homo sapiens
caaattgcctacatattcattgccttttttaagaatttgaactggtagtctttgtcctcctgaattttttctgtatttgtaaaacacattttgccatatgtgtggcagatttttttttctagagagtcatttgtctttgccatttgtggcatgttttgtcatagggaagttttaaatttttatgaaatagttttatcagagaattcatgaatgttgattgtctttgatagtgttgatagaattattttttctgaatttgtaagaaaatttagatgagcagtcattttaaaaatgtctttatttagacaatactgaatatcatcattataaactgcttaatgaacagaattgtctttcactcaattgtgtttggcttatatgcttttgtgttaaagtatctcataactctgtagtgttttttctgtttttttgttttgttttgtttctgtttttgtgtttttaagacagagtttcactcttgttgcccaggctggaatgcagtggcacaatctcggctcaccagaacctccccatccccggttcaagcgattatccttcctcagcctcccgagtagctgggattacaggcatgcgccaccacacccagctaattttgtatttttagtagaggcggggtttcaccatgttggtcaggctggtcttgtactcctgacctgaggtgatctacctgccccagcctcccaaagtgctgggattacaggcgtgagccaccatgcctggcctgtttctataaagtctttaggtctcagttttctcattggtgaaatgggaaggctgtactatctcacctgtttttggcttaaaagtttataaacttgttagctctgttgattattaagaatcaatacatttgcatactttgctttaaccatttatttccataatccagtagtactttatatttttgatattttgatgtaatattttgtttctgatttgttctgcttgattgaacggttgtttttaaacacaccctctttgcattttactgtgaaatctatttaacatattca

SEQ ID NO: 39895 - DNA, 1080 bp, Homo sapiens
aacaacaaaaaaccctgccgcattatttagtaaatagtgatggaatgagtctttattatttatttttttaaaatacatattgttaggacaaagtgtaaagtaagttctagatggattaaagagttaaatttttaaaaatcccaaaataatagtaacaaaaatatgattcttttaaaaatccaactgaaaaccaagagaattggctaatggattggatctgaaaattacataaggtctgagaattgacaattgtacttagcagagtagaggtcgttggtgacctggacaagaaagtttcagctgtgggatggagacatcctgattggaatggattttaggaataggtgagttataggcagtggataactctggaggactttggccatggtgaggagtaaagaaatggagtagtagccagtggtggaagtgggggcagtagaaaaaaaaattaagttaggagattgagtatgctgatgaaaatgtcggtgtcgcatagaaagaggtagacagatgtgtaattgaggggatgggcttttgagaagagcattgtggggacaggcagagtgtgtaggtgcagattctggttagtgggttgatttggtctttaacagttaagagactggtgagaatgctgtaagtttcatttggagttggttaaagagtttagtgacttttttttttttttttttttctgttgtggcactaagcaactagtcagcgtgagcttttgttgttgttagctttcgttttcttgttcatagatagcggagatcatttggaaaaagcttggttgcttgtagacatgttgtttattttctctcccacttttgaatcaccagttatgttttttccctcaggtagccaatgatcatgtgcaactttgttgtaacaatgggtacagtggtggttttaggtttccttttagtgtagtatttttcatttttaatactgtaaatcttctgggacttccataggcttcatatcaattcttccttttaaaggaagcatcaaggaagtgtttatatcttctatacctgtgatctctcacaagctacccataccattgaatcctgagagaaa

SEQ ID NO: 39896 - DNA, 1028 bp, Homo sapiens
tgtttatggttgctttcctgttacagtggcagagttggatatttgtgataaagaccatatggcctggaaagcagaacatattagtagtccttcataggaaagctttgcctacctctggtctaggttctggcatcttccaagataaaatactgttaaatatttagttactattcccttatacttcctaagtggataatctgtgcccaaaacttgatacatctttagtttctgtctcatggaagattttcagaatgtatatttgtttactatataaggaaaaatagaaaggttttatttgagaaaataagagaaactttgcagtatataggttaatgtaatttgataattttttactttgttttattgaatatcgttcaccaattgaagatcacttttcaaaaagcctgacaaatcaggaaattatgaatatagaaaattgctttctgtgtaaaattcaaatagttatgccatcttgttaaagtggcatcttttcgtggtctgattgagcaaaaacatgttgtggtaactatatttggctgtgttaaaaaatgttaacctttggaattaattttgaatttttcgttagagtttttggtaaagtgaagatttcagtaattacagacaaaggatttttgctaaagatagaatatacagtgttgattataactagacatctttgagaaaaattattttatgaaaaatattagaaatatgtatagtttatagtatattaaaatattctcttgctttctgtattctttttacttttgtgaaatttttgggaaagttttttatttgggctgatagtacttgctttctgtgttattaatgaagttaaatgtaatgataatgttttacgtggggaaaacaggaaccctaactttgctttccttttaacaagccaccatgaatttactagtttttaaaaatcataaaaacagggctttactaactacaaaagcattaattttacacattattttaaaagtataaaatttattttcagtttgtcttttaactttattaat

SEQ ID NO: 39897 - DNA, 1080 bp, Homo sapiens
cattaagtgtggctgactgccacagttactacttgagactgtcactgagacagttattactgttactacttgagaccatcattatgagactgaatcaagggggacagacatagaaatgaaaacttaagacaaaggtaactactttaaagtaagggtaacatggggaaggagaagagaagaagaaaagggctccctgcttttagtgagcaaaggcagctgcctaagactctacagcccttaatatgtattgggtagaaagagcagcaggaggaggtaatgattggtcagctgctggattgatcacaggttcacattattgctaacaggtttcagttatgcctaatcagaagaaacacttgtgcctgggtggtggctgccctcagcattccttctgggcaacagacacagtttgtcagtttgccgacatcctgcttttatgagaaacagtttgctgtttgcacatatagcctccagtactatactgagttgatcacgacccttgacaattaaggattgttatatcttgtttgataattgatccttgatcattatgtactattcctgtttttctccgataattttccttgttctgaattctgctttgttagaaattaatataactagtccagctgccttttgatcagtgttggcattgtatgtatttctccatccctttaacctatctgtgtctttatatttagagtgagtttcttgtagacaacatatatttgggtctttttgttcactcttgtcagttctgtcttttaattggtatatttagatgattcacattgaaagtattgttaaagttgggttttagtgtctaccatatttgtttcttactcattatacttgttccttgttgcttattttaaaatgtactttttttttttttttgagacaaggtctccctctgtcacccaggctggagtgcagtggcgggatctcagctcactgcagccttgacttcctggactcaagtgattctcccacttcaggttcccaagtggctagaactacaagggcacaccaccacacctggctaattttttgtattctttatagagatgggattttgcc

SEQ ID NO: 39898 - DNA, 1006 bp, Homo sapiens
tctattaaaatgactcagctccaatcactagtttctggttgttttatttctttttccctactgactggcttatcctttccttcctatgtcaaattcctgagagacttaacagattggcctggctaattgctatgattcttagttgggcagagcttttcaatacagactatgttgtgaattggtggccttcaagtcaggtgctaacctgtgttgaatcagctgtaggaatggtggtaattataaaatacaaaataccctgctggtacaaggatagtctgggtctcacttctttcggtaggggcaatgtgtgaggcagtttctcctaggaagggttggcagttaaccataattgatctgaagcttgggagagaggtctaggtcgtgactgatttaggagtcacttgtaggtggtagttgaaactcagagtatttgaaagagagagggagaatagagtgagaaaaagcagtgggccaaagatggggaccctgaagaacaccaacattgaaagactagagggagcacaaaagaaatggtaggtccccagacatcaaggagattggtgtcacagaagctgagcacgggagggtgcagtggctcacacctgtaatcccaaaacttggggaagtcgaggtgggaggactgcttgaacccaggaagttgaggctgtagccagcggtgatcatgccactgcattttagcctgggcaacagaatgagacactgtctcaaacagcctccccaccttccctagaaatgaggaagtgatatttagtgtctgttgcaacagataggtttagtaggataggcacagatagttttccactacgtttggaaattagatcattgtgactttagggagagcagtttgaattgagtgatggggcaaaaaccagatttcagtgggttgaaagagtaaatgaaaggaccaagtagagaggatagtgaatagagattatccttgagaaatatagatgaaggaagagatgaggcatttcctagaggagga

SEQ ID NO: 39899 - DNA, 1043 bp, Homo sapiens
gaattctagatttcctgagttctgcagttgtttgtggttgtagatattttacaagactgagcctcagtttcttcctctgagtggtgtgtaagttgagctggacgattggtaaggaaatttccagctctgaatttccgtgatgtctaagattcgtgattactgtttatttagtactgtaaggtgtcttgattagttttagtcttttacataaaattgatgattaggtcagagaaaaatacacgtttatatgaaattagttggagtttggaatatttctgacactgctgtctcagttgtttttattcttggcctctttattactttctgttgtgtaatactaaggttcactttctgggaacataactgttttataaacataaatcattatttctggaagaacagattttgttgttatccttttatttttcctctcttctatctttcctttgtctctctcttaccccttgtcagaaagtctttttccctttctactgcctcttcctcttgtcttgttactgtagactgtgtgtgtgtgtgtgtgtgtgtgtgtgagttttccgttgttactgttgattttctgcgtgttttgtgagaggaccacgccgattgtggtgggcaactgtgtcccagtagcagtagcagtagcaaaggagaagtatcatagagagtagataatactttaaaatcacagaataagaagagtgaatttttatttaacctatcattgtgctgcattggttttacctaagtatcatgagacacttttaacagtaaaaactactattcatatattcacgtattacagaatttcaaaagaatgattttaattattttccagagtgacgagaattttccttatctttgaaatagaagtattttgctttcttttgctccaaaggtattctggttttttgttgttgttctggtgtttttgtgtatgtgtgtgtgataggatttcaactttgttgccttgatggagtgcagtggtgcgatcatggctcactgcagtctagacctcctaggctcaagggatccccctgcct

SEQ ID NO: 39900 - DNA, 1033 bp, Homo sapiens
acatggcaaagccccatctctatggaaaaaaaaaaaaaagaaacctcaagtaacacatataaagaagcaggtaggctacttaatcccagaggtgactttctggtgttacgtattctaggaggtactgagaccagaatatttaaggcaccagagaaggagaagagagaggagtagatcagaatctgacccatgttacgtgtttatttcagtattcattgaacgaaaagaagctgctggaattgagaacagaaatagtggcattggtaagaaacaagactgtgatttttctttgtctttgtactcatctttgcttcgttccatgcatggttgtttgtaatgataataggaagttacatgcaggtttactgtcatgggaattttttacattgtgctaaaatacacacaacataaaaattaggatcttaaccattttttaagtgtacagttcagtacatttaaagtacattcacattttggggcaaccatcgccactggctatcacagaactctttattttgcaaaattgaaactctgcaccctttatacattcccttttccagcctctggtgacctccattctactgtctatggatttgactattctacatacctcatataaatagaatcatagcatttgtctttttgtggctggcttatttcacttaacacagtgtcctgaaggttcatccatgttgttgaaatgacaggactttcttcctttttaaggctgattagtattccattatatgtatatgccacattttctttattcgtctgtcaagggcacttgtgttgcttccacccgttggcctttgtgaatagtgctgctgtgggcatgggtgcacagatgtctgttgggatccctgctttcagttcttttgggtatatatgcagaagtggagtgtcacaggattttttgcacttcacaaagtgtttggttatcgtaatggaagatagttatcctatgaaagatttaaactttcttaatgaaagtttccttttcttctttctttttttttttttttttttttga

SEQ ID NO: 39901 - DNA, 1032 bp, Homo sapiens
ttaatattatgttcaatcactattcaacaggcttttttctttttgttttttaaattaacattgccttatgtttagatgtgctgacatattaactgccttctttttttcctctatgtcaaaatttctttatatgagtttagtttttagatatttctcaagattcttttgtaacatagcagccaatttaaatcactataaccatagaaatgagaattgtcttactgagaaaattccatcaacatcatttatatactgaaatcaaaatgttggaaacaaggggatgcttttggtttttgtgttcttaagagttttctgttggcaaaaaacgtccttcctgccttccaaatgtgttatacatgggaagaattgtggtgtgtgtgtgtgtgtgtgtgtgtgtgtgtgtgtgtgtgtgtgtctgtgtgtgtttaagcttagagattaagaatagcaaatgctgacctgaatcctgggtctgatctattttaacacatagattgtgttgaacggccatgaatccatagcaggtagaacgcttttaaaactttttaaatgtgtgattatttatgttgaataacaagcataccaggttatcaaggttgggaagtttttgattaattcaaaccttttatctgttgatatttaccagtctgtcaaagatgaccaattttcaaagcagttagaatatactataaaatgttttaataattcagaaatctcttaaatctttgaataccttaggttatcattgtgattagctttgttatactgttggagtctgagagtttcgattaatagaaatttatggttaacattgattttgcatctcttcagcatttgttgccatattcactttctcacatctcactttgcttgtatgtattttttcttctctaaaatttttatttgccagagttttgtctattagctttgaatacaaatataattttatattgtttatgggaaaattaaatgcagatggcttgaaaacttctgtatgttgtctctgaaaatggagaggatgagaacccactc

SEQ ID NO: 39902 - DNA, 1039 bp, Homo sapiens
acaaagagcacaatgacagtatattccacaagagtaaagcaaaataagtaaaattatctcaagtaaactaaataagaaggctttccatgaactgggcaattgttggaactaagcagacttggagtggctgattctaatatgtgcctagaattacaatattgatccagatttttacattacctatccctcttgtttcttctgagcttgcatccagaggtcactggttggttcacaggaataagctgggtcagtctaaattgcagggaaaaactcaaaaacaacagacaaggctaggttctagtaacaggtgtactatagttattgaaacatagtttttctctctccagtctcccatttttactaaagacaaagcatgataggcttgatttgtttgcaaaataaactttagtcttattatacctggcctgattatttgtataaagtgcagcaagaataatttttgctgtataggctctttttaagttggctttgatggaactttcttccgtaaggaatcttagagtagacttcttattaaaggtttgagcccagccaggggtttgtgcttgcaaatacctgtgtgagttggataaattgtttccttctttcagggtcccaagataacctgggcctcctgagcctgtcagaaagtgacattctttacttaccacaggtcaagaaccctatgcagggactgtgtagacaaggcatgaggccagttttcccaaggagcttttattggctctgtaagtcaactttgattccttaaagaagcctgtttatatttgaaagcatgccatttcagtcaaagccttggtaaaataaccagtttctccaactgggccctgttacaaaagaaaacagattcttactgtacttatgcaaataattatattgccataaattacaaatacaaataatttccaaattctggagaaatcagatagagagaaagaaatatgcttcaaattttgtttacaggagtacactttacccaattggtgcaaaagtagttgcaatttcagaccatgaattttaa

SEQ ID NO: 39903 - DNA, 1084 bp, Homo sapiens
tatgatgaggcatgcctgaccccctcttcccatggtggcctaaactggcctttcaggtttctttggaatccccttggttgagaaggtggatccattcaatcatttggggggcttagaattttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgaagaattttatgtttgtttttcagtcttggctttagagcctgtgatctttctactgcatgaggctgcctcttagtaaagaagcaaaatgcttgcagagtactctgtatttctcctctgaatgtttaatatgctgaacacttcacaataagtgctaacacgaactacatggtcacatgagatttttgttttcaaacagttttattgaggtataatctacaagccataaattttcccattctaagtgtaccattcagtgatttttaggaaatttaaggagttgtgctctcatcaccataatccagttttagaatatttcatcaccccaaaaagattcctttctgcctagtttcagtcaatcccagctcccaaccccagccccagataagcataaccagctttgtctctatagatttgccttttctagacatttcatataaatgtccagaatcctatgttacgtatagtcttttgtatttggcttctttcacttagcataatattttctaggttcatccatattatagactatatcagtacttcattgttttttatttctggtggtacccatcgtatggatatattacattttatttatccattccccagttaatggacatttggattgttttcagtttggggctatttaaaaaagtactactgtaaacattcctgtgcaag

SEQ ID NO: 39904 - DNA, 1050 bp, Homo sapiens
tacagagaaggggtgagagggagggagaagggaagagtgaggtgggcggacaccttcatggagttttgtctagtgagaagagggagtttacaagcaataatcagcattattacagggacataatttaccaaggagtatagaaagggcagggactacctgacgtggtgactattaagtctgagactaaaggacaaaaaggagagaaccaatatgagtaacgagtgggcacgaaatttctatgcagaagaaactatgtgttcagaggttctcaggaagtacagagcttggcaggtgtgagaaaactgaaagaaggcctctgtggctggaatgtggcgagactggagaagttagcagaagccggtgtgaccctaacaggtctgttgcttaaggcctggcatgtcactacactgacaccaaggctttccgtggagaaggagtttagtaattatagagcagctgaaagaggagatgggaggaaaccgcacatcgcctccctgaggagtttgggtctagagattttaaggggtttggagtgggctgatgtctggggatcattgattggttgaagagtgcagggtgaggtcataggacgggagatagaactgcattctcacgctgatttcgttcctgtcggggcgggcgggggggggtcttaactggctgacttcagctgtaccactgtaattcagggtctgaagcacatcttaagcaattctttaaaaagtttatgattctaatgtcagcgatcctgtctataggaacagtggggatgcaaatgattcttaaacaaaaacgttatgattctaaggtcagatatcctatctagaggaacagtggggaggcagatggtcagtgtctagtgctatatgacttttggttacaaggaagtgggtcaaagtgcagcctgattacagtttaattataactatatttctgcccagaacttggcatgtaattcttgttagcctgtgaggatggtttcaccagatctcaaagggctttgtaaggggaaaaaagtacagttgactcttgaacaacacaggggttgag

SEQ ID NO: 39905 - DNA, 1014 bp, Homo sapiens
ccagtgaagtgaaaataaattgtacagtttatgaacatcatattttacattaaaagagtctgttaattctatatatgcagctctagcccatttatctgttttccagtgcaataatttaaaagcagcaagtagaggggaggagactgctagaattaaatagctggcagaagcagtgagtgagagctgacatccaggtgaccaatggtagagaaagaaaatttaggaaaggtagacataagagcccaaacaaacacaaaactaccatagattggtttcaggttaatagatgaagatgcatttctagctcagaagtatcaggggagagtactgttttgctgcaaaatgtagtcaatgatattcttaatactgatcctgagtcatcacaaaatgttaaatgagatatacaaaatcctctttaatgaaagaagtttgtaatatattttaaaaagctttttctcaactaaaatttcaaatactgtggatgcttaaagagatttgaaggcctgggtagcatctacttaatgaagtgtgctgcttagatatctttgttacctatcgatttctcctatgtggaacattactttttctaaagatgccagataaattatgtttttgtggtctgatcacatttaggaatcttggtttctaaaaaaggggcttggggtaagtaagaatatgaaaataaggcctggcgtggtagcacacacctataatcccagctctatggggaggctgaggtgggaagatcacttgaggccaggagatagagaccagactgggcaacatagtgagaccaaaataaaagtgaaacaaatagctgggcatggtggcacatacctgtcatccttgttacccaggaggctgaggtgggaagattgcttgagcccaagagtttgaggttacagtaagctacaatcgcaccactatactctagcctgggcaacagagtgagaccatctcttaaaaaaaaatttgctacagattttccgtttgtagtatctaacatatagtaaa

SEQ ID NO: 39906 - DNA, 1027 bp, Homo sapiens
caagaaggtgaagcattttcagagaatgattcctgacactacagaaacattgaccatttagaatcagaagaccctcagtcaaggctggcctcacaggaaaatcaaatgtaatgattcccataatgagttcaagccagacaactgaattatgcatctgacattaaaacaactgggggattgtaggaggaggagaagtttgggaagagagaggacagtgtaatcttctgggagtaaaatttattactgaacattaaaaaaagatctgcaagttaagttgagagtcattttgtttatactcgaaatgctacaatgtcctttgatttgtttatgcaagttttaggggacaagttacgtttttttagcatataatctacatttattcccaaaacactgctcctgagacaatccatcagatatttcctcaaggctgtggaaaaggggataaaaggcatatttttaaaggtgggcgtgtatgtgcaaaacatgtttgttttaaagagatctgaatgctgtagaaataattagccatgtgcgtgaacgaaaataatgaataccaaatggtacaatgtcctgcttgaatcctgtttcagaaacagaatgtgaaggaaacattacgttctctcatccctctcttttctctttcacccttgttacccctgaattttgtaataatcactattacccttttggctatgaatttaatgtctctatatatagagccacacccctaacacagattcttcttgcctctcagagacagttaaatgtctttgggtattgcactacttattctccataggggctcagacatattcactattgagcattttcattagctaaaataaattaaatgtatgtcgtaaatgtgcagcaacactgaagaagctgcgagctacatcttgtccttgggagtcatttacttagaataagtaaagactttctcacttgctagtttcaggcgtcttaccttgtgttattccttacaaatggacagggctgttctagaacccacttcctgaatacaggg

SEQ ID NO: 39907 - DNA, 1044 bp, Homo sapiens
gagaacagactaatagctgatttcagcaagcatctttaggcttttgttttcaaattattttacatctttttcttttcttttcttttcttttttttttttttttttttgacacagaggtctcactctgtcacccaggctggagtgccgtggtgtgatctcagctcactgcaacctccgcctcccaggttcaagcaattctcctgcctcagcctcccaagtagctgaaactacaggcatgtgctactacacacggctaatttttgtatttttggtagagacgtggtttcagcatgttggccaggatggtctcaaactcctggcctcaagtgatccgcctgcattggcctcccaaagagctgggattacaggcgtgagccactgtgcctggccacccacctattttccatctttagcactggccgttctcattcaaaatacgtactgctacactaagaggagacttaacttcaaattcactttgctccacggatgttgtatatgacctgaatagatgtaattctgacaagcttgtagttcattggaggctcacaatttgaaagaaatgcatgattaagactttagaacataaagaagattctagtaaaacaaatgattgcacccttttggattttttgcatattatctttatgtagggaagggaatgatatgttagaaagaatcctcaaacaggtttagacaaatcactggttgaaccataatctccaaaatatcgctacatcagaaaaagcccaacatagcctctgaggtattcgtcagaaatcccagtgcaagcattaggaaagaaatgtactccctgctcctcacctttgtaagtcagatttagtcttcactgttcatttcaggttctctgcctccataggggtcccttcagcacttgtttggttctctaattggcttatgatagtgggtcttacatcatcaactggattgtaaattccttcagaaagagatgtcaattaagtacacagcagagtcacagtatttcaaaattggaagtcatagtaagggggaaggagggccgct

SEQ ID NO: 39908 - DNA, 1038 bp, Homo sapiens
tgatgcgaaggatgtaaaagtgctccaaggggttaaaaggactttatataataaattcctacaaactgctataggcacagccatagctctgaaactagcattctcgtaaggctagtccaatccataagtttcgtttgcttcaagcagctcagatagacactctctgaagataaatgatgcataaaaacaccattgtttgtgatcagaataatcaggtaccactaaatagtcctgcatgtgtatgcatgataccagcagcctccaacttgcttctccaggagcactgtacttaacttggaaacccctttatttaatttctgtccactcacaaagcttcaccttgtcttctctcctctctgtcctcccgaggttaatccttgagagcctgtaatcaaggctaggccctgcccaccttaagtcaccctcccctctctctaggcctccacctcactggggagcgtcattgcagccagtggcaagaagctgcaaaattctctcatctgtgaagagagcccctaaaaccccaaatcccggaccagtagaggaaaccattgctgccctaatatcacatgttacaagtcttcgagcccatggtatctgagatgttaggagctagcattccttgtaattaaacccctggaacatcacaaggacccagttcagggggcttggttggttgactgattgatgacagcatctcaattatgtaggagatttctgtaaagaggagtgactggaaggaaaagaagataaccttcatttatatcatgagaccttgcgtagtagaaggccgtgaggatgggaacaaagtgaaatcatgaaaaacagcctgatgcaaaatgacaaagaagaatttcagggtcgttgagatcacacttgaacaataactgaacagagccagcactacagttttcagacctgatggctaacaagtgaaatgtattcagagagaggtgtgtgattataaagactccccctacccctggtgctctattccactgactgtccctttatgaaaaatgaattctagagttccct

SEQ ID NO: 39909 - DNA, 1047 bp, Homo sapiens
atagattatccaccatttccatcactctctggataccctcacatgtttaccaccaaaactcctgcgcagagactggtcctcttttgcaaactgcctttggctcccccgcgatctctcatcagaaaagcaggctaaggaatctgcttttgcccccatcctgttagaatgataaatagtagcctgatggccaagttgtatatttatttaatacatcgtctgtattgatagtttatgatgtcctggatatgaatacacgaaagcacagttgcatagtggcgaagaaggattttgatatcgtggagatctggatttgaactcaactctggcagttctccctgccttagtttcttgcccgtaaatgggggtgatgaggtagttgtgagaattaaatgagagactatgcaaattgttataatactccctggaaaatagttaaatacccaatagatagcatcactattttgaaatgctttcaaaattatactcgagttttacttctgcaaaatcaaggcagctttcttcagaaaagagagaaatgaacttcacccctaaaatgtacttggagaattttagagggtcttttccaagttgttataaagcacttctgaagtgaatttgcccatttctgcccacaccaatcttataacattccaggaataaaatctgcactcgagtttaaaaataaaacgggtggaacaaactgaattagaagtccttggcagacatcccccccagcagaatgttctctcaattggtggtattgcaataaaagagatgtatattttttagtctgctcttcctccctgataatttcagccagttgtatttctctattctaaaaacctggtatgcttggatttaatctcaccactcctatctacgctcctgctcctacccccacacccatttcccccaaaaaaaccccacatctgcacagaccctccttcccaagaaaacatggaggcgggctgctctctgataccgtacatgtgcattccggactgtgctgaggaaggtcatagaaacatgagagggctctgctgttgt

SEQ ID NO: 39910 - DNA, 1086 bp, Homo sapiens
gttaaggggaacctgggccctaacagtccacttcctgtaccttcaaccacggctctaccgcctccgctaggagatggcccgaggacattccttagctggcttcagcttgctctttttcccctgcggtccacccctgtctcctgcttggtcatcagtgatttccatgccatcccatgtcattggaccagttgtgtgtttttaataggagttctcatctcactttctccacagctttgccaattctgctctccccctcctgtctaaataccttcctcccttggcttcctgaacaccactgtcttcgggtgccatcatccctttctggcccctccttcctaagtcttcaggtgttccctttctacctgctttctacgcctctaagtgttggagttcctcatggcttagtctctagaccactttgcttctccacttaagtgttctgctagatgatctcatccaaactcacagtgccttgatggatccatgactcctgcatccatgtttctaggccagacctctcatcatcttcgggcctgtgtctccagctacctactctgcacctcctttggggtatcacaatgtcacctgaactcagcacgttcaaagtcaaagttataacaatcaccatcccaccaaacctcatctacccaagaattccccatctcagccattggcatcatctagttacccaagacagatgcctaaaagtcctccttgaagcatttctgtccctcttcctctgcatctaatgtgtcaccaagtcctactgatgcaatctcctcagtgtctttcgaatgcactctctctcttccggcccactatcaccattctagtcctaaaacctaccttctttctaggagccacagcttctctggagtttttacacctcttccaactgttcccatcaccccgttcttttctttgacaacattttttacatataaaaataggtatttatgtgattatatcatgaatgtcttttctccccaactaagaagcactatgagagcagggagcttcctgtttctccccgttcaatcctcagctcctagcagcacagtgcctggtgtatagcagattctccat

SEQ ID NO: 39911 - DNA, 1056 bp, Homo sapiens
tcagaacaatgtgaccagaaaagaggttggaggcccttcaaggtagagcagaaaagacagaggctcaggtcatcagcaatatccgtatgaatctggtgggagaactccaccagtgttcctcacctcgctcctttgtgggatcctgccagactccaatgtccttgggttctaaataaacacctaccaaggggctgagtcaaagagattccagtctctggaagtgtcttcttgtcattgtcatcacccagccaaagactcttttccttccaacatgtttttccctttgacctcaaaataaacaatgtgttctaaaggctctggggcactctcaaaatgcttctctgacctcggataggaccatgcttacccattaatttccagatctgaccttttcactacacctttaagcataactctttcaaaaggcaaaaatagaaatgactgtttcatttcaccaaattcaagtcgccaagagtgagaacgtgtggttttcaccggtacgtttggggaccagtttgttgtcactgaaactgcctgatatcgggtcggagtggctgggtatttttcagtccttggggttataactcaaatgttggaagtggtatcttttataggtaaaattgagggaggggagcatcaaaatgtgtgcgatgcagataataatttgccaagttttctaatttttttcattaaaaaagaacatacagaagagtctacaagtagggcaggcagccttcattcctatgctcttttccttgagggacaccttccctaaccaaataattgaaaataaatgggaattgtgggaacagaggaagacaagaaggaaaactaaaaacccaggacctaatcttccaggggcaggcaggccacttttgtagctcagattctgaccttttctccaatcaaagagttcgaacagactgactgattggagtgctctgtcagcattaaactcaatgcagggttctgctctggcacctttaggggtggtggtttagaccctctgcgtgccatgtcttatcaccagcactgctaactgaatgggatgcattt

SEQ ID NO: 39912 - DNA, 1050 bp, Homo sapiens
cggcttcccaaaatgctgggattataggcatcagccactacgcctggcacattttggatctttatatgtaaaagttgaagcaagaacttgggatgcctaaagaatgatgcctcccagcattagtaagggcagtgtttccaactgaactttgtacagaaaaacccaaacaaaactaaagatgtattttttaggtggtataaattcgaagtgctcaatgttcaagaatccacaataaagaagggcagggatgactgaatagtgataagaactagttgacattgtttagtcatagaacccaaacaaaatctattggttcttaacaacacataaattactccttaggactaatgtaaacagacaaatagaaaggtaacttcattttttaattatctaaatttttcacttttgtaaaagaatcatattataccataaaaatattaaccatgtctccaacttaaattcatgttaaatttccagtggtagctatgtaataaattattgctaagtagaattgtagactgaaagaattaatccatcttctataaatcctgaagattatgttaaccttttccagacacctaaacaagtatgttacatgattcagaaaaagtcatttttgacaagtataaaatgattttgaggtgtgatagcaaattagctgtttcaaacctatgttagagaaattaagttttcagagcaatttttttttgtatttgtgcttatattcctgaaacaacttgcttaaggagagtctccttaaatggaaacataaatggtatacaaatggctatcctctatcataatcttttatttccaaaactcagacaggtttttatcatcatgctctttggactcttaaccatcttcttctacttttaaattctacttctttctcaatacatttttaaacagcatcttgtgatcatttcccagtcttgagtgcctggcactgggaggtgacctgcccacattgctgtcagaattcgctgctggacccctgcacaggtcccaggctgttggttacgtgtttcaatctgcacatcagccatc

SEQ ID NO: 39913 - DNA, 1022 bp, Homo sapiens
aaagcatgctggggccagattgtgaagatcttcagcatcaaataaagaatttcgaagatgttcagtaagctgtaggaaccaatgaaggtatggatggcacggggaagttgtgttatatctactttaggaagttcgatccaacagggatgactcaaatggtttagagagagaaagcattgacaagaagaccaatgagcaggctgctgtgagaggaattcagtctgagctagcatggggcggtgaagatagaaagggtgcagaattggtaggacttggaaaccgatggaatgtgggagaaagagtagaagatgatgatgctgtcagcttccatcagaaattaaagaggaggagctgggtttggagcaagggactgggaaagtttgaaataaacataatttgtttccactgcatatatccaggagtttgtagggggagataccagggaccaggatacagatttaagaacgataaacagtagaaggaaatcattatagaaagtgaatagaactgagcagatagccttaggaaatctgtcccctagagttagaaagaacagagagagcaaaaaactgcagaggggccataaggagtaatataaggaacccaagaaagtaccatctcagagaaattaagaatatttgtttattttggttacaatagacaaattaaactcaaagtgattcaagcaaaaaaaaaaagaaatgtattgtattatatgtggattggttttctattgctgtatgacaaactacaaatatagtgacttaaacaacacctatttatttttttttgtgtgtgcatcttttctttttttattttttatgttattattattatactttaggttttagggtacatgtgcacaatgtgcaggttagttacatatgtatacatgtgccatgctggtgtgctgcacccattaactcgtcatctagcattaggtatatctcctaatgctatccctccccgctccccccaccccactacagtccccagagtgtgatgttccccttcctgtgtcc

SEQ ID NO: 39914 - DNA, 1050 bp, Homo sapiens
cctgaagttaaaacattttggaaaatgttttcaaatatggaatacaaacatgaggtgatattattgctaccatattgcttatagtcaagaaaaaaacttaatcctttttgataatctaatacagactgtgtcatactatatgttgcaaaaaatgtatagaacttgacattcgaagagatgagtattttggctctgtggtttattagctgtgtgtccatggctgacttacctaacctttttgagcttcagtttcttttctataaattgggaataattatgttactatttattagggttgttaagtaattatattctgcaactattatgcatgaaaggcacttttaaaactacagaagagcatagtcaacagtaaccatcatggtctcacttatggcctaataattatgcctactgtagaaatagatcaaaatgtatttggattcccttttctaggataccctctcagattgtcccaaatatacaagggatgaaagaagaaggaacaagtgtgggctgaatatgcagaagaggatggaaagttgacaggagcatgtggttggaagaggccatgttgacatgcagattgtgtgatagccacattgccagagctgagagggtgcaggagggaaggcaagagggaagccttggtatccatgtaaaaccagtgaccacttgctagggtgtgtccataagcattgcatgcctattctttttttttttttttttttgtattttatttatttattttactttaagttctggggtacatatgtagaacatgcaggtctgttgcataggtatacatgtgttctggtggtttgctgcacctattaacctgtcatctaggttccctcccctccccaccccagtccccaacagaccccggtgtgtgttgttccccttcctgtgtccatgtgttctcatttttcaactcccacttatgagtgagaatggcatgcctattcctttttttttttttttttttttgagacagagtttcgctcttgttgcccaggctggagtgcaatggtgcgatctcggctcaccaca

SEQ ID NO: 39915 - DNA, 1050 bp, Homo sapiens
agacttagggagtccatctttctctgatgatattccttatttgctcttcattattccctgtgaaggaataaaaacgatgaaattggatttgaagactggattaagacaaatgacttttcagatttttttttttttaccttagctgtttccaattttcctagaaaagcacatagtcactatataaagagtctgagtttattgcattaaatcttcctaaatagtgtgcccttgaggtttgatgtggggaattagtttagaagattcaggggcttggagtacctgctaactgtgtgatggcgtgtgtctctagaaattttatatgcccattgatttttatagagcaagcagtacaatagaagggaagcaggatgctgcttggtcttaaggaagtctttcctgcctaccaattgccacacccctttttctccaggtagagttgactatgttttcttctgggccattgctgtacttgcctaatacttttaataaggacttgcaaatgtgcctgtaggtctcttctaactaggctgtaaaccactcggacagaggaattgttttatttcttgtaactctaacacctaacacaaggccctcaagataacctgtcaaatgaatgaacagatgagctgaatacccgctgtgtgcctgttcttgtcttaagacatgagggacaacctgtaacacaggacacaatgtggctgtgtctgctctgaaatggtagaatatctagctacagcttagaataactgggtaaggaaataaatgctggattataacccaaagaataaaatatccaacgagtccaatgaataaataaataagggaaaaggaatgactcttccctgcagcagaatttcagttaataaacaaacgaggaaggaagcagtatgaaaacatcattagaactcatagtaagaattgccacgagaaagtcccaccgatggatgcattagatgggcagatgtggattagatggattagaatgagcgggcaaaagtatatgcagaaacaggaaattcgtagaattttaaaatatccctaccccaaaca

SEQ ID NO: 39916 - DNA, 1037 bp, Homo sapiens
acaccaccacgtccagctagttttttgtatttttagtagagacagggtttcatcatgttggccaggatggtctcgaactcctgacctcaggggatccacccacttcagcctcccaaagtgcagggattacaggcatgagccaccttgcctggccgaaatatatatatttttaaaaaggttattttcatcccagcactttgaaaggccaaggtgggcagatcacaaagtcaggagttagagaccagccttgcaaacatggtgaaaccccatctctactaaaaaatacaaaaacaattagctgggctggtggcgagtgcctgtaatcccagctacgcgggaggctgaggcaggagaattgcttgaacctgggaggcgaaggttgcagtgagccgagattgcaccactatgctccagcctgggtgacagagcatgactctgcctcagggggaggcggggagaaggttactttcaaccccatgaaaaagtgagcaaaggacatgaacagacacttttcaaaagaagacatatggccaataagaatatgaaaagcagctcaatatcgctggtcattagagcaacgcaaatcaaaagcacaatgagatactatctcataccagtcagaatggctgttgttaaaaagtcaaaaaataaccagttggatgctgatgaggttgcggagaaagggaacacttatacactgttggtgagtgtacaaattagttcagccattgtggaaggcagtgtggcaattctgcaaagagctaaaagcagaactaccattcgacccagcaatcccattactgggtatctacccagaggaatataaatcattctaccataaatttagacacatgcacgcaaatgttcattgcagcactattcacagtagcaaagacacagaatcaacctaaatgcccatcaatgacagattggacaaaaaaaatgtggtacatattaccatggaatactatgcagccataaaaaaggaatgagatcatgtcttttgcaggagtatggaaggagctggaggccattat

SEQ ID NO: 39917 - DNA, 1051 bp, Homo sapiens
cacagtggtacctagcatttagctcatgtgttcatttagcaggctctaagtcatcttgtcacatgtcatcctcatgtcagctctgtgtggtgttgtcgacccacgagcaaacgttgcaaggtcccctttagggtgacaaggctgattcaggatgtgtctcactgccccaggaaggatgcctctaacatgcggaacatggtgccagtggctgaggggattagttggggaagaagagtgaatagggaaaggaggttgttacatgatccacccctcactggccagagaggaaaaggaaggcatctcattaagagcattagctgtagcctctcatttaaacctcctcactaccccatgaagtaagcattattgcttttgttttacaggtggtgtgagacaaaagtgaaggaatgagactaattaataataagaatccatgccccaccatagctacgatgcagtggagcatggattctaaaccagctctaacatcacatgccctattttcgagcactagtggcttatttctgagctcttctcttcctctttcctgttgatgcttgagttttagttatatcatggcaaattgaaaaattcttcaaaaaacatacagaggaaataaagtggtgggatctgaaacaaaactcttattgattagccattctaatgaagatttgtggctgagatgggagttttgcaatcaccttgggatttcagaaccctgcttttaataattagaactaaagaagggagagtcctatagaagtgtgggtcataaaaccaaggatgtgaatgaggagtggcaagacaggtatcctggagactttatttcagtgagacttctggggcagagttgggactgatgggggacaagtcagctttggaatgatacagaatttttggctgtgacacctgtgtgattttagtgctttgcaccatatcaagagctgagcagagtgtggcaccaatattcaagggactcaaggggcaaatataggtgtcagtgagtgaaagcagatagcgagatttgcaatgcagtgtccaggagtgtcca

SEQ ID NO: 39918 - DNA, 1030 bp, Homo sapiens
gagaccccaagagacagatatcgcattagtccttttttgtttgtttagcaggaaggtttttaagtaaagctcctaaatgatatgtctcattctcatggaaattcatcaatattgttttactgtctcctatctggttactttttattttaggtaaccactgtgatacaatatacacaagtccctggatcatgaaaataaattgaagagctaatgttaatagtaagttctcaaccaggggttatgctggaacccaggatacataacccacaggagggccctccgtgaactcagttttcatggaattgtcccataccttcacaggtagaagcatggctatgttaaaagtggccaatgaaagtatagtttctttatgccttatactttgtttggtgaggatttctgccagaggtgtttgtttcctttagttttctggttgctatgattttatacagctttggtgacctctatgagtaccagataaagttaggtatgataaaggcacaaaaagaccgtagaagccatttgtattctaaatataaatatacagactaaatttgtatgcatttgtgtcttcattcttcacggtgctgtatcctccgtgtgtgtgtgtgtgtgtgtgtgtgtgtgtgtgtgtgtatttcttctttgattccaggctgcttatacgaaaatgctgattcatagtgtcactgtcttttctttttcctgcgaaattctaaatccgtttctaaactttttctacaactctgagtttaatctctctaaagtttttttttttccctcttgcggacacaaggcactttgctttgtttatgctaataaatgtcagactagcccccaaaaattagaagaaatgccagtaatttcaaagggctcttgagcatgattttttttcctgtttcttaatacattgtacttttcagagtttaagtttaggtgcatgtaggtggtattagaagattcttagattttattggtagcatccagacaatcttgtcatcacccgatatatatcacctctatgtggtag

SEQ ID NO: 39919 - DNA, 1033 bp, Homo sapiens
agacctctgcctgtatgggaggtctgggctcgttctgactaaggttttgaacccagatctgccaatttgagatcttgggcccattacttagcctgagcttcagtttccacatctctaaagtgaaaatatagaacatggaatgtacctgtaagaacacaatggaatacaggtaaagtgcccagcacactgcttattccttagccttcatgttttagaaagtggttgctattgtttttgttgttggtggtggcggtagtggtcttcttcttattattatttatatatttacaatggccaaaattatatgaaatgttttccaaaaattaggtatttgtacccttcatatgaatgtgtgtgttaattgggtataattgtctttcttgagtctttaaaatagacaaatcttttgattacatttgttaatattattgtacctacctatatctgacttgacttacaattttacttcattaaatacatagcaagtcatctgagaacccaaagtaatcatacagattacttgccatatagttaatttgtgactgtgatatggctgctaaggtagaggtttgaatttaaaagcacaaagaaaaatgtttacttcaatggttacaaatagattaatcatataaagtacatatttgcagagtctcgctcagtcgcccaggctggagtgcagtggcatgatctcggctcactgcaacctccgcctcccaggttcaagcaattctactgtctcagcctcctgagtagctgggactacaggtgcgtgccaccacgcccggtgtatttttagtagagatgaggtttcaccatattggccaggctggtctcgaactcctgatgtcaggtgatctgcccgcctcggcctcccaaagtgctgggattacaggcttgagccaccacacccggcctattctaaggcttgttctaaggctcacagatggcaccttctctgtgtatcctcacatggtggaagaggcaaagcagttcctgggggagttctttgataaaggtgctaattccattcaag

SEQ ID NO: 39920 - DNA, 1033 bp, Homo sapiens
aaatcctgtctttactaaaatacaaaaattagcacacgcctgtggtccccgctactcaggaggctgaggcaggagaattgcttgaacctgggaggtcgaggctgcagtgagctgagattgcaccactacactccagcctgagcgacagagtgagactccatctcaaaaaagtatacatatatttttcacgaaagtacacaaaaatgcacaccagccagatcactgtttgttttctctcctttttctcttcttttttccctactttttcatctctcatccttcttccttcttttctcgcaccatcatggagaacaaagaagaactgggtcagaacaaacctttaaaaagtgaaggcgagcgttccttgcggggatgcccagtgtcatgactagtgttgggaattcttggtgagatgacaatatttttgcctcactcaaatgaggcatgcccttccaagtaaagcatgctatgttttgtagcaaacagaacacctgagaaggatgatttcatatgactgtgccaacagatctctcacaagcttgtcaggttataattcacaaatcttaactctatagtctatagacattttttttttatatggggtctcactctgtcggttgcctaggctggagtgcagtggtgagatcttggctcactgcaatctccgcctcttgggttcaagcgattctcctgcgtcagcctccggagtggctggggtttcaccatgttggccaggctggttttgaactcctgaccacaagaaatccacctaccttggcctcccaaagtgctgagattacaggcatgagccactccacccagccagtggttctttttcatttgagatggagttttgctcttgttgcccaggctggagtgcaatggcacgatcttggctcactgtaacctctccctcccggattcaagtgattctcctgcctcagcctcccaagtagctgggattacaggcatatgccaccacacccagctaattttgtatttttagtcaagatggggtttctccatgttggtc

SEQ ID NO: 39921 - DNA, 1161 bp, Homo sapiens
catgttgccctgtattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgtgatgcttatgttacaaattggatgtgattccatctattaatatggactgtgatgtatataattgtggtgtgtataattgtggtcaggaaccagcatggggtcctgtgaaccacagtggtggaaaaagctatggcacctgtttgttccactggctttgtgctttgtccatcacacagtgagtgaaaaggtgacaaaaatgtgtaagaagcctgtgctaaggagaaagaaaggtccaatgatgaattttctggaaagaaagctgtacgtaatagagtgctgaattcgctcaatcatatttaagttttatagtactgcacttataaccacacaaaacactattattattgaaattcaatacaggaaaaatgcttttgtttttgaacgtctaagactgtcttcctcctcattgaaaaaattcctactgaatttcgattatatgaagatttttagaaatgcagctattgcatcgaatgaataaatgaatttgaggttcacgttcttaacatctgttttctgactttgatcagtctcctttaagtgctctcgtggtcatactctgcaactcaggtgaaagtttctagtgagatagttatcccaaggagatacttttatctggaagagagtagttctgaagttctaagtgaggttggttggttagatttaggttaaggtaccacatggaaaggagaactgcttaaaggggtagggtgaccatgaaaccttcttctgcaaaccctgctcgtcaagtatgaaaccggtggggtaggaggtccatctaatcttatctgtgcccttttg

SEQ ID NO: 39922 - DNA, 1041 bp, Homo sapiens
agaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcctgtctccaaaacacaaggaggttgaaagaaatgatctctcgggactcttctatctctgacattgtacagttccatgaatagattttattgtaattcttgctcccggctcccccaagacctttgcttctgtcaaacatcatttgctgttgtttgactttgttagattttgtatttaattagaatttatattttagctattattatgtcattatttatagagtaagtcataagcggtgcctaaattcatttatcaccccatctatattagtttcatacctgaatacttcctccgctcctttttactgttcttgctaccatgtcccaaacaacatccatttctggaggtggaatgcagtataactggaaagaatctttcagctgattgtgggattattttttgcaagaggagtgcagaagctctgcttttctaagcagtaatatcaagggccatattctgcttttaatttgcaagtagaaatcgttttgatgtcatttggttttacctgcaggtgcaggttttagtctctaggtaattccttttctcttctgcgtcaactttcccaattagtgtgtgcagcattgccttgtctttttggttaattcataagcagttcatacagatgcctcttgattcattgcaattattaatagtttctttaggcagctagtgcaaatagaaaaggtgacatttgagagggtttgttgttttaatttatttgtttcatagacagagagggagggtgaaaatgaaggctttaaagtcagggagattgaggcttgaatccttctggctctggctcctggctttgtggtccaggtcacattccttaaatctgtgatcctcaatttcctcatctgttgaatgg

SEQ ID NO: 39923 - DNA, 1028 bp, Homo sapiens
cagaatgtttcctgctggaatcattgatctgtctaggcactgatgctccacaggtttgggaacccctgggtcggccggtcttccagcaactcttcctaagttatgttctgtagacttagttggtgagaagctcattctacttttagcaaatctcccatttgaaaatttgaattttcaaaactcatttttcaagaggtagatggatatttgctttataacaggttcatttaaacaataattgaccagatttctttgaagaaagagctgcctctttaccgtaagagccaatttttaagttacatataaattctctggcatcttagataagagcatggagctccgtaatcaacccatctggacttaagatctggagctgccactatgaccttgagtagtcctatgtcctttcaatgcctcagtttattcatgtataagatggaggtaatattagaactttcttatagggctgctgtgaggatggactggagtaaaatagtagatatactgtgggtagaatagtacctggtgtatggtttgtatcttttaacagatgctatcaagtaacttatccctcaacaggttgattgttatggtcatgttttatgatggttgctcctgaaccatacatgactagaaatatgtaaatatacctggaccttggtctttggacccaccctgtagacatctacggctctgcaaagccaaggagccttttatttgtttttgctgaattttaaattctgaatttatcacaactctctgactgatgggatgcatgtgtggtttttttttttttagattgttgtaaaatgaactgatgaattgcatgcataaatgtggttatttgtggtctgagtaaaaataaacaaaaacctgagtgactgaagtattatgcctcaggaaaaacagccaaaaaagtcccagtgggggacaaggtggaggagggaagagtcatcacagacacgatactcttgtaaaatatggaactggattccttacattttattggctgtggattagagaggtgt

SEQ ID NO: 39924 - DNA, 1053 bp, Homo sapiens
acaagaattccttcttttgcatatcagtcctcggcaggcaatcaatgcttaaataaatgcttggtgaatggattagttagaagtaagaacattttggctactgttcattactttgaaaagtgctggaaagaagtggaagttattttcctttccagctgggctgtgctcttaaaaatagtgagtgtgtatggatgaaaataatcatgagtaccgagatgtgttgccatgtacccaaggataattggctcacttacctgtttacggattattcacattggagatcatattcatagctccagaatagtttctttctgacatccaatataaacctgggcctccttcttcctactgttacctggcgtgagcttaggaaacccaaactaagtttaaaatcagcctaagcaaatgtgcagatcagctccagtaatcaaagactgaaaatcagtccagcattcactagtttggggatgattttatagtaaccctgctactgattttaaaaaaatttttttttctgtttaatgtggataattggtaattaccggtatttaagaatataattttaatggatagggctaaaaaaatacgttagcagatcgagtcctcaacttcttccgtttctatgcataggttttacctcacaaaaactactacaagcaccaagctccctgatggaaaggtatatggaagattcattcattctttctttcattcatccattcacacattcactcattcatcatacaatggaaaatttttacttaaccatgtgcaaggaattgtggcaaaatgaaaatgagatgtacattcagtatttaaataaagtttagtggaaagtttagtgaatataaatgcacactttacactttttttctgcattttttcctttcttctattccattggactggtatgctaatagctgtgcactttcatcattgtgtttcaagttgcatgttgatagataatatatgccacattaaaattaggctttggctcaattactattcaatccatgcccattttcacctgatactccttgtagttaccagcat

SEQ ID NO: 39925 - DNA, 1245 bp, Homo sapiens
caaggttatcagaagcaggccctccttattttgataaaagcattgaaagcaatacattgtagaaatggtaatagaaataataatttctgttttaggaccttacatatagaacttccttttctaagataagaattttaagtcatcaattatgttcacattttattttcatgtaatttagtttaataaaataaatgtactcattcaaaatttttttaagaagtgatatacagtgtcagttttacagaattttttaaatgttggctgaaagaacggtaattacattgagatttttaaaaatatataaatgcttaaaattacagaagtaataaaaagaatggttttagacaaatcttatggaaagttttttattttattcttttataattatatttatggatatttgtctttattagtgtagtaatatattttataacgctcataatttgaactttcaggctaatgtactataaatatttgtattacgcattactaccatcccaaatgtaccaaaacacgtttagagagaacaattatggacaaaaaagcaacaagcattatattttgtttgacatatttcatgttagcagaaatgtttcattgatttttctgtaacttttaatgcatcccatttgtggagtaatgaaaatgtaatgataattgccacaatgtaagcaaaaattgtatcctacctgaaaattactttccagaaaattcatggtagtgtactcagaatttgagactcaagagggcagaggtttccccgattgtgatgttttgatttgggctaagaggaactctttttttttttttttacacttaggtgccctttaacatgacaagttttgaatgagttaggtagcagaagtttttcgtgacagttattgtagctactaacctatagcatctatccttctaacgttcaaagaaaatatatttttctgtcactgtgtatggcaaactttattttcttgtgcccttaattttgttcccctttctcacattatctcctggtacttactgaccattacctcagttttgtttaggccgtctttcttgttaatcttccaatattaatagtattgtattatgttgctctgctgggttttaaaaatattgagtattccatttttggtgtatattattgtataaaatgtcctataaattattttctggtatattattttgtaagtttttgcagtgaatacgtgctgccttgcttgtattcttgccttcttccctctgatg

SEQ ID NO: 39926 - DNA, 1056 bp, Homo sapiens
aaatgcatctccccagacagtgaaaggagcctgacaatcctgctggtgtttattgtgaacagatcaacaagtatttggtacttgttagaaacctttcagagctcactaaagcaacatttcttttgcagtctggtgcctttggccttgcagtcagtcacttaaccctttcaagtgtgaagagcgttcatcatttggaacctccattgcccatagcgatggctggatttctaaagggtttactcaggggaataacttattcggaaaatatattcccattgtcacattttaaaacttgacagccatcataacaaaaactggtactgacagtaggcagacattctgaatgtattcattcttaatttggatctattggctgtgatttgaatgatctttggtagtaagttaaaaggatttttttttccttagctaagcgagaaacgatagaggcctatagctagaggactgatagtgcatggtgcttttggacaataaacatgtactttattttaggatgtaatttagtgagcagttagaaagcagtattctagtctttgcattagggcaccactgataaagctggctaagcaaagagaaataatattatggcaaaaaggaaaaaaggaaaagttgctttagttgctgaagctctgtgctgctcaggcaatccaactaagtggggcagggggcgggcgggggggagtattttcataaccctggtatttgaaagaaaagataattgagaattatgtcttgatttagttgtgactgccagtcagtttacaattttatggccaacaaagctaaactggtaaattttttcccccagggctaggattgagagagctactcaactctattcccagggggtttatgagtttttaccgttttgtgagtttatgtggttggtaaattcattgtggcctggtcagatgaagcactgctgtagttaaaatgagctattatttcttctagctactcaacttttataaggtggtaaatagatgggaagcaaggatgtcaatattacacaatgccttggaggtcctggattctatt

SEQ ID NO: 39927 - DNA, 1028 bp, Homo sapiens
taggaaaaacatgtcaactttgtgaggtctccttctcaaagagaagtaggtaatggagtacaaatatcaattaatgctcagtagagtctgcacatttgctggtaacgcagctatgttttagcaaataattgtctctcttttgtttcttgattgttagcagggggaactggggagataaacgtgttgcaaaggtctgtgctgcatcattgtgggaaggatgttcagttcatctaagagaaagtaaaaaattagccaaaccctgctcaccagatatcagagctgcaggaacatgatttccttctttagattctgtgctgagttctgctggcaccctgcattaatatgaaattaacaacacactactcacacggaactttacatctaaaaaaagctcacattatgctttaagccttttattataaaatagtggaagtcatgaggttaaatttgttcatacagttttctctggatcagctgtacaattaattttatataggggatgaaagtatattccatgtggatctttgtcagttgagaaagcagtaaaataactagtggtgaagcctgccttccccatcccaccccaagcacatatatatgatttcctacttgcaagcactccagatattatttttttgcaaatatgaaatacccctggtgttcacattcattgtcattgttaatatttgctatgtgtcaacagtgtgactcatcccaactaaaagcctctaggagaatagaggacgatggctgagaaagaaattccattcaataaattaccattgagcatttactatcattggcactgtaaggccagagtccctaaagagtgcacgatctagtatactgtgtaaggcagatgtacagataactataaatcagggcagaatagggtaaatgtcttacaagaaattattaaaatgtggtgccgtgggtggatcaccatttggaaaggctcagcaaaggttttgtagagaagatgataaaggggaaaaggatatgtaaaccagatgtgggctgggctctcc

SEQ ID NO: 39928 - DNA, 1499 bp, Homo sapiens
gataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctagttttacctcataatgaaggcacacagtattattggggggactttgtaaaataaagattaacagtgtctcattagaagaatacattgacatgatttagacaactcctaagagaaagggaaagtatctgaaagtatctgaatgcacaacatatagaaggtaccctacttcttgcctggtgctaggaatcatgcctaatttgcatatcgacttaggtaccttttttaaaagttgaaaatacacacattcatttctctttgtgcttctatcttccttggtaagttactggatagtgtttattaaagttcttggaaatacatacacaaaaactacagttgtctcttggtgtgtgcaggagattgttcccagaactgcactcccccccccccccagttctc

SEQ ID NO: 39929 - DNA, 2075 bp, Homo sapiens
aggattacaggcgtgagctactgtgcccagccaagatgttagaaaactcttgactctgggtagcagcataactgtccaaaaaaacacaaaacaaaacaaaagaaaagccatgctacaaagtctagtgaaggtcattcccacagaaaacacaaagcattaatttttgtcatacatagaaatatagttttagtaataatccaaaagcatttttgataaaaatgaaaaactttaaaaaaatattttaaagtttttcatttttaaaaactgatgtgttattttgttacatacatacaatgtgtaataaattagggcatttaggatatccatcaccttgaacattcatcatttctttgtgttgggaacatttcagaacttctagctattttgaaatgtacaataaattattgttaactctactgtgctctcaaatactagaatttattccttctatctagctatatgtttgtattcgttaaccaccttcccttcctaccaccaccccaacgaagcctctgaaccatcatttgttctctacctttatgagatcaacttgttttttagctcctacacatgagtgagaacattgaatatgtgtctttgtgcctggcttatttcacctaacataatgtccttcagtgccatagatgttgtagtaaatgacaagatgttattttcttttaatgaccaaatagtattttattgtatattaaaccacattttctgtatccatctgttgatggacacttagattgattccgtatcttggctgttgtgaatagtgctgcactaaacatcaggtacaggtgtctctttgatatactgatttcctctcctttggataaatagccagtagtgggattgctggatcataaggtgattctatttttagattttttgagaaacttccttactgttttccataacggttatactaatttacattcactccaacagtgtgtaagtttccatttccttgccagcagttgttaatttttgtccttttgctaatagccattctaagaggtgaaatgctacctcattgtggttttgatttgcatttcccttatgatagtgatgttgagcattttttcaggtctattggccatttgtgtgttgtgttttaagaaatgtctgttcagatcctttgcccgcttttcagtgggattatttggttgtttttgttttgctgttgagttctttgagctcattgtgtattctggatattagtcccctgttggatgaatagttagcaaactttttttccctttcaacaaatttttcactcctgattgcttcttttgctgtgcagaagcttttcagtttaatatagtccctcttgtctatttttgtttttgttgcctgtgcttttgatgtcttagccataaaatctttgcctaggccaggggggtcctatcttttggcttccaggggctactttggaagaattattgtcttcggccaaacacaagatacattaacactaacaatagctgatgaactgaaaaagaaaattgccaagaaaaaaaatctccacgttttaagaaagtttatgaatttgtgttggacggcattcagagccatcctgggctacatgtggcctctcggttggacaagcttggcttagaccaatgtcctggagcatttctcactatgttttcttctaggggttttgtggtctcatgtcttacacttaagtctaatccattttgagttgatttttgtatagggtgagaagtaggggtctagtttcatactgcatatggatctccagttttccaagcaccatttactgaagagagtatccttttcccaatgcgtgttcttgtcatcattgtcgaaaatcagttggctgtaaatacgtggatttgtttctgaattctctattctattccattggtctatgtgtctttttataccagtctcatatagctatatatggtaagtatagctttgtgtagtatattttgaagtcagatagtatgatacctcagcttttttctttttgctcaggattgctttagctatttggactcctgtggttccatatgaattttaggatttgttcctccctccct

SEQ ID NO: 39930 - DNA, 2030 bp, Homo sapiens
agcactgtctctacaaaaaacacaaaaattagcctggcttggtggcacccgcctatagtcccagctacttaggaggccaaagtgggaggattgcttgagctcgggaggtagaggttgcagttacctgagatcatgctactgcgcttcagcctgggtgacagagtgagaccctgtctcaaataatgataggccgggtgcggtggcttacacctgtaatcccagcactttgggaggccgaggcgagtggatcaccaggtcaggagattgagaccatcctggctaacacagtgaacccctgtctctactaacaatacaaaaaattagccgggtgtggtggcgggtgcctgtagtcccagctactcgggaggctgaggcaggagaatggtgtgaatctgggaggtggagcttgcagtgagccgagatcatgccactgcactccagcctgggcgacagagcgagactccgtctcaaaaaaaaaaaaaaaaaaaaaaagataagccaagctgtgcaacctgtgggctgcatgtggcttaggatggctatgaatgaggctcaacacagatttgtgaattttctaaaacattatgagattcttttgcgatttattttttttttttattttttaatttgttttaaagctcatcagctgttgctagtgttagtatattttacttgtggtccaagacaattctttttgtccagtgtggactagggaagccaaaagattggaccacccccgcctcccctgctgatacaggcaatagataatgtactgatcgaactgaataaggaatggaggacataaaattaaagacgttgatttcaagctgctgaagtcaacattcagatgtatgtaatgtgaccaggcatggtggctcacgtctgtaatcccagcacttcgtgaggctgaggcaggcagatcacctgaggtcaggagtttgagaccagcctggccaacatggcaaagccctgtctctactaaaaatacaaaaattagctgggcgtggtcgtggatgcccgtaatcccagctacttgggaggcagaggcaggagaatagcttgaacctgggaggtggaggttgctgtgagctgagattgtgccactctactccaccctgggcaacagagtgagactctgtctcaaaaaaaaaaaaatgtatgtaaggcctttggatacaccctttgggtggagatacggatttggggtcattaatccatagttttgatatttgaagtcatgagagtagagttgagtgtgttcactcaagatggcctgaaatgaaagtccgctaacttacagggagtggcaggaataaagcttttgaacagttaatcttttaaaaaggtgcaaccagaaaggaaaaacaaaaactacatggcactggttgcttcagaggaagatggatttcaaaggaacaggatcagaggtctcaataaaaaagctgttactcaagcaagagatgggttagtggtgggagtaatggggggggttcatgaaccagaatagcagtagaagagtcagaaattgattgaaatagatttgagaaaaatgtagaggaggaggagtatccagccaagctaaccaagtaagacagtggagtcaccaactaagagactacagtgacaagctcagaagtgtagattgcaggtgtagattaggaaactgttttttggggatttaaaaaccactggagtaaatgagagtttgtgaggacagtgggccaagatggaaccccagggagcaatttggttggcaagatggaagagaacatacctataaaatgtagagatcagttaggtaactatggaagaggtggcgacagttgtaggccatctagagaagtaggaataccagaatgaatggcttcactgtcagcactatattttgggccttaccaagccgttcttcctgtgccacctctcccacaaacatgctagttttgcttaagatttgtcacctctgtgtatccttttcctgcctcttagtcatttcttccttctttgcacacttgttttaggttgtcacttgg

SEQ ID NO: 39931 - DNA, 1054 bp, Homo sapiens
atttccctaatgcaaatgatgttgcatttttttcaggtgcttattgtccatttaaatatcttagggaggaatgcctttcacgtcctttacccattgaacagtttgtctttttgttactgagttataagagttcttagtctggacactagacccttaccagatacgtgatttgcagatattttttcccatttatagattgtcttttcactttcttgataatttccttgaatggacagaggtatttaattttgatgaagtccatttttttcttctgttgctgtgcttttcgtgtcatatctaagaatacattgccaaatccatggtcttgaagctatactccctaggttttcttctaagagttttatggtgtttatgtcatatttaggatattgatccattttgaatttttgtttattgtgtgaggtagggaaaggtttttttcaaaagtactttacctactactttttaaattggcaaacacttaaaaagaaaaacttggttattagtatatttcattatggaaaacttgattctcagaagtagaattgtagactgaatccccatatactatttagccagcttcaacttttaccattttgacccatcttgtttctttttctttcttctttttttctgagacagtctcgctctgtctcccaacctggagtgcagttgtgcaagctcgtttcactgcaagctccacctctcaggttcactccattttgcctcagcctcctgagcagctgggactacaggcgcctgccaccacgcccggctaatttgttttgtatttttagtagaaacggggtttcaccatgttagcctgggtggtctcgatctcctgacctcgtgatctgcctgcctcagcctcccagaatgctgggattacaggcgtgagccaccgctgcctggcctttttgtttgtttgtttgtttgttttgttttgtttttgagacggagtctcgctctgtcaccaggctggagtacagtggcacgatcttggctcactgcaacctccgcctcccaggttcaagcaattctcctgcctcagcct

SEQ ID NO: 39932 - DNA, 1086 bp, Homo sapiens
aggcactgtacctggcctgctcctgaaattttaatacttgctttcttgctttcacttcttctgaacatattcttatagatgttactttacttttttatacaaatatccacctctaagattgtgtgtactccttagaggaagccacattttataacacagttctgtgtttttcagaatttaaagtgagatttttaaatttaaaaggaaaaaatacttagtgtctttggaataatcagtttgcttaatgtcttttttgtcactttatttttctaaaaagctctttttgtatcatttcttaataatttggaaaaccaggtacaaatgacctctccgagcagcactggcagtcccatgtttaaattttcatctccaatcgtaaaatctactgaggcaaatgtactacctccatcatctgtaagtaacaagcaaggaatagtatatatttactgatttcaaagccatgttatatttttatcaaatctaagatgccactggtggtgagaaacactgttatttttcttccaacttaaaaaatactctgtgtaaaaaacttttgaacaatcatgtattcttcactacataatgtacatatgtatgcatattcattttcttctgtaccatttgaaagttaaaatgcaaacaactggatttccttaattcttctccatgtgtcccttaagaaaaaagacattcctttgcatccccacaatacagctatcatacccaagaaatttgacatgatataataacgacatggtccatattcagatttccccattatccccagactgtcctttaattgctgttttatttctgttggtcctagagccaattaaagactaggacctaatcaactacatgatattgcatttagttaaaacatgtgtcttgatttacctttaatctagaaaagttctgggcatttttttctttcatgattgaaaagtgaatgtttggggtaagaataacacgtagtttaatattcaaattgccccagatttggcatgtttatattattttaatatgtcattttctagttttgactgtgtccttgtcttctgacacaagtagatgttacagatcaaa

SEQ ID NO: 39933 - DNA, 1049 bp, Homo sapiens
ttacaaaggtattagatagtgaattgtgaaatgtgtgttctacttgagatgtctctaagcatcaagttagcagaattcttggcttttttttcctcttagattagtgggacccacttatgatctactaagtcaaaatttgggggagtagaaatcaaatgatagaattggttcaaggtcagctgggcgcggtggttcatgcctgtaatcgcagcactttcggaggccgaggtgggcggatcacgaggtcaggaattcgagaccagcctggccaacatggtgaaaccctgtctgtactaaaaatacaaaaattagctgggcgtagtggcaggtgcctgtagtcccagatacttgggaggctgaggcaggagaatcggttgaaaccagaaggcagaggttgcagtgagccaagatcgcaccactgcagtccggcccgggcaacaagatcgaaactccgtctcaaaaaaaaaaaaaattggttcaaggtcagtaatataaggaaccagtgtggacaagtgtgtgccttaaggagttggcatgagagagtagattatatagttgatgtttttagggttctacgctggaggttggacagagaagagaagcttccctacaaaaatagccagatgcatcttttgtttgttcctcctccctcagttgattatgacaaatttcaaacatgaaatgttgaaagaactgtgcagcgtatacacacagtagcagttagattccaacattttgtgttacatttgctttatcaaaaaagaaaaatttacctgtccatctttttttattttttggtgcattttaaagatagttgaagacattagtacacttcacccccaaatacgtcagcatacatagcgtgaagtagagttaaatatttgttgttctttttataacatagcaaaattgacatatagtgaaatgttaaattcttaggtgtgccatttaataaatttgacaaatgcttacatctgtgtaatgcaagccctatcaagagattgaatatttctatcatcctagaaatttcagttgtcctccttctcagt

SEQ ID NO: 39934 - DNA, 1043 bp, Homo sapiens
agatacagtcttgctctgtcgctcaggctggagtgcagtggcgcagtctcggctcagtgcaacctctgcctcctgggttcaagcaattcctgtgcctcagccacgcaagtagctgggactataggcatttgccaccacacctggataatttttgtatttttagtagagatggggtttcaccatgttggccaggctgggtcgaactcctgatgtcaagtgatccacctgcctcggccttgcaaagtgctgggattacaggcgagagccaccgtgccctgcctgtcttcttcttgcttgcctgtttctccttttttgatgttgtattgtgaaaggtaactgtaagttttttaatttcactgcttatatatttatccagtttgaagatttaccgtaatccattctgccatcaggatacattttggtagatttctaatacacattaaagtgaatatgcacttttctgtctgcacacgtgcagtattttctctagagtatttatctaggaatggaattgttggattataggggatgatccacatcttctgctgtattagatgttgccatgttttctcttcaagatagttttgcagttcaacatttccaccatatgacaatagatagatcttggggcatccttttgtgtgttttttggacatttgagttttctcttgatccatttttttcctatggggttatttcctgtagggatatatatataatttcttatatgtatattaagaaatatgtatgtatatgtatatataatttattattagaaagagttctctatatattctgaccataaatgtttggaaaagatagggacagatttaagattggttacattaacctttctgtctatatattgctctttttttctaactactttaagttgaatgcaagtctcattttagttgtattataaatgcatttcagcttagcttaaccatttgagttttgatacatagtccttgtatttgtcatttgtttctaattaaaatttcaccagtgactccctcattgaccaatgagttttaggagta

SEQ ID NO: 39935 - DNA, 1073 bp, Homo sapiens
acgcctggcccatagctagttttaaaatatcttatttgcagctcaaaaaatatggacagtaattcagggaaaatgtgacaaaagtacattttagttcatgcatttaaaattcactctgggccaggtgcagtggctcatgcctgtaatcccagcactctttgagaggctgaggcagaaggattgcttgagcccagaagtttgagatcagcctgggcaacacagcaagacctagtctccatttaaaaaaaaaaaaaaaagccaggtgagttgcctcatgtctgtaatctcagcactttgggaggttgaggcaggcagattgcttgagcccaggagtttgagaccagcctgagcaacatggcgagaccctgtctctacaaaaaaaaaccaaaaaaattagccgggtgtggtggcgcacgcctgtgtacacaggaggctgtggtgggaggatcacccaggtctcacctacagtgagctgtggtctgggtgacagagcaggagtccgtctcttaaaaaaaaaaaacaaaaaactgtaaaaggtttgatctgtagtgctgttttgaatatagttccattttgtatgcatgcatgtgtgtgaaaagtcattaagtctggaatgaaatatagagtatccgtgaagccattttagaattatatgtgtgtatatttatgtgcataggtatatgaatacataccttaggttccattattatcagtttttcctcttatttgtttgtatctactgtatatttctctgggaaatactcatggtctttaggtcatgttagctattgtcaaaatttagatatgaatcattgatttatatgaaaataaatgtttttgatttctctttacctgtaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtgtgagtatatgtatatttctaccagtctttgaatattgattagaataagtaagactaaataatgtaa

SEQ ID NO: 39936 - DNA, 1049 bp, Homo sapiens
aaagtgttgggattacaggcgtgagccaccgtgcccagccccctgttaactcttgatagtctcctttccaatactgtgcatatttcttttccgtagtagttttttaaaaatttctaatgtcttatagttggctgtgcatcataaacacatattctgtgtaagtctttaacggtggaaatcaactcgaaggtcggcttttatgttaacttctcattgatttttcagagttgatattaaaaatatgtttataaatatgtgtttggtagacaataagatactaattaaaatggtggtcttttaggtaaaattctattgtagttaagcttataatcatggttatgtataccaaggccttaattagaataacaggtcactgagtttttgatggtttcagtatagtggttctcaaacattaatttgcagaagaatcaaattcaagagcttattaaaataaatttgcctttctaatgagctcataggctacaccaatgctgctgatctgagaactacactttgagaaccactgttttagtccttttataagtgactagatatataaactacagaactaaagattacacagattgtcacacatgggtatgcacacaatttaaagggaattttgtgagatttaaagctattttaagttttactagatttagcatttattgataaggttaccagaagctttgaattgcatgatccaaggacacgcctgtatttgggtcttagcacctttttgttcgttcagtccatagtacttcccactctctctttttttttttccttgagacagagtctcgctttgttgctcaggctggagtgcagtggcgtgaactctgctcactgcaacctctgcgtcctgggttcaagcgattctcctacctcagccttccaagtagctgggtctacaggtgcccaccaccatgcccggctactttttttttatttttagtagagacggggtttcactatgttggccaggctggtcttgaacttctgacctcgtgattctccctcttcagcctcccaaagcgctgggcttatag

SEQ ID NO: 39937 - DNA, 1021 bp, Homo sapiens
gggaagaggttactgtttttatgttaagtgtcttttcaaagtctaatttacagccaagaacagcaaaagtaccccttggctttgtgcctctgcggcgccccggagatctccttccccgtccctcttcctttccgagaagccgcgttccgttgttgaactacgtttcccagcgtgccgcgcggccgagagcgtggactcgaccagcccttcctctttgcctatcagctcgtcgcagcatgatgatgcaaatgcgtcgggcgccgatgagtgacgacattctggctcgcgaccgcggcagccgccttagcaggggtaataggcgcaacggcggcggaggctgcagggacgacgacgacgacggcggcggggcgggcgctgtgcgcacaggggaggggtaggcgggcgtcgccagcggcttcaactgcggcagctacggctagggcgacggaagaactcccaccagtcggcggtcgagttaggcctcagcaccgcggggaactgttcgtgctgtcctctgcgggagatctccatagagaccgtgacacacacagaggcgggggtccgcagaggcggccggaccggagcctcctcggcctctgcggccgccacccccttccccgctgccagcactcaccctctctccgctcctgctcgcaacctcgcggttcctggggtgcttgtgcccactgtgtggacagcgcgggcggacttttgggccggggccgggcggcgggggaggctctctaaggcctccgcctctgcctctcccgcccccttacccgccccggagcgggaagcggcggaggctccgccatggcctcgggagccggaggagtcggagggggcggtggcggcaagatccggacgcggcgttgccaccaggggccaattaagccttaccagcaggggcgacaacagcatcaggtatgggaccccgacgccgcggtggcctggcgggtggggaaactcggctggaggggacgggcggttcgaggccccggcgccccacgtggagcagaca

SEQ ID NO: 39938 - DNA, 1048 bp, Homo sapiens
atgtggatctccatattagaattgaatgagttaggagagtatgctgcagtggaacttcatcaggcaaaagatgtcaacacaggaggcatctttcaacttagacaggtactgagtttgttttgggtttttttttaatgttttctctctgttccactcttacacattgtttctggggattttctaactatttgtatctttattctctaatccttttccccttctttatcccgttccttttcattatcattcctggcacccatactcctccccaccctcttcagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggtaagacaagcagacttaaaatagtatttaacaaagcttggttaatgcaggtcccagggggacctctttgccaatataacagaactctttgccttaaccgtagatcttcccccagttcacatttccatccattgccttttttctagctttaaaatctgtttgcttagtgtcagttaataataattttatttataaacacacgcatcctaatgctatagtagtcattaactttaggcagattttattttatatctggcccaaaatatgttgtatctttggcattactgcctgacctgatccactttttgggtttttttgtgtgtgttttttttttaaaagatagggttttgctttgttgccaggttggagtacagtggtgtgatcatggctcactgcagccttgacctcctgggctcaaacagtcctcccaccttagcttctgaagtagctgggactacaagcacacatcaccacgcccagctgattcttttattttttgtagagaagggcatgtcattctgttgcccacactggtctcaaattcctggactcaagtgatcctcctgcctcagcctcccaaagtgtagggattacaggcatgagccaccgcacctggccac

SEQ ID NO: 39939 - DNA, 1045 bp, Homo sapiens
tactatgcagccatgaaaaacaacaagatcgtgtcctttgcaggaacatggatggaactggcggccatcattcttagaaaacgaatgcaggaacagaacaccagataccgcgtgttctcactaataagtgagagctaaatcatgggaaccgatggacagaaaggggaacaacagacactggggcctgtgggaggaggagggagaggctcaggaaaaaaaaacaaaaacctgccaagtactatgcttactacccgggtaatgaaataatccatacatcaaaccccttagtcatgagttgacctgtataacaaacctgtgcatgtacccctgaacctaaaataagtcaaaatatttaaattttaaaaaacaaaagtatctgataaagaaggtggtttgcttttaaccatagtgtttttcagttaaatagttaaaaatatttttttgatttcccttaattccagattgattttctttggggcttaaattcttaaaagaaaggaaaagtgtagaagtcgggtacagtggcacatgcctatagtctcagctactccagaggctgaggcaggaggatcacctgcgcccaggagtttcaagctgtagtgcactgtgatcatgcctctgaatagccactgcactgcagcctgggcaacacagggagaccctatctccaagaaaaagagagagagagaaggaaagaaagaaaaagggagggagagaaggaaggaaggaaggaagaaaaaaaaagatgagatattttgggaatgtcattcaaagacaagaatagttgcattattgattttgtcaggtttcactggataaaagtaagatgtcattaattgtatgtggttatataagaagctggaactcttacctaagtaaattgttgatgggttgtgaaataatgaaggactcttacctacatgaatgttgatgggttgagaatcaagtaaatttaaacgctggtgagaattacaaagaaagccacagatgtcgtttattctctttgtacacttagaatgtagtatgaaacaagatataaatttgt

SEQ ID NO: 39940 - DNA, 1043 bp, Homo sapiens
tgtcatcaaagttgtccgtgagaaaggtgtttgcagactaatgttagggatcagaggcgaaacaaaaccccagcccctagacctccaccgtagctgtgtgtggtgagggcggatctgggagttcgggaatggggcttacaagactctactgtgggagtctcagaggaaggacggattgagttgctctgtcttctgtatttgcacttcaatttgtggccactcatcatgcctagtgagtagtggtagtgctgtgtcatgacagctgctggtgcagtttcaaatagcctcactcacgtggcctgtgtcagcatggaaccttggggtgagatcccctctgccccagtcatttgggatcatgtgtgtttctgcactactgactaacaatggaaatgtggattatatatcttattcagtatctcgtagcaaaaaccctataatgcagttttataaaacggtgtgttttccagcttctctggaaaagatttataaacactgttaggacagttgggctccatctaaatataaatggatggcaagtactgtagcaccctgtcctttcttttttaaacccagagcctatatactgtttgagaaatatgtgtatatatttttttaattctgaaagaacttttcttctctagagcttacatttaaaatgtcttcagatgccctcaaaaaaattttaccatatttctcatatttttttagaagttataggagtttgtcagaagttctgatgcttaggaatacataggttgttattatatagataatattttacccacccaggatctatgtttgcataagattttttgtttgttttttggtttgggttttttcccccagtttatattcttttctttctttttttgagatggagtctcactctgttgcccaggctggagtgcagtggcacgatctcagctcactacaacctccgcctctgggttcaagcaattctcctgcctcagcctcccaagtagctgggactacaggcacatgccaccacgcctgactagtttttgtgtttttagtagagatag

SEQ ID NO: 39941 - DNA, 1053 bp, Homo sapiens
aatcaccaaattcaaagggtagcaaatgctgtccttttatgtgtttaaaacagattgtcactcctttactcttcagccccgctctgccatagtatagtacatgacacaatgcccccaagagctgcagtgtgatacagagattcacaaaagagaacttgtcccccactcccgctgtggggacacaggtgacgggtgcctgtgaatctacaaacagcagctgaagttgtcaatccatcctcagcaactaacggtttttagcacttggcatgtacaaaacaccaagctaggtgctgagggagataccaaggtgtgtataacatggtcttgttcagtggcagttcagaatctagctggggagataaggcaattcatgtttaatgacattgtagatattagtcataagaaaaaacaaccaaatttgaatgctgcttccatatggcccactcacaatggaaagaaaactttaatatctagagaagtgtcttagagggaaacagtgtatccaggtactgagctgtagtttagaagtgtggatgaaattgcatatatcaagctcttaatacacagccctgtacttagtgggcactcggtactacacttttaacatttttttgaattgacataatattgttactaacacaaatatgtcaagaaaaattattctttttattagtttttaatatttgtcttgttttttaggtcaagaagtggttttcaagtgccttggggaaggaattcttgaaaaagcctttcaggggtataatgcgtgtatttttgcatatggacagacaggtaagaagttgcttttatagaccagatgtgggggatcatgcctataatcccaggacttggtgaggctggggtgggaggatctcctgagcccaggagtttgagaccagcctgggcaacatagtaagacccgtctttataaaaactaaaaacattagcccagcgtggtggcacacctgtagtcccagcttcttgggagactgaggtgggaggatggcttgagcccaggagtttgagactgtagtgagccatgatcacaccact

SEQ ID NO: 39942 - DNA, 1052 bp, Homo sapiens
cccactttctgatttagaaacacgtaattctctagtgggggtataatggcattgtagtgggttggttggagcagttgaagaatatgggctcttaagtcagacttggttcaaatcctggctctaacaccttctatctgtgtaaggccgggtgagttactgaatctcacgatccttctgtttcctcatatggtaaataaggatactaatagttctgatctcatagggttgatctgagggctaaataatgtattcatttaaagtgcttaatccagtaagtacctggcgacttagggaggaggaagcactgccttaatgtttatcgttgtctttattattgtctcattgtgacaggagtcagcactttggaaagaaaatgcaatgtactgagatttatgacaactggttttgccacaaactgctagaccttgggcaggataatttctgtgggtctctgttcttcatctgtgaaaggaggagatacagcctggaatgatctcagatcccctccagctctctgataaaacatgaatcagccattttatgttggccacacagctgttccagtggacttttcagaggcaaattaaaggcttatttgttaagccattcacattgcattgaatcatgctttgaggtattttacattttatttatttgtgtttttttttttttttttttttttttttttttgagagggagtctccctctgtcgcccagagtgcagtggcacgatctcggctcactgcaacctccgcctccttgggttcaagcgattctcctgcctcagcctcctgagtagctgggattacagacatatgccaccacacctggctaatttttgtattttttagtagagacagggtttcaccatgttggccaggctggccttgaactcctgacctcaagtgatcagcatcccaaagtgctgagattacaggcatgagcgactgtgcccagccaggaattattttacatttgaaatatattatctcttcctcctattagcttttggctaggtagttgtaataatgtttgtctggcagataattctg

SEQ ID NO: 39943 - DNA, 1022 bp, Homo sapiens
tttttctctgataattgtgtatatttttaatagcaacctttttttgttcatcctaaattctagccatactatgtcaatacctgagattattgagctgctagatttgttgcaatatggaaatcccattgcatcctttaaaatacctttttgtttgtttatcaaaatcattgatacatttcccccaaaatatgttcctccaagaaaattctgttatcaaataagtttggggaatgctgctgttgaaatgttgcattgaatatgcaaggagagtaacaacatatattagcatgtcaaagtctctgaaaagtactgccataaagaaacccatatttaactgtgttcagcagcatttctcaatttagttgatgtcagaagctttttaagggcttgacctttgttaacatcccgttcaatttctatgcttgtgaaatgctggtctagagaaatgattatttttaagtaagttatcagaaatattctgcattttctgacagtctctgaagtcttcactgctgttaaatgcaggcagtcttgccccaaaattgtaggattgtggtggtgatttaagtaaatcctcacaactggattatgtttaactcactaatgtaaaaaaattatttctgagttcttattctgtactcagccctacatgaatagatgggattggggacagggattatataccacgtgacctggcctctgttttcaaggggtttacatcttaaagatatatgagactcaaatgcagacagttactgaaggcatcagaactttatgtgtgccaataagtgctaagctgttttgtcgaccctaggagtcttgggatagtagaagtagtgaaggccaagatagtcttcaaggctggtgaggaattgagagagctgagccttgaactgtgtcttcaagagtgggcaggtatgatccggcagagtggaaagacaaagtggggtaaaggcatgtaaattgcatgagttgtgtggtaaaaactcatggtgtgggtgacctggaagagatcaaactgc

SEQ ID NO: 39944 - DNA, 1031 bp, Homo sapiens
aaaacacagataacccatgttttagaagagtggacccaaaggagtgtccttctaaataacctcactttcctgatttttatggttatcatttctttcttttttttttttttttaagtttttcatttaactatttatccccaagcaatatatttttagttttgccctttttggtgaattaatgtaatagaatcatgttgaatatattattcacgggcttgctttcttctttcaacattatttttttcagattcatccacattgatgtgtgaaactgtggttaatgtccttccactgctgtaaactgttgcattgtatggagtaccatggtttatttttccatcctccaggtttgtttcttcactggtgtttggaaaacaacatggactccaaactcctcaagtcaccttgccacagatcccttgagttgggggttgggaatttccaaattgttggctttccttagtggaaatactagatgttctcatttctggagaccttctagagaatggactgtgatggacttttgcaggggctgttagctgttgacctgagtctcctgggtctggagttaaagccctgtgtctgcaggatcttgtcgatgagccctcccctggggtcactccttctagtgacttgaaataagttaaattggacttgaagtgagttaaattgttgtgggcccaaaaatgcttccagtgttgttaattaaaagttcaatgtattgtgtttgatgcccctttttacctgatttaaaagcttaagtttctctttggattaatcaataaaagtacttctataagtaaactctgcagattttttagtcactcaactaataggacttgcaggaaaagtgaaatgtctataagcaaaaaacaaaacttctactgggggaagctttggagctttaggtagattggggccagccaagagcccaagtggtttaaccagaagcaggctagtcttcagagcacaggacgacaccaagagtttttgttcttcccactcttggctttccaagggcattctcctcc

SEQ ID NO: 39945 - DNA, 1681 bp, Homo sapiens
tccctccaagagtgactgttagctgcccttgctcattggttctcagacttaaggatttttaaaaaacagtagaaataaaaatttggataaacagagagttcccagcctcttttaaatatgccgagtaatcacactaaaacaagagcaagccggacgtggtgactcactcctgtaatcccaattctttgggaggcagaggtgggaggatcgcttgggcccaggagcttgagaccagcctgggcaacatgacaaaaccccatctctacaaaaaatagaaaaattagctgggtgtggtagtagtgctcacttgtagtcccagctacttgcagggctgaaatgggaggatcacttgaatgcagaaggtctaggctgcagtgagccatgattacaccactgcactccagcctgggcgacagagtgagaccctgtgtcaaaaaaaaaggaaaaaaacaaaccgctactaaattttaatattttattataaaatagaggtcagcttaacaccagaataggagaaaggacataatctcagaatttaaaacttggatacatttaattttgtgaagtgatcacattaattatctcttttcctggaaattgatggaaataccaccatagctatgtgaactctgaactgtgaagtacagttaggtgtccctggtgtgtgcgatgtctaatagtacatcagctattggagttctgaggatcttgggtccttcaggccagatcatactaagaatcattaaaggatattttcccttaaaaattgaccagtctctgttatttgtatgtagactgaattttttgagtggtagcctacatctttgtttttgtattttgatgtattgaaataacctcaccaatctttttaaaagccgaaataaaattgaaatttgtaaaagtgttgtaaattactttgtctctgagctgcagcttttcccttggaaatctcttatttgctttttgcactgttttgatagatacctgttgagtataaataagtagttttgtaaagcactatcaagtgttgtagccaagagtgtgctctttggagacaaactgctcaggtgaatggatataaggcttttaagtggttataacctatgtctgttcagtactcctatctgagcctatcactaacatccctagaaagaattcagtaagaggattagggaaaaggaggtgcatgtcattaacactcatggccaggcctatccaggacgcagatatttaagtcaaatattgcattaagattaataaagaagggggttaggggagaaaagaaaaggaaagagaaaagaaaactacctggtaattgaagcaggcaaattgctggaagcatgtaagcgatctgaaatctagttactttcacactgccattggatctcctctctcagcatcctgatatatatatataatttttgtatttttagtagagacagggtttcaccatgttgaccaggctagtctcaaactcctggcctcaagtgatccccaccgccttggcctaccaaaattttgggattacaggcatgagtcaccatgcccggcctgcttttatgtatttctatacacaaaaacttaaattgaataaatggatcaaaaactgttctaagaaagcatgcatgaatcccttatttaagaaaacacggccgggcgcggtggctcacgcctgtaatcc

SEQ ID NO: 39946 - DNA, 1519 bp, Homo sapiens
ccaagccatcctcctgcttcaccctcctcagtagctgggattacaggcatgcatgaccatgcctggctactttttaaattttttgtagacacaaggtctcaccaggttgcctgaggctggtttcgaattcctgggctcaagtgatcttcccacctaggtttcccagagtgttggaattacaggcgtgagccatcacatctggcttgtttatggttagttaattcattccagactctcagcctgaaaacactgagaatgtttgcatgctagttttccacatcatatacaatattattaaaatactcatttggaatagaattccatatgggttaaccagagtactgttgggatggttgtggctatttgcacgtagcagatttcctgcttttattcaaagacaatattactggattttaaaatctgcttttaacattatttttccttttcactatacataggtctatgaaaattatcctacttatgatttaactgaaagaaaagatttcataaaaacaactgtaaaagaggtaaatatttcagtctttcaagtttgactttagaaatataagacaaaagtaattacataaaatactccatatttttcaaaatattcatgtcactaaatatcacatttgatcctcacatttcttcataatagggaaatttatttcttctcattcccactttaaagcttaaaattaaagtttgaacagttagtgataagacctgaactcagattatgatgtggcctcatggtgtacctgggtagctgggcatctcaacgttgctctcacaaatacttgaggaagttcctgtctacgaggcaaaggtgaggggaagatcagcaggtagctgtaattctgtattgatctcaactgatttttgaaggacaaaatagtaaaatagatgtggaaaaaatgggataaaggtttatgatttatggcaaaataatgtttctctttcattacagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatata

SEQ ID NO: 39947 - DNA, 1035 bp, Homo sapiens
ctaagattgttggaaaagtgcagtattagggtgggagtgacccaattttccaggtgccgtctatcacagcttcctttggctaggaaagggaattccctgaccccttgcgcttcccaggtgaggcgatgccttgccctgcttcagctcacgctcggttggctgcacccactgtcctgtacccaccgtccgacaagccccagtgagatgaacctggtatctcagttggaaatgcagaaatcacccgtcttctgcgtcgctcacggtgggagctgtagactggagctgttcctattcggccatcttggaacctcccggggcaaacaattagagtaatttaaatgatgaactatattttagagggttggcatactacagcctgtgggctaaatccattctatcttagtcacctggttttgtaagcaaaattttattgtaatacagccacatctatttatttaactattgtctatggcagcattgccactacaacgcatagttgagtagaaactgactggcagagtagaaactgactggcaaaattgaaactatttgtaccatctagccctttacagaaaaagttgctgaccctgaactatacagtggaagtaaagcctacagggtgcttgcagactgtgagcttatagagtcaggacctgagtcaagcagcaagtataacaggactgagaaaattgacaaaaggcagaaatttagtcaaattttaggagtacaggactcttgagaccacctgggtcttaggatttaactttagggagggactgagcagtggagtagaggaagcagttcattgcttttcaggttgtggaatcataggtagggtgctggataataacaagggttggagaagaaagaagttttccctaaaagacacttggcagatgacttgccaacataaagaacttagttctgttatctaagatctatctggatgttttctttacccatgtttgttggggttttttgtttttgagacagggtcttgctctgttgaaggggtgggttgcccctccacacctg

SEQ ID NO: 39948 - DNA, 1052 bp, Homo sapiens
ttttccatttgcttggtagatcttcctccatcccttcattttgagcctatgtgtgtctctgcacatgagatgggtctcctgaatacagcacactgatgggtcttgactctttatccagtttgtcagtctgtgtcttttaattggagcatttagcccatttacatttaaggttaatgttgttatgtgtgaatttgatcctgtcattatgatgttagctggttattttgctcgttagttgatgcagtttcttcctagcatcgatggtctttacaatttggcatgtttttgcagtggctggtaccggttgttcctttccatgtttagtgcttccttcaggagctcttgtaaggcaggcctggtggtgacaaaatctctcagcatttgcttgtctgtaaaggattttatttctccttcacttatgaagcttggtttagctggatatgaaattctgggttgaaaattcttttctttaagaatgtcgaatattggccctcactctattctggcttgtagagtttctgcctagagatccgctgttagtttgatgggcttccctttgtgggtaacccgacctttctctctggctgcccttgacattttttccttcatttcagctttggtgaatctggcaattatgtatcttggagttgctcttctcgaggagtatttttgtggtgttctctgtatttcctgaatttgaatgttggcctgccttgctagattggggaagttctcctggataatatcctgaagagtgttttccaacttggttccattctccccgtcactttcaggtacaccaatcagatgtagatttggtcttttcacatagtcccgtgtttcttggaggctttgtttgtttctttttactcttttttctccagacttctcttctcgcttcatttcattcatttgctcttcaatcactgataccctttcttccagttgatcgaatcggctactgaagcttgtgcatgcatcacgtagttctcgtgccatggttttcagcgccatcaggtcatttaaggacttctctacactggttattctag

SEQ ID NO: 39949 - DNA, 1074 bp, Homo sapiens
ggtctgaaattctctttgtttgttgtctctctgccaggctttgatatcaggatgatggtggcctcataaaatgagttacggaggattccctctttttctattcattggaatagttttagaagtaatggtatcagttcctccttgtacgtctggtagaattcagctgtgaatccatctggtcctgaactttttttggttggtaggctgttaattattgcctcaatttcagaacctgttattggtctattcagattcaacttcttcctggtttagtcttgggagggtgtatgtgtccaggaatttatccatttcatctagattttctagtttatttgcgtagaggtgtttgtagtattctctgatggtagtttgtatttctgtgggatcggtggtgatatcccctttatcattttttatttcgtctgtttgattcttctctcttttcttattagtcttgctagcggtctatcaattttattgatcttttcaaaaaaccagctcctggattaattgctttttttgaaggtttttttgtgtctgtgtctccttcagttctgctctgatcttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttaaatgtgtcccagagattgtggtatgttgtgtcgtttttctcattggtttcaaagaacatctttatttctgccttcattttgttatgtacccagtagtcattcaggagcaggttgttcagtttccatgtagttgagctgttttgagtgagtttcttaatcctgagttctagtttgattgcactttggtctgagagagagtttgttaaaattttacatttgctgaggagtgctttacttccaactatgtggtcaattttggaataagtgcgatgtagtgctgagaagaatgtatattctgttgatttggggtggagagttctgtagatgtctgttaggtccgcttggtgcagagctga

SEQ ID NO: 39950 - DNA, 1028 bp, Homo sapiens
tagagatagggtcttctgattttgcccaggctggtcttgaacctctggcctcaagtgatcctcccatctcagcctcctaaagtgttgggattacaggattgagccactgcaccctgctttttgaaaacacttagaaagtttaagttattggaggaaattatatttgcataatcaaagaatttctcattctgcaaaaggaagcactcagtaataatagttaatatttagtgtttactatttgccaggtactaccaaaaatacttttcatctgttaatgtatctactccccataaaaccataggaactattgtttcttttgttttgtaaatgagacaagggcccagagatgtactggggctggaatttgaaaccaggcagcttgctgctagagcctgtactctttgaactattatgtcgtatatttttctttagtgcttgtgcagtatatttgcagtcttttagaaattttaatagatgacaggcctggttgtccgtttagaaaaactgtagaacattatcctttacagcagatatgaaatgtagaaagatgtggttttgttatacagaagtaagattttatggagatggcttgttatttattattataaatgtttatgctttgacaaactgtcactactcacaatttgcaggttttaaaatgatgtcatgttgtgtatcacatctaaaattttaatggcaagccttaaaaggctttggaagtattttagttatctaattctgattttctaatttgaatggagattgagtaattattgatgatattgtttcttttgctcaaccttcaaccctttcagtaataacttactttcttgtacctgcaagtccagattttattaccgtttaactaaaaaatgatatataatcatgattattgtattctgtgtattaagtgtgctaaagaacttaagaatttttaggattccctttcagagcctaatatatagttcacatgaactgggtggacacttaatgaaccttaaaacttagtttaagttcgtcataaaaaa

SEQ ID NO: 39951 - DNA, 1027 bp, Homo sapiens
actttatggcttctctttggcatgtttgaattgccaacattactacttctgggctttggggccattattaagtcacataagggtacttgggcacaagcacaatgatactgcaacagttgataggataaccaagatggctgctagtgactaatgggccaaggttctgggagcatctacagtgtggatatgctggacaaagggatgattcacatcccgggcaggagtgagcaggatgacatgagatttcatcacactactcagaacagcatgcaattttaaatttatgagttgtttacttctggaattttccatttaatattttcagactatggttgacaacaggtagttgaaaccacatgcagaaagagaaaccatagataaagggagactgccgtattattctttcttcttttttgagacagagtcttgctttgttgcccaggctggggtacagtggcacgatcgatactcactgccacctccacctcccaggttcagcaattctcgtggcacagccaccctagtagctgggtccacaggtgcatgccaccacgcctgactaattttttgtagagacggggtttcacgatgttgccaggctggtctcgaactcctggcctcccaaagtgctgggattacggggttgagccaccgtgcatggcttcctattctttctaaagcttcttgtttatgtacttctatcttcagagttctctctagaattcctgatttagatcaaaatttgattttaagcaatagctttaagaaagttaatgagtataaatccacttgtgcttatcagaacttaaaactaaaagctattaaaaacttgataattggaggaattgtcctgttgattgctttgtctggttcctgcctttactgtatatagctccaataattcaaaatctaggaatcagcaggcagtgtagcctgtatgccaagtccagcctacagcctgtttttatacagccctcaagctcagaatggtttttccatttttaaatgattgtttaaaaaaatgaat

SEQ ID NO: 39952 - DNA, 1057 bp, Homo sapiens
tttttttgccttccttcaaaaagtgcttatgtcattcctctgattctgtaccttcatggttatcagagacagggagaatccccttcacgtttttgaaacttctgtattactgatcctttaaaaatttaggttatagtacattgtactatctgacattaatggcagctgttcatttttatttgttcccctttagaacatctgaaatagttgatggtcctgattgaaccactcagcatatagagaagtagcaaactcgaatctttaaatctcatgacaatttggaaatcagctttttctttattctttttttaaaaaaacttaacctaattttccccccattttgttaaaagactcagtcttgtctccacttaggttaaataacaagatgttaaccattgtgagtattttcaacattatttcctcaatgccatataatttttattataatcactaaagttttcaagatattttgaaagagacttaaaatgggggtcagtacttcacttatttttgagacagagtcgtacgtcttactctgttgcccaggctggagtacagtggtgagatcatggctcactgcagccttgaactccagggttcaagtgatcctgccaccaagtggctagcaatttttaaattttttgtagagagaggttcttgctctgttgcccactggcttttgatttctgaggtaaccactttttgattgctcaagtcagtgaattgggagtatgctaaatgctgttagggttacagaagatattttccaagcaaatgccatttgatacttagcattataggatttctaaagaaggaaaatcttcatgcctcttgaggaaaggctttgggtagaagtggaagtactaccaattcaagttgaccttgggaatggagaggaaagttgtacgtgtgaacaaagataaggaacagggaaggcagggtgcctttgactaactcgtggttagagttgtgtgcccagaagtagagcaatgagagatgaaactaaggtaatgtaggttgaacccatgctatagagaacccatgaagctgggcattg

SEQ ID NO: 39953 - DNA, 1600 bp, Homo sapiens
aatctatgaagggcctgatgcagtagcttatgcctgtaatccctgccctttgggaggccgaggcaggtggatcacttgagctcaggagttcaagaccagcctgggtgacagagtgagactgtctcaagaagaaattagccaggcgctgaggcacgctcgtgtaatcccagccacttgggaggctgaggtggaagcctgaactcaggaggtcagtgctgcagtgagctattttcatgccactgcattccatcctaggtgacagaatgagatcctctctcaaaataataagtatatgaagaaaaccgagcctcacataaaaagaatatttttaaagtctttttagataattgtgtatattctctttttgataccatacaataccaaaactctacataagttgtagtttcctaaagattagttgtaatgtttaatgtaggtctgaaaccaggttaattaacttgggtcttgtatgtatagttttgtaacatgcatttaccgcttgtaaatattggttccctgaattatgtcttccaaatgttgacgttttattgaacactgtcattaaatcatgctcattaatataaatatcatctcatcagaaaaattacttaggccttggtaaactatcaagttcacagtagtagatgtgaattttccagaattctagttcccacttgaaatcataacgtttatcattggcgataaatgctctcagttttccttgaagtgacaagctcaccttgttcatgtttgaaaacatctctatcaaatacctaagtctgagttagccatatttgttcttttaaaaagtggtgttctctgggaggtgaagcttgcagtaagccgagatcgtgctgctgcactccagcctgggcgacagagcgagactgtctcaaaaaaaaaaaaaaaatgtggggttctatgaaaaaggagcttggagcgtgtttagctcacaactcagatacacaaatgcttttccttcagaaaaccattgaacttcagttgtagccatatttatgtatatcttccattttgtcacagatattagaaagacatgtacttgagagttaacacagtatttattgttttatcaaggacattattaagtgaaaccatttgccttgtttgtttctgctggtgtgtggttgtgaggaatacagtgactaatatatgttgcttccttgattagtactaaggtgccatcaattttacccacctttgctttcctttgcttttgcaattagtacaaatgtcaacacagtgaaaagagcagataaatagtgttgctattattatgaaaatagtttctacctcggagactccgaaaaaggtctcaggaaaccccaaagtccttgaaccacactgtgagaatctgttttttcttgtcatatagaatcttaactcttatgtcagtttttcatatgtgattctgtgatgattactccttaatctgatagtatcgagctcaggctattttcttttttttttttttttttttttttttggagacagcgttttactctgttgcctagactggagtgttgtggtacaatcatggctcaatgcaaccttgacctcctgggctcaggtgatcctctca

SEQ ID NO: 39954 - DNA, 1163 bp, Homo sapiens
ggttggctttccctttatattgtggagaacatatgtaagctttcctatattaacaccttggtttcttccattttctgtttcagatttagaaatgccatgttaaagagcatctgtgaggttcttgatttggagagatcaggtgtaaatagtgaactagtgaagaggatcttgaatttcttaatgcatccaaagccttctggcaaagtgaggatcaatttttatttttttcataaatcagttattcatagcctctttatatgaaacaaaaattgattaataacagcattgctgtcagtattcgttcatatctacattcaaagactataccttctgttgacgtatctgcagtaatttcctgatagaaataatatagatgccataggggtatgttgcttcggaaaatcagatacaagggatataaggttaagaatagtgaattaatgtcagaagggacagaaagtactagtagtcagggttaggtatctagaagacactggaagaataggaagaggttgggctgaggatgaggtgcaaggctggagggaaggggtgcaacctgtaatcaagtgaagacaaaatagggagtatattagaactggatgttttcctagatcctggaataaagtattaaaaagtgacatttaaaagctaactcttacaagtttcctatattgggtttccagaatctgcagcagagcccaggagccagacagggaagtaaaatggccttacagttttctcactcttcctaaaagctagtaggtttgccctaattatttaatggtaacgaatgacataggtgacttaaaatgtctgttgaagtgttacatgaccttgcctttttagtgtgatttaggtctgtcagcaaatgtttttatattcttccccatcttgacaggaaaggaagtgtgagagatctagcaggcctaggagttcaggggaatgccatctctgatgggagatggcattaatcaaaaccagaaaatagctctaggacttcgttttcgtccgcccttggtccttattaccattagctgcacgaggacagataaacagcagttaaagtgtaaacttttgttatacaactacaaacgcaaggggtatgatgatttttggtgttttaaattggcttgtttaaagacaaaatacttcttattttctaa

SEQ ID NO: 39955 - DNA, 1885 bp, Homo sapiens
aggttttggggactttgttctacatgtgtatctaataaagttaatacaatgtttaagctttttgttaattaagaaatactaaattaatttctagaaaagagtctcatcgtggaaggcaagagggaaaagaaaaaagtagagaggttgacaatgcaagtctcttccttacagagagagccatttacaattgcacaaggtaagtttattctagcttcctttcattttgtggtgaaagtgcctaaatttgtgaaaatgatggtttgtagcttagtatcagcaaggtagtgttttatacttttggtataattttatttaatttgctctgtaagagcagagttacatgtaaattatgctgtgaaaataattctcattaaattaactttgtaaatgtattagtaagccataggtatttaattgtgatttttttttttccccaggaaaggggcagaaactttgtgaaattgagaggatacatttttttctaagtaagaagaaaaccgatgaacttagaaatctacacaaactgctttacaacaggccaggcactgtaagacctttttacactttaaacctacttgtatattacttcacaatggaatcaatttctgtaaatgttagtgatccactagttcaatttccacactttatgactgagcagactgaggtatatacttattaaatgatttatcacaggaaacacagctggatattagcacttggattataatatccagggctctgtcttcttttttctttttctttttcttttttttttctttcttttaagacacggtctcactttgtcacccaggctggagtacagtgtgcaatacatggctcactgcagcctcaacctcctgggctcaagtgttcctcccgcttaagcctcccaagtagctgggaccacaggtgcatgccaccatactgtgtctggctaattgttttactttttgtagaggcagggttttgccatgtgcccaggctggtcttgaactcctgagctcaagtggtcctcccaccttggcctcccaaagtgttgggattacaggtgtgagccagtatgcccagctctagggctctttctcctgtagtagtttttattccaaactgaaatttcaaattacgaaatccaaattgtgatgaaaggttttagtgacctttaaatgtattgaaagaaattcatgtttttggattttctcgacattcagaataagtgaatgtcggtatgatttgtatgagatcatacatatgatctcatttgtatctcatacaaataagaggcaaaatcatttgtatctcatacaaatctcatacaaagtgaatttggtgtaattgtatctcatttttagcaaatacctgataaattggatgatagttctttgctaaaggattgttattatactgtacatatgacttagtatattatataatcgagggaactgctttaggttgtacgtgggcaaagtaaagttgggtgttagaatgtctgaagtagaatagaatgtctggtgcatgacataatttattttcagtgagtctgttaatctcatttaatccttaaaccaatttaatttacacaagtcccataactagtgaacggtattagctttttgtggtactcgctattctttactttgaaagaataaagtccttcttgatttggaaaagaagaattactagtaactttattacttatgaaaaggatatatttttaaatagtaactttccacatcccctggtactgtcaggtaacttttggttgtggtaaaaactccccagtgaaaatttgttcaaattgttcttttcagagacttaagtttgtaggatttttataatgttaatatgttaatgacaaatacatttttcagttttgaataagaaatgt

SEQ ID NO: 39956 - DNA, 1023 bp, Homo sapiens
tttcacccaggaaacagttttcttgctcttttggtgtttagaggcgtgaagtcggagtgattttcagcgagaatgtgtgcacaatttatctgcttttgttttgagcgatggcgtagaattgactttgtgtattccggtttttaaagtatttgttagcgtggtagagatgtattggagtgcagccgacttctcgtccgctctaaacgttcgttaacatttcatcatttgacgggaagtttgtaggtcttggatttgatttttttttttacctgtgtgtgtgcacctttgaagttgctaagtggatgttctaattttgtccttttcattacacatcttttgccttttgaagttattgtaaggtcttggtgcagcccgttaagactgaagttataaggctagacccggaagtatttgaatactttcgaatatttttacatttaccaaaaagtttccctccctggcaaacagcggtgaaagctgttgctacttgagaaagtagttaaaaatgaagaaagtgaactctgaaagaaagttaaatgtgagcccagcactgtctcggtttcgaacctgtgtctgttttaagggagggcgatatgagccctgatttgactggaggtgtgaaacggaaacttgactgaatagaggagtgtgctgcggcagtttatccaggatgcatgcagtgtctgtttcaggtgtacccgcttcttgacatgtttccaaacatttaaaaatccgagtcgcatctcttagcattctttgatattagcttagtctgcggttatttcgtatatgtttacgactcagccacacttgggaagaggttgaagcgctcttcctaaacccggattttttttaagcctcaaccagcctgtggtcacaatctgggttaagattacaaggtgtgccttttgtttgtttaaagtggtatgtgccctaagaagggcatatttaagtaaagcatggctttttaaatataagttttcacataaactattgcttaacaacatgttattttaaaattat

SEQ ID NO: 39957 - DNA, 1103 bp, Homo sapiens
agaagaaaaagttagtgccacaatctagaaaaaaagaaatttcacttaatatgaatacacagtttcatttttggtttatggatatttaaaggagccttacaacacctgcatagagaacagattgcatcatttttctttacaaggctgaatgccagaagaaaatgatgaaatttcagtggggttttaagttaaagatgtcgagccccaatcctggttgtcttagatcagtttcttctagaatcagactttgagccaatgcccctgtgtgcaagttgtttattttggaggtgtggagaaaatcaggaggtaagtgagaagtgaaacagaaagacaaggaatgtagccagtaaaatgttaaatattaaggccgctaccactggagttaatccaatttggaagcattgggaaacagtacaagaacacatgctccaaaatcttcatgaccttagatttggcaatagattcttaggtatcataaaaacacaagcaacataagaaaaaatacataaattggacttcatcaaaattaaaaccttctgtgcatcaaagggcactattaagaaagtaaaaacaacctatagaactagagaaatcatatctgataaatgtctagtactcagaatatgtaaataactcttttttcttttaaatttttttttttgagacggagtcttgctgtcgcccaggctggagtgcagtggcgcgatctcggctcactgcaggctccgttccccagggctcatgccattctcctgcctcagcctcccaagtagctgggaatacaggtgcccgcaacctcgcctggctaattttttatatttttagtagagacggggtttcaccgtgttagccaggatggtctcaatctcctgacctcgtgatccgcccacctcggcctcccaaagtgctgggattacaggcatgagccaccgcgcccggcctgtaaataactcttgtaactgagtaacgaaaagataatccaatttaaaatgggcaagggacttgaatagacattcttcaaagaagatatataatggtcattaagcacattgaaagatgctcaacatcattaaccattagggaaatttaaatgaaaaccacaa

SEQ ID NO: 39958 - DNA, 1039 bp, Homo sapiens
ctttgtagatgtgacatctgtgctcagctaggcttaactaagcaaaaaggaaactggggggcacacattccgggaagaaggaagagcctatgtaaaaatcctgaatagggaaggtgtgcagtgcattagcaaagaactgaaagtggccagtgtgattagagttgagagcaagggggaaagcagctcataatgaggctgataatgtaagcaagaaccagaccattcagggcctctggctacattaagcatttcagagtttatcttaaaggcatgagaagttattacaaagttcaaagcagagcagatcatgtaatgctaaattttatgggtgaaagtttgatgagaaacaggatatttatatagtgtcaaagtactttgccacaaaatacttactgactgccaagggaaaaaaaataaatagagaaagctatcagacaccactctaaccaagtgatcaaagttaccattaccactaatggatgaatcagcatcatgtacctcctcatgtaatgcactgagaagaacataacatcactctgtgatacttctgctaacaacgcatgcctggatcagattgtgggaaaacataagacacacacaatgggagggacattctacaaagttccctgtattcttttaaaacacacacacatacttacacagtgaagtatcaaaagacagggaaagactgaggaactgttccaggttgaaggagactgaggagacatggcaacatgtgatctgggatggattctggaccagcacttttttctcttgctataaagggcattagtgagacaactggaaaaaattgaaaaatatctatagattagaccttagatcaatgtcaatttcctgattttcataattgtattgaggctatctcaaagaatatccttgtctttgcacactataatacttaagggtagaagggcatcttgtgtgtaacttactctcaaatggcttaggagaaaaagtagagatagaatgaatgagaatgagagttactatgaaaacaaatgacccatgataaaacatg

SEQ ID NO: 39959 - DNA, 1033 bp, Homo sapiens
tcagcgcctgcagaaggaaccagtcctgcagatatcttgattttggacttttaacctcaagaactgtgagagaagacatttttgttgttgtaagccacccagcttgtaatttctcacagcagccctaggaagctcatgtgcgttgttttatgattccccaccttttgatgaattaacaaccgtcccctgatcctgatcatacaggataaggatgcctctaccgtctgcatctctggctgttcttgtcacatctccatttgttttattaaaaccataaactcttgaataatttctacatcattttgaatgtaatcagaattctgaaattatcaaagggaaaaaataaagggcatttgtggaaaacagtcacgtgcttctgaacatcgtggatttgggggtttgacacaagaggagcatggaaatcagttcctgtcaacctcactttcagccacatagtcttgataaatgtcctcaagagatgtttattttctggcattttttggatctcctcgtagtaagaaatctctgatgttacccacaaaactacagaatatttaaactagaaaggacattgttgttagggaaataatacagaaaaaaaatccgcctgaaaattgcatgtgattcagttctgtgattactgagtggccctactatctagttctcgaagggtatgttgtctttttttctttttgtcattattaagcagtgttatttttccctaccaccgtaaaggcaggctgcctcactaccataaatccctcttcctgggtaatgtcagttaacatccatggagagtacataccaacctgaaattgacaaaatgttttaaatcacaaattgccagttagagaggtattttaccagtgtttattctcattacaggcatgcgagcaaaccacaagttcatcagaatggaattgatttaaccctactattgcagttgaaatatcttgtttcggattttgtcaagagataaagtagtattttgaagttgaacctggtgttttaaagcagcctgatgtatagccat

SEQ ID NO: 39960 - DNA, 1065 bp, Homo sapiens
tcgaaccatcataaataagtcagggactgtctgtactctaacatacactcgctaagctgcctctttcttcccggttggcattagaagttgaagctgtggatctcagccctggctgaatattaaaatcaccttggaacttaaaaaaaatttttttaaaagatgccttatcccccaacctcccacaaattctgatctggattaggattctaaaatcagtcactttaaattttaatttttcaaaaaaacagatctttggttgattccagtgttgagagctgctatgttgagaagtcctgctagttagctactgtacactttgtagcctatctaatacttgtgaagctttatagttcttttaaagtagtatataaagtacttttgtagtactttcacgttccatttagtgcccaccacaatctggtagggtagatgttattagtatcccacatacccacttaaccttgtaagtctcttatttgaggttacttttcatgatggaaccagactgaaagaaggtgactccaggcccaactgggtggacctgagccacaggaaaaatttcaggttacatatatatggggtgtgtttgtgtgtgtgtgtgtgtgtgtgtgtgtgtgtacatgcacatacattctatattaaatacatatatttgtattatatatagattttatacacacacattatatagtaaacataagtatatattatgtacataatatatacacatattaaaaatatatattatgcacacacattattcagacacatgcacatacaaacatgccattggtagtgatctctatctgtataaaacttgacatcccgggccccggtcaaggttgtaaaatcaccccctaacattccacctccttattcagtgggatcccttcagcagtgtgtgcccctcactccttatggaggcccagaattctttactcaggctcttatttttagatgggccccttctgaccctctgtaccccaattttctcccacctcacctccagggctgctggggaatcatcagaaggcatgctggactggagtcaggacacctgagttc

SEQ ID NO: 39961 - DNA, 1034 bp, Homo sapiens
gccgctttggagggaggaggaacaggaggtggtggaagtgttcgtggtgaggatctggatgtacgcgcccggggcggcggcagcggcggcggcggcggcgaagccggggctggctagcagtgcccttttgtccatggaggctgcagcggcggcggcgacgacagccgccccctccccacccccggcggtcaccaggtactgctccagagcgggctggattccctttctcatctctcgctcctgctctttttagtgttatggtatattaatgtattgttttcaatttctttattatttgcagtcggagtttccaagtctctcctccttctctcctccccgcccggcgcttccgagccccctctctctcttttctttttatttttccgcaccgcacaggccccgggggccaaaaataatcggggctctggagagaggagggtcccggccgcacggatatcgggccccaagcggggatggaggcgtcgggggcggccgatgcaacggattgcgaggcggcggcggcagcccgggtgctgcggccggcagctgaaaaatggctccaggaagctgctgctgacaatgaatgaagggatacggtttacgcgccaaggtcctcccgcgaaactcggatttcccgccggcttttcaaaccatatttgcatatccccgcccctcaacccgccgaggaccgttcccacagcccattgggccgctacctccttacttcagtcccaatcatggagcagggccgcgacttgctggtttccattggctgccgtgcatcatggttaccggggcgacagggaccctatttgcataggcctccttgattggctggcagaagagcagtttttagggggtggggcaaagaatttccttctctcccacggaagaccacgcctggcctaggctccgcccctgtccccgcccgcccgccgggccggcgctactgacctgggcagggactccgcgccccgcagactcagtgtagatctagtctagagcccaagtttcgcttttggaaattgtcaagg

SEQ ID NO: 39962 - DNA, 1091 bp, Homo sapiens
gctgatttttgtatttttgtcgagacggggtttcaccatgttggccaggatggtcttgatctcttgacctcgtgatccccctgccttggcctcccaaagtgctaggattacaggcatgagccactgtacccgacctattttgaatttttatggttacatagtaggtgtatatatttatggtgtacatgagatattttgatactggcatacgatgtgtaataatcacatcagggtaaatgggatatccattgcctcaagcatttatcatttctttgtgttacaaacattccaattatgcttttaaagttatttttaaatgtgcaaggtacaatacctgacatcaaattatactgtagatctatatagtaactaaaacagcatgatactagcataaaaacaaacacatagatcaatggaacagaatggagagctcagaaagaaatccacacatctatagtaaactcatttttgacaaaggtgccaagaacacatattggggaaaggacagtctctaaatggtgctgggaaaactggatccccgtatgcagaaaaattaaaccagacccttatctcgcaacacatacaaaaaccaaatcaaaatggattcgatacttaaatctgagacctcaaactatgaaactactaaaagaaaacattaaggaaactcttcttcctcatttatgagctcttcatttaacatcctttcctcttctgtacattaactgaaagttgattcttccatgaaaatccatttttctcctgaagctctttcatttgaagtctgcaagttcaccagtatcccatggactttgaatctggcaatcagagttgactttcttctgatctccattctgaattatacactattttttgtctcctatgagtaaaaattatgctccttggcagtttatgccaagccctttgcagccccttcatagtcatccatggattttctgattactcttgctcatttactaatattttagtgcctggtcatagtcttttccatctggttaaattggacttttattttaggtgactttaaactttgctttgacagtcaatcttgcatgatagtccctcaattcatt

SEQ ID NO: 39963 - DNA, 1059 bp, Homo sapiens
ccataaagcagccattactcactgtaggtgtctgctttgatcttacctgaaccaaagtattttataacccataaactggaaaaaaaaaaaccgaaaaacaaatagtgtcacttatcagataaaattaggtctggctttctttcttttctttttcttttctttttttgagatggagtctagcttttgttgcccaggctggagtgcaatggcacgatctcggctcactgcaacctccacctcccggattcaagtgattctcccacctcagcctctcaagtagctgggattacaggcatgtgccaccatgcccagctaatttttgtattttgagtagagatagggtttcaccatgttggtcaggctggtctcaaattcctgacctcaggtgatccacctgcctcggcctcccaaagtgctgggattacaggcatgagccaccgcacctggcctggcttcttagaaacaaatgttcaagagaagcagtggcttaaatgagagaaaagtttattttttcctcaagaattcaaaggttggctgtccagggctggtaggcagtcccatgtcttcaaggacccagctccttccatcttcccagcactggcttgctttctcaaggcctctgtgtagtcctagatggctgctgtggcagcagaccttgttttctgttctaggcagcaggaagaagaaaagatgaggaggacaaaaagagcttccctcagaagttttattcaatagttccttttctgtctctttgaccagtgtataatcacatgaccacactaagctgcaaagggtgaggggaggttgggaaatgtagtctgttagctgggtattctggggccccagataattatgtgagttttattactaaggaataaatggagaatgttcactgaacaggcaatctttgccacagtcaccttcatcttatccttgagcctcattctctgcatcctagaccttcatccctcccttgtccatgtcctggcacaggaagtgatccatcagtacttgttgaatacccttctgtgctttgcccatttctggccccatctctgg

SEQ ID NO: 39964 - DNA, 1034 bp, Homo sapiens
aaggcagttgaaatttttggatcatatgaatgctatacttctgaagttgtagactaaagtagagtggcagttctgccttcttttcacttgagttcagtttttgaaaacagataacagcagtaacaggccatgtatattcagccttctaagttttatctgaaacccaaagttaggaacctatttatggcagaagagaaggggcaaattccaaacccctctggctgtcttgatatttttatattacataccactatgcagcatagtactttttataatgtatctcattgttttgcatttctgcattaataatttcttgcacggtaatagcaaaaacacctttttttttttttttttaagttagtgggcaaaaggctatgtgtatcttagagagtattcttcttcttttcaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatt

SEQ ID NO: 39965 - DNA, 1120 bp, Homo sapiens
cttcaggaaacttttccagtacaagacttgtccacagtggatatagcagctaaggggttaacaaaatgacgtcagagtagctacggtaatgggcaggagcctctcttaatctgcaaccaggcacagagatggaccaatccaagaagggcgcggggatttttgaattttcttgggtccaatagttggtggtctgactctataaaagaagagtagctctttcctttcctccacagacgtctctgcaggcaagcttttctgtggttttgccatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagtcactttttcatcagtcttaaaacccaaaggctcttttcagagccacccacttattccaacgaaagtagctgtgataattttttgttgtcttaacagaacaaatttctaaggacccccccggaaagcattagactatggtcttaaagttgattaacagaaataacggtttggtcagtcttgcagtgtaggttatttctgaccttattaaggtgctatttggagagaagctgtgtaagtccactatcattcaggcctctagcttgctatgattagcatttgtttaaacaactttgtaagagtaagggaaaaatctggtaagtagttaactggcgcttactaggcatttttgcaaagctttgaaaagattagaaaattgtgtcttgcgagttccagtgtcttcctcaaaatgcttaggaagattttctcagctca

SEQ ID NO: 39966 - DNA, 1057 bp, Homo sapiens
atttgacattagccaatgggagaattcctcacagcctacctccagtcagtataaatacttctctgccttgcgttctaatgtagtttcattacattttcttgtggcgattttcccttatcagaagtagttatgtctggtcgcggcaaacaaggcggtaaagctcgcgccaaggctaagactcggtcttctcgtgcaggtttgcagtttcctgtgggccgagtgcaccgcctgctccgcaaaggcaactactccgagcgcgtcggggctggcgcgccggtgtatctcgcggcggtgcttgagtacctgaccgccgagatcctggagctggcgggcaatgcggcccgcgacaacaagaagacccgcatcatcccgcgccacctgcaattggccatccgcaatgacgaggagcttaataaactcttggggcgtgtgaccatcgcgcagggtggcgttttgcctaatattcaggcggtgctgctgcctaagaaaactgagagccatcataaggccaagggaaagtgaagagttaacgcttcatgcactgctgtttttctgtcagcagacaaaatcagcctaacagcaaaggctcttttcagagccacctacgacttccattaaatgagctgttgtgctttggattatgccgcccataaagatgtttttgaggtgtttttaatggctttgagtgtggcacttttagtaatttgtcctgcagaaattagatccatagaaacctcaggaattctaggtatgtgggagaagtgccatgcagcacaaaacatgtttacaggggtgattcgcgttaagtttcacacacagcagttactacattttagaggaaggaaattatacccatgagtgcattcctaactatcttgaatggaagtgttaaaacccgcatgccccacacaagtttgaatatgtcataccatttgctgtagcaattaatggcatacacaattgagagcacacacattaccactgaacatttgagtatgtatttcccaaaatgagcttttttccagtttggggatgttttgctttgttttggggtgga

SEQ ID NO: 39967 - DNA, 1089 bp, Homo sapiens
tgaagaaacagaattatcatgaaaatttaggtggaaaccatttcgcttttttcttcaaaaataagggaagcatgtgcccaaccacccctgggaaaaagaaccttcaggggcaaaggagcgaacaggtaatttataagaaaaacagaaagtggtctctgactgccccagacttccttcggagttgggggaattggggacgcctggacgcgttgtttttgtgtttgtggaaaaaataaatgaagagcatgaagcccgaggcttctgagatcctttcctgaccaaacccaagtgatttggtgcggggaattttaatatttttccccttttgtgaggtggaacaaacacaacttgggagcagcgcagcggctcagagcctgccagccaggcgggcgaccagagcaccaatcagagcgcgcctgcgctctatatatacagcggccctgcccaggcgctgcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaagg

SEQ ID NO: 39968 - DNA, 1431 bp, Homo sapiens
ttgaaaatatctccaagtttaaatagacaaatcaagatatgaaattaacctttctaaacttaagagggtaaaaagaaatcacttggccaatcacaactagcgcgcgtctttttaaaacgttgatcaaagccagtttcagcgccaacatttaaaaaaaaattaagacacgtcatcctagtagctagacacaattttgccaaggaaaaccaaagtacgttttaaataaaagctagaaacatggcacagaggggaaagggttgaaaacaccagcagttaaagatggacggaggaaagttttaatatttggtctacatgcaggagatgttctgtcagggagtgggcgtctccaccaatcgagctgcaggggaaaggctgccttgtccaatcagaacaggggtgtctttatatatacgggtacgaaaggctagactttcgttttttcgtcatttagcagggtttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaaattgtcttgtgaatgtgtgctaaccaaaacccaaaggctcttttcagagccaaccaccttttctataaaagttgctgtttactgttgctgtccgtaaactggaacctctgttcactcaaggtaagtaagcattcttgcctctatccgttccccctcccctcacggaattggtgcaaaaagctttattataattggggagttcttaaaacagcctttaaggtactcttatatctccttgttttgggggccgctttcttaggcttggatgcctccggcttgggaactttcttggccacctttgaccaaccaaccttctccagcagcctccaccagcaaaagcttttggggtccgcttagtactctttttcggaataaggacgccccaagctttcttgggcctctcggctgccaggacagctgtcttgggcatgactgcagcggcttttctggcctcggtcttgattttcctaacactgcctggtttggcgggaatgaacctgaggcgctgcactccttagcacgaagatgccctcgtttgttttcaaggccc

SEQ ID NO: 39969 - DNA, 1052 bp, Homo sapiens
ttctttgcaattggttggttgttctagccaatcaaatagcgttatttacaattcgacctccaagtataatagtttctcacttgctaacaaaattcacttttacatttttgtcttcattgcttaacatcgtttttaagaattcaaaatgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaaaacgagaactcttatattggctttttaaggaagcagtcttaacaaaggctcttttcagagccacccatgtattccttaaaagggctcacattttctgtgtaaatagctattttgcagttttctttaataatttttccatttataagtgggtgttcttaacactgaatcgtgaaactaaccgtccattttaaagatgccataaaaatacataagcaaattggcggggcgcggttccttacgcctgtaatcccaggactttggaaggccaaggtgggcggatcacagggtcaggagttccaggacagcctgaccaacatggtgtgaagccccgtctttactaaaaataaaaaaatttgtcgggcgtggtggcgcgcgcctgtaatttcagctatttaagaggttgaggcaggagaaaatgttgaaccccggaggcggaggttgcagtgagtcgagatcgcgccactgcactccagtttcggcgacagagcgagactgtctcaaaacaaacaaaaac

SEQ ID NO: 39970 - DNA, 1033 bp, Homo sapiens
attgcccaatcagagctggatattttgaattctttatttgcatgaaaggcctataaaaggagagactctagacacgagcttttatttaagtgcgttcattctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaagagctttaatattgaatttcaccgttttctagggaataatttttccgattttgtaatcccagcactttgggaggccgaggcgtgcggatcgagaccagtttggctaacgtggttaaatctcgtttctactaaaaatacaaatattagccgggcgtggggcagtcgcgtgtcatcccagagactcgggaggctgccgcaggagaatcacttaaacccagcaagcaaaggttgcagtgaaaagacatggcgcttttgcattctagcctgggcgacaaaggcgaggcttcgtctcaaaaaaaattgatcaggagatactcctgttctgtgttggcaagatcctgtaatcctagcactttgggaggtcgatgcatgaggctttcttcagctcaggagttaacagatttgcctgggcaacatagaactcgtctctgcaaaaaaatgaagctaaccaggtgtgacgg

SEQ ID NO: 39971 - DNA, 1137 bp, Homo sapiens
catgagatagtatctcattgtggtatagatttgcatttctttgatgattagtgatgttgaacttttcagccacttgtatgtcttctattcagaagtgtctgttaacgtctgttgcctatttattaatgagattttttttgtttcttgatttgtttaagttcattatagattctggatatcagacttttgtcagatacaaggtgattggtatatatttgcgaatattttctcccactctataggttgtctactttgtaaatagtttatttttctgtgcagaagcaatttagtttacatcacacctgtcaatttctgtttttgttgaaattgcttttggggacttagccaaaaattgttggccatggccaacatcaagaagggtattttctaggttttcttctaggattttagtttgaggacttattttaaaagctttaatcgatcttgagttagctttgtatacggtgaaagttaggggtccagattcattcttctgtatgtgactagccaactatcccagcactacttattaaataggtagtcctatcccaattgcttattattgtccaccttgttgaagatcaggtgattgtgagtgtgagtctttatttcctggttttttgttctgtaccattgatctacatgtgtgtttttgtacaagtatcatgctatttttgtgactgtggccttacagtatagtttgaactttggtagtacaatgtctctggatttgttctatttacttagaattgcactggttatttaggatctttttaggttccatatgacattggtagtttgctaggaatagtgtcgaatctttaaattgctttgggcattatggctatttttatgatattgattcttcctatccatgagcatgtaatgcttttccatttattagtgtcatcttctttttctatatggatgcctttcatttttttctttcactttattactctgactagaacttctagtatatgttgaataggagtggtgagagtgggcacctttgtcttgcagttcttaaggggaatggctccagctttggcctatttggtatgatgttggctgtgagtttaccatagatggcttttattattttgacctatgttttgtgatgccaactctgttgag

SEQ ID NO: 39972 - DNA, 1059 bp, Homo sapiens
ttgggaaatatgcatgtttcaataaacactataaattgtttctggaacctgtgcatctttcttctgccaaattgcatttggaacatttttatgaaattaattgtacaaccttgttaatgagtattctttttgcagctcatcataatttttagaggtcattatgattttgtcacattattttaatcacttatttgcatattatttgtataatttggtaaaaatgagacattaaaataaataatgagatgaaaattagtttcttggaaaaaacatctctcattcctctggaatgagttgcatgtctttgttcaagtttgtttgctattgttgtacgtttttaaaatcgtgattaatacatagtaaacaacattataggttgtttattaatttcaaatacacagagttttttcctgaaataaatatgatcagatagtagacatggatttgataactttaaactgaaatatatagttatttaatttaaaatcaaacctacaaaaattgtaaagagatacagaaggcactgacttatttggtgtctttaagaacaaaagtgggcgaaggacatgaacagacacttctcaaaagaagacatttatgcagccaaaaaacacatgaaaaaatgctcatcatcactggccatcaaagaaatgcaaatcaaaaccactatgagataccatctcacaccagttagaatggcaatcattaaaaagtcaggaaacaacgggtgctggagaggatgtggagaaacaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagt

SEQ ID NO: 39973 - DNA, 1077 bp, Homo sapiens
ctcactgcaacctccatgtcctgggctcaagcgattgtcctgcctcaacctcccaagtagctgggattacaggcacccgccaccatgcccagctaatttttgtatttttgtagaggtggggttttgccatgttggccaggttggtctcgagctcctgacgtcaagtgatttgcctgcttcggcgtcccaaaatcctgggattacaggcctgagccaccatgcctggcctgtcctcatttgtttatccatctcattttttgtccttctcaccaaagttatgttgctttgtcttgtgggttttttttcatgtggattcctgaaccccatccagccccttgtcccctccccagccagctcacactcttttctcacagctcctgggactcccgttgacacacagggaacagccacccacagtggactgcactgttctgtttgcacccttaaatttatcgtgcttacagaatgacacttctgcaaactagtcaagtagggggaaatggtttgtggatatgcacccttgtttattctctttgaaaatgtaaccagctctgaattctttctcctctgaggaggagtttcacttgtcgcccaggctggagtgtagtggtgcaatcttgactcactgctacctccacctcccaggttcaagcaattctcctgcatcagcctcccaagtagcttggattacaggcatgcaccaccatgctcaccgaattttttttttttttttttttttttttttagtagagatgaggtttcaccatgttggtcaggctggtcttgaacttttgacctcaagcgatccacctgccttggcctcccaaagtgctggaattacaggcatgagccaccatgcccagcctcagttctgaattcttaagaaactcgagagggtctaggtgagcattgatagaacctctgcagtgctgggtgtggtggctcacacctggaatgctagccctttgggagaccgaggtcagaggatctcttgagcccaggagtttgagaccagtctgcacaacatggaccccatctctacaaaatatttaagatgagttgtggctgggtgcagtg

SEQ ID NO: 39974 - DNA, 1063 bp, Homo sapiens
gtctgtaatcccagctacttgggaggctgaggcaggagaattgcttgaacctgggaggccgaggttgcagtgggctggagatcgcaccactgcattccagcctgggtgacagagcaagactccaaaaaaaaaaaaaaaaaaaaagaaagtgaacttggattgattgtaaatatctattgcaaacacaagaacaatcaccaaaaaggtttaaaaagggaagtataattgatatgttaagaaaggataaaaatggaatcttacaaaataaaaccagaaaagagaggaaaaagtggaagataaaaaaaaagaagaaacaaaggacaaggacaatgaatagaaaacagtaacaaatatggtagatatcagtccagctatataatcactttaaatgtcaatagtttgaatatatcaattaaaatatagataattagctgggcatggtggcatgttcctaaaggcccagcaactcaggcgaggcagggagggactgaggcaggaggatctcctgagcgagcccaagaggtcgaggctgcagtgagccatgacactcaccctgggcgacagagtgagaccctgtctcaaaaacagaaacaaaaagagactcaatcagaaaacaagatccaactatctatatgttgtctaccaaaaatccactttaagacacctatagattaaaagtaaagtgatggagaaacatataacatgttaacactaatcaaaagaagcttcagtagctaaactgatattagacaaagttgacttcagatcaaggataaagaggagcattacattacattgtagcattataatgatggaagagtcaatcatcccagaagacatacaaaccttaatgtgtatgcacctaacaagagagtgtcaaaatatgagcctaaaaccaatagaactgcaatgaaaaatagtgtattagggatggagacttcaacacccatctaacagtaattgacagatccagcaggcagaaaattagtaaggatatagcagaactgaacagcaccatcattccactggatctaattgacatctataaactattacattcaaa

SEQ ID NO: 39975 - DNA, 1054 bp, Homo sapiens
ctatacatactgtactgcttttccctacacatacatacctatgataaagtctaattgttataaactaggcacagaaagagattaacaacaataataaaacaactataatagtatactgtagtaaaagttatgtgtggtctctcaaaatatcttactgtattgtgctcatacttcttgtgatgatgcgagatgataagatacctatgtgatgagatgaactgaggtgaatgatgtaggtattgtgacacagtgctaggctactcttgaccttttgacaatacctcagaaggagtttcatctgcttcaggtgatcctggatcatgaagccatggcaatgtccatggttggatgtcaggagcagacaatgtcgtggatgtgctggacaaatacattcatgtcccggggggatgaaaccggatggcatgagattttgtcatgctactcataatgaagcacaattttaaatttacaaattgtttatttctggaattttccttttaatattttcgaacagtagttgacatcaggtaactgaaaccttggaaagggaaactacagatagtgcaggggctactgtacaaatctggtagacatggaccataaatttgccaagaaacattctagggcgttgcttctcaaaatttaaagtacttatgaatcattcagggtcttgtttaggaggtctggaaagaggtctaggattcagcatttctaataggctcttggtgatgctgctgatctgcatactacactctaaaatactagttactacagtgacttcttcaatatgaaataacgaagttttggctatgaattttgagaaataaaaaattaaagcgaatgtgccatttaagacattgataaaataatagtgaagcttttagagattggcaaaatgaaaaataactttgtaaaaaaactcaaaattggccaaagaaatcccatcacacatagaatgctaaaatttataattttggctgctagaaatacaaaatttgaggaattgaataagtactaaaaataactaacattatatttaaaaggtgatatttag

SEQ ID NO: 39976 - DNA, 1059 bp, Homo sapiens
tatctttcattgtgaagtacttccagaggtattctttatggctacctgctttgcaaacataccttccttggtgtcatttctgttgatgaaaacatatttatttcttgaacaatcggctgtttccaaaccctgtattgtattgatgtcgtccctcctgtagaaattctactgctgtgaggctgcctacactaatacgtgctgtgctgttacctgtagtgccaggtgtggaggggatgctaggcagctctgaggtctgccgcactgctcatgcttgcggtgatagtggtagtggtagtgatagtgactgggcttgcaatatgggaaagattcaggatcctctggggtctgctgtaaactcctgataccattgaatctgttctttaagaatattgccagcattgactaccctgcttcttttagttgtcatctcttttgttttgggcaacagtttacttcctgattatgtactttcctggttatgtttcttctgttgttttatgtgtttgctgataaactgctttctttcattggtatattttattaattctgttaccctgactattctcaaggatcttccctctgcctctgctctttttcacatatatttctaaggctttagctattcttgtccttctttttttgagctgatactttccatcctacatttgaacatccttgttattctgatgttggcatctttcacttccacaaacgctactatagtccagctctccatttcttttcttaattctcaaaatgcctagacttgaacttgttagtttctccctgctaaattatttctctactatttacaactcttcccatatctagcaatgatgtgattatttcttcagtgttccaggctgaaacacatggggtcttagctaataaatctttcctgtttgttctgtctttaaatcatggttcttggattttttgttttgttgtttattagcaaggaatcccaattcaaactgcccccttcagattcagttcatctctgtctactcttagccatctctgttgtcacctttttagtcaactattaccttaaatgta

SEQ ID NO: 39977 - DNA, 1030 bp, Homo sapiens
gaaaggacaaagcagttcaaagctgttgaagatatttctggtttagtattcaatactgaaagcaaaagcaaatgactccaaggtcataattccttcaaatttcctctagcaggtttcctgtgctattgtcatttgaggctgtgaagctactaggatcagaccctcagctccaaactccctttctgctggtttctcacaaatacctgtgaacaggtgcatcaaccgtgactagcaagtggagttctagggggagagaaaatccaagtctcttgtctcagaatgctcctttgaactccacttttctcaactgaattccaattcagtatggatgacttatttcatctaaaagctggaagctcttaatgcacctagaaaattctttgttactagacttagtaaccaggcaccaaaacatcttttactgtagtatctacttaccatactacccaagaatggcacactgctcacatcttcaaaagcttaaaccaagagcactacacaggtgcgtagtcgtggccgagtggttaaggcgatggacttgaaatccattggggtttccccgcgcaggttcgaatcctgtcggctacggtttggttttagcctgacttctcccaaatagtttccttctaattgcaccccaaaggcaactgagtctcctggattacaattgtgtcatctcctttggtaacactgcgttgaactctgcattctagctgtcatcatcattattaaccctgcgttgtagtttacctctttctctgagtccattactttcctcctcctccaacatccgagacaaccgtgtctcgagtaagagagaatctattgctgtggtgtaaacaccacctaacgttaatcctgatttgaggaaggcaattctcttttcctcacctacaagctctgagaatcgaagtcagactccatcgagttttctctgtagataagtctaagttgcttgtctggtgtgtgaagattttgcctatagtgtattaagtgttttgttagcccaagtttagggactgtcattcaa

SEQ ID NO: 39978 - DNA, 1050 bp, Homo sapiens
gcccttgcggagcagtcggtgcactcggcccacggggaactggagaccggcacgagaagagcgggtcttggctttggcgcgagctttgcctccctgcttgccgcgtcccgacatgacgaagaaacgataaatggaggaactgagaacagccgagagaagttcaccagagctccactacttatagtcaatactgggcgcgaaaataaagctgtgccattggctcaaattacagttttatttcaaccaatggaatcgctgttatgaaacatgcttctttggattggacaaacgtgtatatgacgtcatctagaatcgccaccagtcctacacactattttattaatcacctcatttgcataagaattcgtgaacaggacgttacaacacacagctttttcttcttcttctttttttgtttttttaagacagggtctccctctcgcccgggctggagtgcggtggtacgatctccggtcgctgcaacgtccgctcctgggttcaagtgattctcctgcctcggcctcctgagtagctgagattacaagcgtcagccaccatagcccggctaatttttgtattttttagtagagacagggtttcaccatattggtcatcctggtctcaaacccctgagctcaggtgagccacctgcctcaacctcccaaaatgctgggattaaaggcgtgagccacagcgcccggcgactttttttttttttttttttttttttttcccttgagacagggtctggctttgccgcccaggttggagagcagtggcgcgatcgtggctcaccgcaacctccgccttcctggccgaagcgatcctcctccctgagcctccccagtagctggggttacaggagtgcatcacgcgcccagctaattttttacatttgtttgaagagtcatggtttcgccatgttgttcaggctgctctcgaactcctgacctcaagtgatccgcccgcctccgcctcccaaagtactggaattacaggcgtgcgccgccgcgcccggccgctttttcctattccttgtaccctttctgc

SEQ ID NO: 39979 - DNA, 1097 bp, Homo sapiens
ttttcctttacgttctttaactttttgtcaaatcagtaatgacacctcgtaattaaaatagtgcaaggcaagtttagatttatcaagcttatatttaaacaggattttgatgcatgaaaaatcctagacttttgggggatttttttttgtttccgtttttgtttttctttagctagcaaaaccattttacgtttcttgacccaaaacagaggcggaatgtctccctttcactagcagattaaactgggagccaattccgtgtgtgagacgtggcatggcacagtctactgtccaatcagaacgcgagggcagctataaataccgggatgatcagtttttttctctcatttgtgttgagtaggtacgtctacttagccatggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctgcgcttccagagctcggcggtgatggcgctgcaggaggcttgcgaggcctacctggtggggctatttgaggataccaacctgtgcgccattcacgccaaacgcgtcactattatgcctaaagacatccagcttgcgcgccgcatccgaggggagagggcataaatattcctatcagcccaagaagtctgtccaaccccaaaaggctcttttcagagcccctcaattgtcaccaaaaggaagctgtagcttttgagacgtgtcttagctccatgttaaatacaagctgtggacaaaacgtggtagtggcccaacacactataatgcaggagtcaggtcacaggctgttggtatgctaaatcaatttcacatacagaacctgttcctactgataaggattatcactcaaaaaagacatgtcatggggtcaattttacagatgaagtttagttttgaaaagtattcctgttttta

SEQ ID NO: 39980 - DNA, 1018 bp, Homo sapiens
gcgcccagcagctgctataaaatgcgcgtccctgtaggttcctttcactcactttctgacttaggccacaggtcgttttaccatgtctggacgtggcaagcagggcggcaaggctcgcgccaaggccaaaacccgctcctctagagctgggctccaatttcctgtaggacgagtgcaccgcctgctccgcaagggcaactacgctgagcgggtcggggccggcgcgccggtttacctggcggcggtgctggagtacctaactgccgagatcctggagctggcgggcaacgcagcccgcgacaacaaaaagacccgcatcatcccgcgccacttgcagctggccatccgcaacgacgaggagctcaacaagctgcttggtaaagttaccatcgctcagggcggtgttctgcctaacatccaggccgtactgctccccaagaagactgagagccaccacaaagctaagggcaagtaagggctgaactttaaaaatgtaaacttacaagacaaaaggctcttttcagagccacccaccatttctacggaagaactgagcactctgttctccaaacctatcagaaatttgtggccgagttcaagcactgaggccattactttcctattgggtaaaataaaagtattgaatcaggcctagtaaatactatccaactgctaccttataacatgaaggaacctccttaattgtcccctccccacaaactgtcctgggtctttaaaaaacttggggccgggcgcggtggtttatgcgtccttagcattttgggaaactgaggcaggtgggtggggaggggagaaatctctagggacctggagttcgagaccaccctgataacgagacccctgcctcttaaaaaaaaaatgactgggcgcggtggctcacgcctgtaatcccagcactttgggaggccgaggagggtgtatcacaaggtcaagagatcgagaccacccaggcaaacatggtgaaaccctgtccctactaaaaacacaaaaattagcc

SEQ ID NO: 39981 - DNA, 1064 bp, Homo sapiens
ggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaagggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaacta

SEQ ID NO: 39982 - DNA, 1020 bp, Homo sapiens
agttacttaatatactttaaaatttgagaagcgttgagttgaatgacagctgacttcatggctgtctgcgaagtggggaagcctgaacacagtcctataaactaaaggccactgcagacttttagcacaaggagatccttacagggaacatgtgccatcagctctttggagtgaacaaggaattagacccccatcatgccaaaaaactaggatttttaggtggtctttccatcccttcagatttaagtattcaaagaaagagagacagacctacattccaagggtcttctgagtgcaaggccttgtgttgtttgtttatttaggggagggcctggtgctcttctctgttttatgctttaccttcttttatttctcagatctcatgttagcactatgttctgaattccctaataatggctcttgagaactgatttacattttgttggtttgtttacttcttgagcacataaaaggaccccaaattagagatactatcccttgggcttctgaaaaatgaatcaaccaaaactggttgactctaaccttgccttgctgagtaaaaattctgctttggatgagaacctgtcttgattattttagtggacaacagataagccacatggaagtacacatggctcctgatctgtctttttatttacagaaatcattcttaatctctactgagatggcctgttatttccttccttttctaccctgccacagcaaactccacagtttctgggactaacttcctactacaccccaacacaactccagtcctctcttctcttcacacttctagctggttagtgggtttgaagtggtgagacagtgacaaaaggggaaggggaaaaataaaagaagggtaatctgcattcttccttagtaagtcccactcctaattacctttctacacagccctgtgtctttgtcccatcttctcttcactcctgtaatatactccccagccccattttcttagtgcccctgtctcttgcctctctagccataaaccctgta

SEQ ID NO: 39983 - DNA, 1114 bp, Homo sapiens
ctgcaatcctagcactttgggaggccaatgtgggcagatcacctgaggtcaggagttcaagaccagcctggccaacatgatgaaagcctgtctctactaaaaatacaaaaattagctgggtgtggtggcaggcacctataatcccagctactcaggaggctgaggcaggagaatcgcttgaacccaggagtcggaagttgcagtgaaccaagatcttgccactgcactccagcctggacgacagagtgagactctgcctcaaaaaaacaaaaaaaacagggtttggacatgttaattttgagattcctattagaatccaagcagaaaagttgagcaaacaactagatataataaactggaattcagtggaagggtctgtgctagaactacagaattggggcttttcagaatacgcatagtatttaaagccacgagataggatgagatcatgaagggagtaatgagcagtagaaacagagtagctagggaggtacaaagaatgggattcttagatgcagacaaaagtaatttggttttaaatgtgctgaatttgtattgccaaccagttctttctctgaaagcactgcaggggcatataatggagtttacagcttgatttctgaggcctgaccagagatcccagaatagaaggcacagctcgcagtactggccttttcccccggctttcttttttcaaaatatgagatatcaaaacaccgttttctatacatctgagatagcattttgctgactctcgcttttattctgaagactgaggctacaaaatgaaaatgtatcagggaaatagaggcagtatatggtgatttcttagttataaaatttaacctttgaagagaatgggggagtaatttgagaacctgttgtatgccaatccctgtgcaaggtggtttatacaaatgttatttataatctcagagagagtaagtaactagcccaaggtcacagagctactagactaagagagagagtaagtaatccatgtgattccaaatccctgctttttacaataccttgctgaagaaacctgttatttttaaatgcaagaggaaataagcccatggaagaatgggagccacccagtggctgaaattga
